United States Patent 8,781,750 (CELL-TYPE-SPECIFIC PATTERNS OF GENE EXPRESSION) - sequence listing, part 11

SEQ ID NO: 36198 - DNA, 278454 bp, Homo sapiens
tcggcgggaagcggcgatcctgccaccgggaggtgtggaagagccgggtaggtgagcaaagtccctccgcgcggtggccgaggggcgcgcggagccggggccggcagacgccaggacgcgccgctgcgctctgctccggggcgggaggcgcgggtcagtctcgctctggctgcgggaggccctgccggggaccgaagcgggaacgggggcgcctcccgggggtggaggccggcgggtgcccgggccgctgcgacggggcgctgcgctcggcccgcggggtccccgagccgtaacaaaggcgcggcgcggccgcggctcccacccacttccgtccccggagcgcgcctcggggaggagcgggccggggcagggtttctctccgcggagtttcgggaagttagcgcggctgcccgttacgctgagagcatggcggggaggcgggtggcccggggagtggcgcgccagtgatcagaactacgacatcgcccggttcctttcccgacaccagccgcaagtggccggagctgcggtggctcccgcgccccagcccggggtcccagaccggcgcctccgcagggcccgcgcgggtttgaacccgatgcgtggtgcgccaggccaccccagctgcccacgtttctgcgcgcgtgcgggctccccgaagggagtggtttagtccccgggtgacagccagcagtccctggcaccccgagtggagctccagaaggcggtaattgcattacagtgagtgagcggcggggaggctccagtccaggccgcaatctgggtcaggtgcgggattaagagcttcaggcgttggcatgagagatcttgtgaagtctgacagtttattgcaatgagaagttcctcacaaggggagaggccagctggggaaattaaaggagctcctgtccgccatccccagccccatcccgaggttgtgataacttgtgcctgtgcaaaccctagcacaggcacgcgttttgtcatagaaatgtcagaggcagcatctctactgcgccagatgtttctcagcatctgaacaggagaggaggaggtggtattgaagagaaacccaggacgttctgcttgctgtgaaccctagcccctcgcagtcaatcgatggaattcacgttttcgtgtcttgtcttatctgcctccacccccttcttctgttggaaggaaagggcaggcactggtttttatgaagggctaatggaccagggactctcccctacacaatgtggaaggctcttcattttctctttaaaccttacaacctcttcccaggaggttatttctgtttcacagatgaggaaactgaggcttaaagaggttaacagatccaagagtctgccctgttccaaagaggactgtttattcttccaggttatttttttatttttgacaaagtcggttactgaagagcgctttatggactgctgggtgtgtgctgtaccccggggttcaggtttgattatgctaggctatagggcttgatggactttccacctatctctggcttgtgttaatgccagtgccatagctaaaccaactcatatttaaaacttaatgtatatgaagagaactaaggtttcctccccaaacctttagaattatgacagttccaaagagaggtggaaatagctgtcctttgctttttgcagtgtttcatcaggcaggtgggcctggagtcaggaattctacacagcacggagctctgtttgccttttcttttgcaaggagctgcagttcccaccttgtttaagctgtgtgtgactttgccactgtgctgaatgtgcgtttaaaattgagtgaagtatgctttggaaataatggcccaccttactgactgataagttaaaacctcagaatttctttgagggatccaaggatatggttgtatccacaacttttatacaacatttgagctcaagtttacaaaataggactttggcattgtcctgaatgtacttaaaatgtattgccttcaagaaagatgtttgcaactctggcgtgacagtcagggacttggaacgtcctaggtagaggcagccaggcacgctgatgagggcaagcctggaaagtctgggaagaatggctgggttcggttgctgccttcaccatttagaggtctgcagccttggacaatttgcctagcctctgagcttcactttcttctcttaaaacataaatcaaaggccaggtgccgtgcctcacacatgtagtaccaaggctttgggaggccgaggtgggaggatggcttggggccaggagtttgagaccagcctggacaacatagtgagaccctgtttctacaaaatatttaaaaattacctgtggtcttagctacttgggatgctgaggtgggaggatcgcttgagcccaagagttcgagcctgcagtgagctatgatcgcatcactgcactccagcctgggcaacagagctagacagctgtctgtaaaaaaactaaacaaaacaagctaggaataataatagtgcctcctggtttcaaaccatgaggactaaattagataattcatgagatactcggcacagtgcctagcacatagttgctattcaacaaatgttaactaataatgatgatgtttaagaacagaatccttcccttcctcccctcatccagagaggtaaagtagttcttagttgccctgaactgactgttcttagtgaatatggcaatatagtacagttagtgattcctccttctctcagcaagttggggctagggaaaggttggtagtgatggaaaacttggtccagtcgcccaaggagtttacaaggagctccagaactgtagagcttttctcctggttttgccactgtgtaattttgtggtgggcctttcagccatttccctttctcttaaatttaaagcccagtattctaatggccaagatggtaggaattaaaaaaaaaaaaacaaaaacccaaaccaaatgaactggtgaaaaggaaatatgtattctcctttctcattcactagccatcaatggcactaaagaaatgtatctgcttctgtgaaaatggtgctggcctaatcctgggaagagggaccatttccttggaaaatgtagtattttctgatagtctgtttaaaggtgaaccaccaagttgatagaagaggaaggagagtttgagacataacatttcaaaaatatttccttaaacatggtcaactatgtatgatctgaaaattgctaaactaacttttagatgacagcatgaagcataggtcagttaaactgaacaattaatgagcaaccagtatagctatttcatatgttaaaaaaacttgaaagtttttcaaatgagcaaatatactctatattgtatatacatgcaagaaatataaaatcgtatattgtatctatatgtatatagtatatataatggatataatttcttataatacatctgatcattttttgctattttatacctcttgatttgggttttgctcttttaaacaattgatatggactaaagcaacataaagaaacgttataatgtcattatacaccacccgatgtgtagttaccatgaacattatcttcaagaaagtgcatggacaggaggacagagagggattgtcattatgtaggttttacatctggatatgatatgcagcttctcccacactggaaaatgagctgcgtgcataaccaattggaggcgtgtaaagagttaggagcaagatccctgcttttgtgcatttcactccatttgtagccacttgttgcactccatctggaaagaaagaagccgctgcagggcatgcgccagacctgcgctgggccgtcgcttccattgtacggaagatgaacaggcggcgttattttggatcacatagcagcttgttcaaaagcatcttgcattccccagctgttccacaacttcttcgcatatgggagagaacttgccagctgctggggcaactgtacttacatttgctgcctttgttcagtaaacaaggaaggtaaaaagacaggcgcctttgttaaactgtagtcattgtaaagagacttacttgtttctgttatgtcaatgttattccagatatagtctgtcaggggaggcggtttaaaaggaaatgtcagaattaacatttttttttaatccaaataaatgttattttagggtaaccggcatgtatagtttttccatatgtaaaaccttaggctgcttttatatttcattgcctaacaaaggaatggatctaatacctaaaaataagtgtttatttaaaaattgacatatgaatcagatttaattctatacatttttctattgcatgaaatgcataaaagttacaatgtgtctccagacagtgcttttgtgttttcagaacattctgttgtttttgcatttgttggagctggagggtaccttgcccacatcctttgtttaatcaatgagaaaacttcagtttataagaagttgttgcttatccaaggtggtatggctagtggatttaattcagcaaatcttctgttgagtgtttatagtgtgacaggcctgggaaacctataaagatgaataagggttgggcccagccctggatggactcgcagttcagaaacaacagacgtaaacaaatacttcaagtatgagggctagagcagaggcagcacctttttgttttcagaacagtgttgtaatcatgtcagctcaaataaagccagagtagcaagttgatgtgccagtaagaatcgaggagcagaatcttgggtacaggaagatagaagaggcgttatatggtttatcaaattttacgtacatgtccttaaaaaagatttcgtattgtgcctctacctaggcctgcttgtctcccagttcctggccagcaccccaaaacatcttgccttcctaattattgtgaattgtgaataaatggccctctagtagctccagcatcaatcacaatcctttttgggatattcagtgagtttcaatcgcctttgttctataaaaggttgtaaaataagccataattgcttgggcatgtataaaaccctctgactccaaatctcctcgaaatcttaggggttccttgtactggaaactgctgttgcttcagatcccctgatgattcacggttgctgagttgcacccacaattctaagcccttaatccacttctggcctccatttacacattcatgtatctcttacttcatcccttttgtgcagtaataacagatgtttacagtctttcagttttcacttggtttactgacgttttcacttgagatgctcaagaaccccgttgggttcttagggctggtgacccagggtttccatcttggagatgaggaaactgaggctccacggttgagaaccttgcctgcgctaagattagaactaagatctcctgattgaaaattcaacactcccctctgactggaagggtcaacttatacgaagctggaggttgagtctcatcttcttctacagcttcattgtacatgccctgacttcagtgatcctcactgggtttttcacccaggactttcactgggataaatctcccttccttagtacatttctttgcacattacagttctcttagcatcttattcttcttttacttttttcttttttagagacagggtcttgctctgttgcccaggctggagtacagcggtgtgatcatagcttactacagccttgaactcctgggctcaaggaatcctccctcctcagcctcccaagtagctgggactacaggtgtgcaccaccacgcccagctaatttaaaaaaaattatagagaaatgttgcccaggctggtctcgagctccctgggctcaagtgatccttctgcctcagcctctctaaatgctgggattataggtgagagaaacagtgcccagccatcatgttacgtttctaagtcttgtctctcaagagcaattgccacctttttttttttttttttttttttttttgagatggagtctcactctgccacccaggctggagtgcaacggtgcaatctcggctcactgcaacctctgcctcctgggttcaagcggttctcccgcctcagcctcccaagtagctggaactacaggtgcgtgccaccacacccagctactttttgtgtttttagtagagatggggtttcactatgttggccaggctggtcttgaactcctgacctcatgatctgcccacctcggcctcccaaagtgctgggattacaggtgtgagccaccgcacccggccaattgccaacttttaaacacatacatccctctgtcttgctacacacaccacatacatacacacacacacacacacacacacacacacacacacacacacacacctccataaacacagaggcccagcatggctactgtacccactatcctttttcacccagcccagctcctttcagaagatgacttcacctttataccatcaaactttttcctcctgcttaatgtcttgggatgctacaaaattcttgatggatgtcagatataggtgggcggtcaaagttagcctgtttcctctttttccacaggggtactgttggaaaatgatccagttccccttgatagtggtgactatgttgtccccccaacatcatggtccttggggttagaaataagagccatttcccttaggaggaagaaggtgatgagcttagttggggagggggacctcctttgctcaggacttctctagtattccttatgcagccatagtaccactccccacaaacatcctaacaccgcccctcacccccagactttggcagctttctcctccttctaggaccctttgtttgtttccctctttgacattctgcccctcctgttcctggtctgttgctgtcgcccagccacctcccggcaggcctgggtttcaagtgtcttagggacacatttgccttggacgtccttatctccatctgtcattggtgtttaattgctttccctccactccccagcctgctctttgacttggggtaagtttcccccttgcgatcctttctgattacttctttcagctttcctctggccaattcagctgcccgttcagctcctccatgctgctagctcaccttttgtgtctgcagtttcccagggtttccaatacatggctttgtttctatccaaggctgctctactctttttcccttccttcctttccttcctccccctttttgacagtgcttcttgatgcttgcattcctttccctttcatttttttcttcttaacaatttgcaaacccttctccctttgttctgagtcaatctcatttggctgtcacctttgtttagtataataatgatattgaataccctatcaaagtttttatgtacaggaaatttctgcttttaaaaagggttctttggaactgcaacttggaaataccagttttgaaactggttttgaaaaggtctgaactttggggaaaattgtttgaaatttattttggctttccttgcccgtggcagtaccttgaaagtaactgaaacataagcttgttttggataacctttcccttgcaaatggaaattgtacatacacacagcagaattcacgttggctttttttttctttttcaaatcatatttctggaaaatcttggaagggagtttgtgctttgtggccagtccagggtgggtgtaagtcatgaatgattggtcatattaagactgtgctagacccttttgatcaaaagcctcgctagggatgctttctacttatgatcctctgtccatgagaatataccagagagtaggtattaggaaatccttgacagattgacttgattaaggaatctttacttttcccccaaagctgtgaacataaaggtttactcagggttggtaatagagtaggatggtagttggaggttctcgccctgccttgaggtagagctgcaggctaccgttggtcctgagcagccagggggtctagcactgtttgcagtgcacccagagccctcccacctggcacttgttccctgcaaaaatataaaaatattgctctttttgtgactttttcttttttttttttttttgtgttcacgacttaattcacatttctcctttctctaagttctgcaataagtgaaaagatgtttacccatgccgaaatagtctggtactttaatttcccaattaaaagggagcacaattttcttgccccagtagcagtgttacttatcccaggtggtttggctattgcatgtaattctgcaaagcttctgttgcgtgtttacagtttgaccggcctgaggaatctgtaaagatgaataatggttggactcatggcacccagggagtttgagtccagcccggacaacatttctctataattttttttttttaattagctggtgtggaggtccccacttatagtcccagctacttgggaggctgaggaggcagaattccttgagcccaggagttcgaggccacagtgagctatgatcacaccactatactccagctaatgttagtacagactggagcacacagaccaaggaatctttgtttcagcaatcttctttaattggtgttactggacatagaatcttgatgtaaccatcaacttcagttaacctagtcaagttatccacctatattattatgttattattagcatctgaagaaaggtccttgaaattagaattgtatagaaacaagaagtaaaagtaatcaaactgctgattttgtctttcctttgttcagctaacatttgataaccacgtggtgtgtgtgtgtatgcttgtgcacgtggatgtgtgtacccatttaatgcttgttattgagaatatagagtgaatcctgccttcacggagcttacagtggcggatacatttgtaaataaacaagcataggtgttgtgatggaagcacattctagatgtcatggagacatgaggggatgccatgatggcggtgctgccactggtagcatcatctgttgactgtccactgtttgccaggccctgtgctgagggctttgagggcttgacatgctgttcttattttaattagcacttttttttttgagttagagtctttctttatctcccaggccagagtgcagcagcgtgatcttggctcaccgcaacctccacctcccgagttcaagccattctcctgcctcagcctcccgagtagctgggattacaggcacctgccaccacagctggctaatttttgtatttttagtagaggcggggtttcatcatgttggccagtctggtctcgaactcctgacctcaagtgatccgcccgcctcggcctcccaaagtgctgggattgcaggcatgagccaccgtgcccggccacagttagcacagctttttaagtggaagccttgataggttaagtacctcaaatgaggtatgacaataagtagtagagtctgggtttggattcagatccaaggtcctaaagcttttgccataaatgacaggatgtatcagtagcttcctaggtttacttttcctcctctaaccatccctatctctgcacataaagaaggaataggaagcctggagagccatttgatataaaagatatatgtgggggccaggtgcagtggtgcatgcctgtaatcccagcatgttgggaggctgaggcaggaggatcacttgagctcaggagtttgagaccagcctgggcaacttagtaagaccccatctctacaaaaaatttaaaaattagtcatgcatggtggcacacacctgtagtcctagatacttgggtggctgaagtgggaggatcacataagcccatgatgtcgaggctgtagtgagctatgattgcaccactgcactccagcctgggccacagagcaagaccttgtttctaaaataatttttttattttttaaaaaaggatgtaggtgaggagttagccctagccccactctctcctataaaggatgtaccatggggatctagtctagacggttcctcagtgtctgtaattatgcattttctctgagtattcttcatattcaatgttttgccaactctgtttctaaagaggctttcttttccctctgctgagcgttgcggaaactggccatcagcctgactgagccccagagccctctgcctcctttctcagtgctgtgcatcgcaaccagcagcctctggtttctgccttgatcccctcaatggtgcttggtgaggcaagcagctctatttcaggcctgcagaaggggagagtcacttcctctttaggatctgttctttaaatgaacccctcgtggaggggaagcctgcctgctaggacacatctgtgtgcatgaatacaggctctcggaaatctcatcctcacttcagcagcctgctggttacactgctcttatctcccctttcctgccttttaaggattgcaaggctctgtggttctgataagacccagttatgacctgaagaatactggctggacagattggaggaaacctatcactcttgaagggaaggagaggctcaaaggggacacgagatcctgcccttttccaaaaggaacccttgaggacacaagagcggtcctctgcaggatgaatcaccctgaggctctaggagaaactttgataagcatgctctgccttagggctgtgcctgtcctgtttcctgctcttgatagcaggcaagtagaaagacggacctctgaccctgaactgtgtgccataatgaggaaattccaccctgaaaatttagaaatttagaggtgagcatgcatgctttttttttttttttttttttttttgagaccgggtctcactctgtagcccaggctggagtgcagtgacatgatcttggctcaccgcaacctctgcctcctgcagagaaccttcaagtgattctcatgcctcagcctcctgagtagctgggattacaggcatgtgccaccacacccagctaatttttgtatttttggtggagacggggtttcaccatgttgaccaggctggtctcgaactcctgacttcaagcgatccacccacctcagcctcccaaagtgccgggattacaggcgtgagccaccttgcccagctgctcatcagtttttaagtccaaaaataaggctaagaacttcctggaaaaattgatagaacatgaactcaaatgaagagacagcttacttcaaccagtgttagatgatgtccatccacttcctaaaaatgaattcggtattagactttgaaataggatttatatattttttttcattctgaccccagaattatccaattattttttaaaaaatagtcaccatcatatatcctgacactgagtttccaggaaaaagaaaaatcatattatatgcttgagaagaaaattacatggttggaagatgttttggttgattatttgtataaacccaacatctgtgtgtatgtgtgtgtgtgtgtgtgtgtgtgtgttttaaatcctcataaaaaaagaatgaaaagctttcattgcatggctcttttttttttctatacacttgcttctcacagtgttggaagaagtcacaagttagttatagcaggcagtgaaagcagtttatgtttttccatgaacaaattggttccatgtcttgtatttaggcttcttgaaaaaaaaaaaaagagagaaaacaaaaaactcagaagaaactgcaagcttattgtggaaaactcactttcattttgagcacagatactggttctaggttcaaatagtagcatcctttatctgtttgcagaacttggtagttctacaatttataaacccgttcatacttcccttgccccatacccaagtctctctaaacacaatgtcttctccattattttccatttcagctagaagttggttttgaaaagttaagtgctgtgtttgcataatcttcacccaaccctttttctcctccaaactttttatcttgtttggttgccaaattcacacgcattgcttgtagttacccaacaatggcttttgtttcattttttcatatgttctcaatggttttcccacaatttttgattctagggacaactagggagagttcatgagttgcagaaacaaggaaagttgcctccattaattgtaggcttactgaattagttaccatcaccaagtataggtaaataggagaatgactatttaaaagatgaaaagaatagatttcatagtaagagagaagtttcctctctcaagatattccttcttcttcctcattttcctcctcctattatataataataattattattattccctgaagcattgttcatagtctggtgggacaaacagttgttgctaagagtaatgccttcttaacagtgaataccgaaagtttcagttcaagtactagaaagtgacttgtcatgaataatcacagtttaaatttaagtgatgcttagttatacatttattttttatgtttttgagacaggatctcactccgtaacccaggctagagtgcaatagcacgatcccagctcactgcaacctctgcctcctgggctcaagtaatcctttcatcttagcctcccagtaactgagatacatttttaattttttgttttttaactttttggccagtggctggctaattttttgaagagacaaggtctcactatattgctcaggctggtctcaaattcctgggctcagccaatccttctgcctcagcctttcaaagtgttgagattataggcatgagccaccacgcctacatttataaatatttatggaggacttttatgtacagggcagtctgccgggattttcacttatctaatgtcatttaatcacaagtaccacgtgaagtaggtagtattactcccatttcacagatgagcaacatcaaggcttgagaggaaaaatgattggccagagtcatgtatctaggagtgacaggattgagatttaaatcaagatcttctgattccagggtcacattcacttcccagccaataagtaaacggcagtgatgtcaccatggaggtcctatgtgtgtgtaacagtggattctggaactcagcttgaaagctcatgcagtagaattttaagaacaaaactgtccaattagggttggagtttttagtgcccctacattggatttagaggctagaattcaagcatctgcctgctttttgctaaaaatgtttattgtacaaataaatctgtacccaactcctgaaaacaccaggtttttatttttaaatgtgcacaacttccaaaggccggtttggtgctgaattggaaaggattctagttcgcaaaacctggaaaatgaccattactcttgttttctttctttcgttctttttctttaaacagttgtattgaggtataatattgccatgttttcttaacctagctttttggaagaaagtttgggtcaatgttaagccaaaatttcttaacttctagggctttttgatatggtcttgcataagtttctcaaactctcacttttttattactcccagataaatcttttcagtagaaatttgggaaatttttgcattttaaaaactcgtacttgctgatgcagttttttttctttcttttctttctttctttttttttttttttttaagacagagtctcactctgtcacccaggctggagtgcagtcactgcaacctccacctcctgggttcaaacgattctctggcctcagcctccccagtagctggaattacagatgcgcaccaccacgtctggctaatttttgtatttttagcagagacagggttctgctatgttggccaagctggtctcgaactcctgaccaaaggtcatccgcctgcctcggcctcccaaagtgctgagattataagcgtgagccaccagcacccggcctgatttatttttaaggttagctttcctgaaaatgccttcttctctaactcctggttagcctgcaagccagacaaaatagcactagttacgatgataccagtaagatgtcaaaataaaactttgccacaagtcaacatggatatggactgcttattagtataaagcagggatccccagcagtattgaaatatgtggctttgtaaatttgtctgtttccttgtgcagttctgtcagtttttgcttcatgtatttggatgcatagctattattaaggtgaataaacccttaggatccttatgtccccttgaagaactggtgactttatcattatgaaatgaccttctttagaccagctgatattctttgctgtaaattctacttgttatttataaagccacttcagcttttttttttttggattggtgttagcatagtataactttttccatccttttaacccttttgtggctttatttaaagtgctttttttttgtaggcagtatacagttgtatcttttttccccaatatgaaaattagtcttttaattggtatatttagattacttacgtttaatgtaactatcaatatagtaattttaaatctgtcatcttactgtatgtgttctatgtatcttgtctattctttattcccttttccctggtttctctgccttcttttggattgaggtgtttttttgtttgtttgtttgtttgtttttgtaatgattccatttgtctcctttgttggctaattagctatatgtctttgttttgttattttgtggttgctttaagatttacagtataatctgggcataggggctcacacttgtaatcttagcactttgggaggctgaggcgggtggattgcttgaggccaggagtttgagaccaacctggccaacatggcaaaaaccccatctcttctaaaaatacaaaaattagtgggttgtggtggcacatgcctgtagtcccagctactcaggaggccgaggcatgagaatcacctgaatccaggaggcagaggttgcagtgagacgagatcacaccactacactccagcctgggcacagagcaagactgtgtctcaaaaaacaaaccaacaaactatttagagtatacatctttaagttatcatagtctacctttaagtgatattatatcacttcacatatcatataagaacattacaataggatacttccatcttggcctttgtattgttgtacagtttacttttacatatgtgattaactccatataagttattattgtttgagaagtcacttctcttttaaaagcttaaataataaggagaaagctcttatgtatttacccaggtagtaactatttccactgttctttattcctttgtgtatatccatatttctacctgattattttttctacttaaaataatttactttagcattttttgttatgtaggacttctggtgatgaattcattccatttttatatgtctgataaatccttattttgcctttatttttataagtaccatgtgctaactagttgtataattggagctacagttttatttttggaagctatttttgctgggtatagaattatagattgacaattttttcttcttagtttatgaaagattttgcttcactattttacacttgccttgcttttgacataaaatctgctatcattcttaccttcttttgtttatgtgatatgtcctttttttctaattgcatttagtatttttattttttaaaaagtgaagtctcactgtgtcatccagggcagagtgcagtggtgcagtcatagcccactgtagcctcaaactcttgggctcagtcttcctgcctcagcctcccgagcaactgggactacaggcacatgccaccacgcccagctgcttttaagatgttttgtttgttcctggttttaagcaatttgcaatgtgctttgatatacgttagtttatatttcttgtgcttggaattaaatgagctccttggatctttgggtttatatttttattaggtttggcataatttttcagccattatttctttaaatatcattttctatccctctgtgccccccatgtggaatccaattacatgtgtttaggctgcttaaagttgtctccacagctcactcatgctttgttcattttttttaaactttcttttctgtttttcattttggatatttctattgctatgtcttcaagttcaatagtcttttcttctgaaatgtctacctgctattaatcctatccagtctactgttcatctcgcacattgtagatattatttctagaaatttgatttgtgtttttatatattcatatctctgcctaaaatcttgaatatttgtccttgtctgctaattctaatacctttcttaactcttggtcagtttcagttgattgacattgctcctcgttgtgggttgtattttcctgcctttttgcatgcctggtaatttttgacaggatgccagacattgcaatgttatcttctggggggatggaaatattgttgagctttgttttgggatgtagataaattacttggagacagttgattcttttgtcttactttcaagatttattaggtaggagcagtgctaattagacagggataattatttcttaacccgtttataccgagtgttccataattggaacactaagcttgtgggagttatttatatcctattgcttaaggtcatcaccaaggtctgatttctcacacacaaaaaatttgcaacctccagcataaatgggttaagcaacatctttctgagtacccagtgcttgtgaattatgagtttttccattctttttgtttgtttgttttgagacagagtcacactctgtcatccaggctggagtgcagtggcacgatctcagctcaccgcaacctccacctcctgggtttaagcaattctcctgccagcctcccaagtagctgggatgacaggcactttctaccatgcctggctaatttttgtatttttagtagagacagggtttcaccatgttggccaggctggtcttaaactctcgacctcaggtaaactgcccacctcggcctcccaaagtgctgggattacaagcatgagccaccatggctggctgagtttttccattctatcaggtggaaacagacactgttttgcatcagtaccagacactgttatctccaatcttttctagtgttcccccaccccctcaggcacatgtagtttgctcagaaacatgcactgactactcaaagataaatctctggacttctctgtgtagttctctcctatttggtacttggtcctgcaaattctaatggcctgggtctaccccagattctcggctctgggagtctgctgggtgataacctagggcggtcatattgcctagaatctgaaaattcagattctgttcagtaggtttttgctagggtctgagactctacatttctaagaaacttttagatgctgtcaatgctctggaaagactacttcgagtagccagggtccctagatattcaacagatatgtaatgtaaaccacatatgtaattttacatttcctagtaatcgcattaagaaaattaaaaagaaacaggcgaattttttttttttttgagacggagtcttgctctgttgcccaggctggagtgcagtggcgcgatctcggctcactgcaacctccacctcctgggttcaagcgattctcctgcctcagcctcccgagcagctggatctacagcgatgtgccaccacgcctggctaatttttgtatttttagtagaaacgggatttcaccatgttagccaggatggtctccatctcctgacctcatgatccacccgcctcggcctcccaaagtgctgggattacaggtgtgagccactgcgcctggccacgaaacaggtgaaattaatttaattatatattttctttaactcagtctacccaaaatgttatttcaacatgtaatcaatgtaaaaatattaatgagacattttttcttaaattttatagtaagtcttaaaatttgatatgtatgttatagctatcagatactacatttttatctgaaatacttggtctatatttagcttttataaaatttatagttgaaaaagtatatttgttaaccaaaccccaaatatacaagttctccagcaactgaactcagcatcaaaaaatcattctccacgatattcgcattcaacttgacaaaactggttcatcttttttagaataattaatttgactttttgaaacaaaaaatatcagtttcaaagctacatctgttcaacttaggcaaattcactaactcttatgccagctcagaattgttgacattaaattcaaaggaatattgcaaaaatggaaaaactaactctaaatttatcaatatcaacaaagtattccccaacattttcttatggattttgaaggcaatttatataatgcttttgatttcagtgaagtcatccacatattgattcaagttacaaaaatgtatgaaaccattattttttacttctcttatgaaaaatgtcaattttgacataaattctcctgcctctctagctaggtcataagtaagtttttcctttccttgaaactttaaatttagctctttcatatatagtgtgtgatatctgtgaaaaaaaacataaatcacactgcctatttttttttttttttttttttttttttttttttgagagagagtcttgctctgtcgcccaggcttgagtgcagtggcgtgatctcggctcactgcaagctccgcctcccgggttcacgccattctcctgcctcagcctcccgagtagctgggaccacaggggccccccaccacgcccggctaatttttgttttttgcatttttagtagacagagtttcaccatgttagccaggatggtctcgatctctgaccttgtgatccacccgccttggcctcccaaagtgctgggattacaggcgtgagccacggctcccagcccacagtgcctatttttgtcttcatttcttgcttcagcaagcattctttttttgtaaagaaaatcctgcattgtagttaactgtacagtgaatgtttgtaaaaattcttctatgattcaaccagagatcattggcaaagaacacatgatcaatcatttctggttttctatttctttcagcagttccataaactgcttcaagaatccaagatgttttataactggccagagttatgagctgagatgtaaaaaatcattaaaacaatttttttggccattcttattttgagtgactaatttcattgatctgtttttgactgtcgaggggagatggcatcaaattcattatgtttttgctgaaattgtctgttaatattttctgctttattatctttgactttttatgtaacacacagctttctccttttgctctgccacagcaagttataattgccattgattatgttgctttttgcttaccttcctctcctgtctctttttttcttgactgttctgattgtattattaatttctgtgtctccactggattttgtatcagtcctaaggctttggaaagtgtctctgtgttaggactgctacaaaattttcaaagtgataaattagaaaaattggccatatttattttataaactagagaaacaatgtaattatatcttaattaaaacaagtattttgatataattaccaattatgatttacatagttatcaccataacttgtgctgtctgtgtaaaatattcatatgaacacattacagtgttacatcagtgtttagaaaaaaacatttaaatggaaacactttattgacaccaagtagatcagtgatgctttcctttgtagactcatctgctacaatgcaccaaataatattttaagcaatatagtatttaaagtaaaatgtagttctaccaaagcaatgcattaatgtttaatggaacatgttttacattgcttcagtttttacatttaaataaaatcatgtgaaattaattaaaagttgacattcagttcctcagttgcactcaccaacttaagtagccatgtgtgcccattggttcttgtattggacagcacaggccaggggctacttgcatttgaacctaggaaccttgtatcaataactagatggttgctcacttttcttgcccagcaactacatcttccttgccttgtcccatggcactcaggaattttaggagtttggcaaataaagtcttgtacaattaagtggtctctgaaggtctcttgatgaccatgactcttggacaacttcccactgtgctaggccattaggacaagtctggggacaacttctgactccagggacagtctgtgggatgtaatagggattagcttgggacaaggccaaggcagagtttataggtcaactgcagctactcttcctcttcccatgggttactaaccaatgactcaagagcaatctggcttgatcttagttggatgggaatgttgtcggcagaggtagcattctcattgttctggaaggagcaggtttcattttcacaccaatcacgagagtgttaggggaaagctgtcccttagctaagttggctaggaaggttttcaaaaatccatctcaattaatcatcataggctatgaaatgacacctgaaaaatatgaagaaaatggaatgggtggtttgtgtgttgaatacaaaataatgatataaagcattctagaattcagaaaccaacttatgaaccaagatgttattttcagagtggatatactcaccttgcctggaccctgattaaactcctcctctttttttgtttaaagttcaatttatattctgaccgttttctttgtttagagttatattgctttggttcatatttttgtactgccttcacaaaatattaggggtgtttacttagatcttaggtttctcaagtctttttcttccttccttccttctcttttttcttttctttttcttctttttttttttttttttttaatttcagacaaggtctttctttgttacccaggcaggagtgcagtggtgcagtctcaacctcctaggctcaagtgaccctcccacctcagcctcctgagtagctgggaccacagctgtgtgccaccatgcccagctaatttttaattattttgtagagatgggctctcaccatgttcccaaggctggtcttgaactcctgagctcaagcgatcctcccacctcagcatcccaaagagctgggattacaggcatgagtcaccacgcccggccaagcctttttcttttgtctctgatcctcctaaactttcttttatctccaaaactcttgctctgtgctttgtacactgctgcatgttcagatagagcttaatctgtacttactcatcactgatgattcataaaatacaaagtgtgctttagtaacactgaatagtatagtctagaatcctaaaaaagttgagaaaaagactttgttctccttattttctatttttttctattgctccaccttgtattagaaattaggaaagactcgtggtgaatgtgtccaatcagttcacctcacctcatgttgtttctaaataaaataataaaatctgaacccatagtcttcgccttttttgaggtttaagtattggttcatctatgtcgttatgtaatttcaaagtgccttccggaaaatccctcgggatggagatgactcaggatagctttgcactggtttgttatggggccatctaaatgaaggaatggccctctgaaatggcagcaacaaccctaagctgcctgggttccagtcccagttctgacaccgtctaggtgagtagcctcagccaagtaacttcccactctctaaacctcatttttctgtctatacaaggtaggaattagatgatgacattgcttcccaagccttcccacccaacactagtggcccttgagatatcattgattgggtgcttctccagtatatccatggaaattggagaaatgctgtgtgctgaattctattccatatttggcttccaaaagctcataagcacattagagactgcaagaagccttgaagtaaagaaatctgcttaacatttttaaacctagcattttctaaactctttgaactggaaactctccctcttttggaggaaaagcttcaagtatattggagtatcctgtagtacatagtttgggaaatgctggaatagatcagtggtcggcaaatagcagcctgcaggccaaatccctcttgccacctgttgtgtaaataaagttttattggaacacagctacactcattcatttatgaattgtctatttgccccagaatagccaagttgcagagttgtgacagagacctgtatggcccatactgccaaaaatatatttaccatctggttatttacagaaaaaaaaaatttgctgactcctacacacaggattattttcaaagtgattcatgaacatggctgaaaaaatcagatcgtggaggaatgctgtaaatgaaaagcaatagctttgttccagaagcaacacatttttaatggttcctgttaaaattattttagtggttattactaatagttgtataactcctcactcagccgtttctgatgtatgtgctttgggttgcctctgtttgatagaccacgttcacatgcacacacacacacacacacacacacacagaggcatgtacaacttcttagttttatcagtacatgaattcctctcttgattaccactgcagtttttttttttcttttttcttttttgagatggactgtcactctgtcgcttaggctggagtgcagtggtgccaccttggctcactgcaactgcctcccagattcaagcaattctcctacctcagcttcctgagtagctgggattataggtgcccgccaccacacccagctaattcttttgtatttttagtagagacggggtttcaccatgttggccaggctggtctcgaactcctgatctcaagtgatccacctgcctcagcctcccaaagtgctgggattacaggcctgagccaccgtgcccagccctaccattgcagttttaatgttcataaacctctatatcttgttgcatttatttcctacctattaggtgccaaattttataagatgaggggactagtaccactaaccttccgcattcctctcttttcctgttgtccatctttcagcttttctcagctatgtctttatttttacagtgttgagtctgataacatttgccttctctatctggaaatattttccttgcattgcccattgattgagtctaaaggttgcaagctgtcttagtccctttagtgttgctataaaggaatacctgaggttgggtaatttataaagaagagttttatttggctcacgattctgctgctggaagattgggcatctggggaaagcctcaggctgcttccacatatactgaaaggcagagaggagctggcatgtgcagagatcagatagcgagagagaaggcaagagagagaggaagaaggtcccaggctctttctaacaaccagctaaggtcgcaggctctttctaacaaccagctctcctgggaactaatagagcaaaaattcactcactgcctccccgccccccagaaagagcattaatctattcatgaggaatccacgcccatgacctaaacacctgccattaggcaccgcctccaacatagaggatcagatttcaacaatgttccaaagggtcgaatatccaaaccgcagcacaagccaatgagcagtgttaatgtaaatactgtctgtagaagagccaagcagtgcttgctgtgattatacttccctctctataattctaatatcacaactgcagcatcactcaaaatagatagttcttaatatctttttctttaaaattttttaaatttttatatttttattaaaatatataaaaaatattgaacacgtcatgaatttgcatgtcatccttgcgcaggggccatgctgatcttccaattttagtatatcattccaattttagtacatgtactgtaatccacctgccttgacctcccaaagtgctggaattacaggcatgtgccaccgtgcccagctgctctaatatcttttccaattgagttcattctgctaatttttaccagttgctctaaatcatggcactttttttttttttccttgagacagagtctcactttgtgtcacccaggctggagtgtaatggcgtgatctcggctcactgcaacctctacctcccgagttcaagtgatttttgtgcctcagcctcctgagtagttgggattacagggtgcaccaccacacttggctaatttttgcatttttagtataaacggagtttcaccatgttggccaggctggtctggaacccctgacctcaggtgatctgcccaccttggcctcccaaagtgctgggattacaggcgtgagtagtgtcacctgtccagtcatggcgcatttgaaccatgtctctcctgctttttgttggtggcatttgttttcccttgaggtttatttatttattgagacgtagtcttgctctgtcacccaggctggagtgcagtggcacgatctcaccacagtacaatttccacctcccaggttcaagtggttctcctgcctcagtctccacagtagctgggaccaccggcgtgcgtcaccatgcccagctaatttttgtatttttagtagagacagggtttcaccatgttgtccaggcttgtctcgaactcctgacttcaggtgatctgccctcctcagcctcccaaagtgctgggattacaggcatgagtcgccattctggcccccttgaatttttttattggtttgtttttttggtgtgtgtgccttgttgagggaagaattgtgcctccttgactatttccctcaaatcctctagtttttaacgcatttgtctattgcctgaaataaatgcattctttttgaagacattctttgcggattccactcactgatgtcctcatggcttcctagacttgcagttgttaattttccttaaattcaaggctttgttctaccatgtgttggatgccacatctctttgcctgtgttttacattgattttttttgaaatatatttaatagtcttaagtgatttattctgattgaggctcactttctgagtcttacgtgtttgaaaatgtctttactatgattggtatgggtttctaggcttgaaataaatttttctttaaccttcaaaaatcttgctatattgttgcagatttgaaaaggcacatgctggtctgtgtttgttattaactgactcttttttcctttttgaaagctactagagtttctttctctttattcctcaatattctgcaataattattaatacaattatatagtaatttgacagtgagatgtctaaatgtgagtctttgctcatttattgagtttggtagtcagtgggtgtatcagtcaggttctcttcacacaaaaatcacacagatttgaacagggaaactttaaacaatcattgatttgtagcaggggattaactactaaaaggaaaagagagctgtaaagaatacaggaatggttggctgggcgtggtggctcacgcctataatcccgacactttgggaggaggccaaggtgggcagatcaattgagcccaggtgtttgagactagcctgggcaatatagtgaaaccctgtctctacgaaaaattaaaaaggtagccgggcatggtggcgcgcacctgtagtcccacgtactcaggaagctgaggtgggaggattgcttgagctcaggagtttgaggctgcagtgtgccatgatcacactccagcctaggcaacagagtgagaccctgcctcaaaaaaaaaaaaaaattaagaaagaatgtgagtgacacatacattgagcagcccctccctctagggctgaggcaagatcgagttcagaagtggctgcctctcgcgcacccccaaatctgaaattcagatctcagggcatggttccgtggcccattgaggcagcacagtctggggaggagctgcatgctagcccatgtgggataccgcctgctctggtgtttaaaaaactgctagaaaccacccacccactgggtgcctgcaagccttgctgggagccggctgggtgctgggggtactcactggatacctgctcacaggtttgctctactgaaccttgtgaggatgctgcctgctggggtgtctgccagacttaccgggaaccacctgcagggtgctgccgaaactcactggggtgacgcccctgggtattccacaggctgctagctgctgcaggcacaagctggtgagagcataccccataggagaaaagtcgcttcctcctgcacgacttctccagcactctcaaccagcaaagcttaacctgatgtcagctggcaaaggagagacattgaccacgtccagctcccgtaattcaaaggaaggcaaagaagggtatctgcagctgagaggtaacacatggataaacagcaaacatcttgaagtctaagcttgtcaccttagctctggggagttttcttgtacaggttaagcatccctaattcaaacatttgaaatgctctgaaatccgaaactttttgagtgccaacatgacacgacactcaaaggttatgctcattggagcacttagggtgtcagagttttggattagagatgctcagctggtaagtacaatgtaagtattccagaatccaaaaacgtctgaaatctgaaacacttctggtctcaagcattttggataaggggtactcaagctgtattatttctttgataatttcttccttttccccctgccccatatttttctgtggtttttagaactctgattggtcaaatgttaggcttcttcggttccttctctggctttttaatcttttcttcaattttttgtgtttttattcttttgctttgtgttctgggagacttccctaacattatctttgtactgttctattgaacttttcattgtgtaatcatcttttaaaattctttcggcaggttttttgtttgatttttttgttgttgttgagtttgtttttgttctattggctgttttgttttctttgctttttcttgtgtttttctcagtagagcaaacctgtgaacagatctccagtgagctccagtgagctccacccacacccagcaggcttcccagcaaggcatgcacactgtatactttttatagcattctgcattgtttttcttttatatttgcatgttttatggttatattcatcttccagaaatgtcaaaatcttttgttttctttttcttttcttaaattttttgagacggagttgcccaggctggagtgtagtggcgcaatctcggctcactgcaacctctgcctcccaggttcaagcaattttcctgccttagccacccaagtagctgggattacaggcgcccgccaccacgcctggctaatttttgtatttttagtaaagacagggtttcaccatgttggccaggctggtcttgaactcctgacctcaggtgatccgcccacctcggcctcccaaagtgctgggattacaggcgtgagctaacgcacgtggccaaaatcttttgttttctgatgactgattattttctcttcgctgatgtaaatttgtacatttttttttttttttttttttttgagatggagtctcactctgtctcccaggctggagtgcagtggcacaatatcggctcactgcaagctccgcctcccaggttcacgccattctcctgcctcagcctcccgagtagctgggactacaggcgccctccaccatgcctggctaattttttctattttttagtggagacggggtttcaccgtgttagccaggatggtctccatctcctgacctcgtgatccacctgcctcggcctcccaaagtgctgggattacaggcgtgagccaccgcgcatggcctgtacattttttttaaagttatttttaccatcattttagcaggccagactacatgagtttaaatcacagccctgatatttactagccatgtgactgttctaagccttcattttctcatttatgaaatggggatgataatagtgacctaggttataaatcataagagtataaatgaaataatacacgaaaagtccttagcacagtgcctggcatatactcactgttttaaagatagcttcagctattattatttgtaaacataccacattattttaaactgattataatccatttaatcattattttaaaagcacttctagtctgtaaaatataatttctttggtcttattaattaccactgctactgctgtcactattaccactgctaccacagatatcttcaagcaagcagatgtaggaattaatagaaatttggtttaagggcaaattaatggcatacaatttggagacatttacttaggatacaaaatcaatatgcaaaaatcacaagcattcgaataaaccaacaatagacaagcagagagccaaatcatgaatgaactcccaatcacaattgctacaaagacaataaaatacctaggaatacagctaacaaggaatgtgaaggacctcttcaaggagaactacaaaccactgctcaaggaaataagagagtacacaaacaaatggaaaaactttccatcctcatggataagaagaatcaatatcgtgaaaatggccatactgcccaaagtaatttgtagattcaatgctattcccatcaaactaccactgacattcttcacagaattagatagaaactactttaatttttacatggaaccaaaaaagagcccgtataggcaagataatcctaagcaaaaagaacaaagctggagtcatcacctacctgacttcaagctatattacaatgcaacagtaaccaaaacagcatggtactggtaccaaagcagacatataaaccaatggaacagaacagagacctcagaaataataccacacatctacaaccatctgatcttcgacaaaccaaacaacaaaaaagcagtggggaaggattccctatttgttaaacagtgctgggaaaactggctagccatatgcagaaaacagaagctagaccccttccttacaccttatacaaagattaattcatgatggattgaagacttaaatataaaacccaaaactataaaaaccccagaagaaaacctaggaaataccattcaggacatagacatgggcaaagaacttcatgacaaaaacaccaaaagcaattgcaacagaaaccaatctaattaaactaaagagcttctgcacagcaaaagaaactatcatcagagtgaacaggcaacccacagaatgggagaaactttttgcaatctacccatctgacagaggtctaatatccaaaatctgcaaggaacttaaacaaatttacaaggaaaaaaaaatacccatcaaaatgtgggcaaaggatatgaacagacacttctcaaaagaagacatgtatgcagccaacaaacatatgaaaaaaagcttgacattactgatctgacatgcaaattaaaaccacaatgagataccatctcacaccagtcagcatggtgattattaaaaagtcaagaaacaacagatgctggagaggatgtggagaaataggaatgcttttacactgttggtgggaatgtaaattacttcaaccactgtggaagacagtatggtgattcctcaaggatctagaaccagaaataccatttgacccagcaatcccattactgaatatataccccaaggaatataaatcattctactataaagacacatgcacacacatgtttattgcagcactatttacaatagcaaagacatggaaccaacccaaatgcccgtcaatctacaggcatgagctgctatgcccagccaagtcgatttattaaaagtagctcagtatatacccaaaggaatataaatcaattattctattataaagaaacatgcacacatatgttcattgcagcactatttacaatagcaaagtcatggaatcagcctaaatgcccatcagtgatagcctggacaaagaaaatgtggcacatatacaccatggaatactatgcaggcataaaaaggaatgagatcatgtcctttgcagggacatggatgaagccagaagccatcgtcctcagcaaacttatgcaggaacagaaaaccaaacaccacatgttctcactcataagtaggagttgaacaaggagaacacatggacatagggaggggaacatgacacactggggcctttcgggggttgcgggtcaaggggagggaaagcattaggacaaatagctaatgcatacagggcttaaaacctagatgatgggttgataggcacagcaaaccaccatggcacacgtttacctatctaataaacctgcacattctgcacttgtatcccgaacttaaaaaaaaaaaagatttgaagtgggaagaacagtctatattctccctccgcctcctttctgtatggaccctgatggttacatggggccctccagaatatctaggatcatttcctcatctcaagatccttcaatttatcacatctacagaatctttgccgtgtcaggtaatattcacagtttccaggaattagaatgtggatatcttttggggatccattattcagccaaccacacacacctttatccttttgtccgtgaataaagttaatatttacattaactttggccatacccaaaatctctttgggaaagttgcaaattggaggagaaaatgaccccttgcatttttcctttaatttccaatatccagggataaagaacttccaatgctacttcaaggtttatattactatatttttaaaaattgtgaggctctcattcctagtctcattacatttcaaaggcattaataccctgctttaaaaatcagcaccaaatgtacatggtttagacagatccattgcgtacatctcaatctgttacataagcgagaagtaattttttaaattgcttctttaaatgtagtaggagttaaaggagttccctgttcccttccccaaccccctgaaaatccccaggactcctgagaggtgtctgcatgtcttttggtttgggagattaggtagggcttgagtcactctgagttgtccgctaggatggagggggcagtgacgttgaacaggtacctgaatggccaaggaggggtcaagtgtagaattcagtttcaccaataaatgatgatcgtggttgtgaatgaagggaacaatttgcggggggaaatgatcaaatgatcaataaactgagaaattaaattttaagcagaatttggtgaagaaattattgagacctactctacatgagaacccatgttagatgctttggaggattaaaaaagaagaggccagcactttgggaggctgaagtgggagaatcacttgaggccaggagttccagaccagcctgggcaatgtagtgagagcctatctctacagaaaaaaagagagagagagagaaagcatgagaaagtcatttctgctagtgagagagacatggtataaacatttcaaaattatttgtaagacaacatattttgtggcacagtttggtgcatgctcagttcctcggtgaacacacatacacacacacacgacactgcaagtttagggagtggcgtgagctctacaacttggaaaacttatgagaaagcacagacgtggctgagggaggagtggttacgattttgagcatggtaggctgaggcgcccagcccactggagcaggaagtaccagtgaactaggatattaatgaacagttcaagaacccacctgaggctaggcacagtggctcatgcctgtaatcctagcactttgagaggccgaggcgggagaattatttgatgcccggaattcgagatcagcctggccaacatagggagagaccccatctctacaaaaaattaaaaaattagctggggtggtgtcatgtggctgtggtcctagctactcaggaggctggggttggaggatcacttgagcccaggagtttgaggctgaagtgagctgtgatcacaccagtgcaccccagcctgggcgactgatctagaccctgggctccttcccccaaaaaaacaagagcccacctgacagggactttggaggagagacttggcctttactgttaactttccccaactgtttgtcagggccactgaggaatcccatttgggatgagaaacaccccacattgcagggcacggctacctgaaggcaatcctgagaatccccctggacgttggtgtctggatccttctgatgcctgcctgctggttccacgagtctgctggccccaggccaggccctttgtcggagcccccgccacaggggctgctggcgtgcatctggagaaccagctgacagaaggcctgtgttctattcccctccccttctctgcttcacttgccatgaatgagcagaacatgagtggaaaagagtgatgcatttggggtggaagatgcgattgtcaagagcagggtttctggcaccaggtggtggagaaggagaaaggcctgacatctctggagcagtggggggctggtctggggaaggggaagcgcagaaatgctcagcatctggcgtttcaccctcacggtgatccaggttaccctcaaatccagtgttaagagggaacgttaaataatgaacccagagaaactttaaaaacagcagagaaaaattatgaaaatggaggaataatcctgcatctgtttcaaggttagaattttgtttttgcttttacagaaactaagctctctcttttttctctattaaaaataaatgcctagatcctttcacattgcaccctcgcttacatggggccccttcacatttttgaactgtcttggacgagagcctaagatccaagatgcattctttttttttacagcaaagtgaaaggaaataagactcattcatttaacgaatatttgtgaggcagcctgtgaagttgccttagaatctgggccaggtagtgagatcagtacgattctaccctttttctcctaaagtctgaagtcaaaggaggcaacttcaaaataaatgaaggtatctatgatgggctgagtgttgagagtttgcaccagggacagctcagagaacagctgcgtggggacaggaactatctgggtgagcagattgtccacagataattcaaagtcatcaaaggtcaaaggtctgtgagctgtgcttgtttagggattcattttcagtgtctctgtaataagttttgaactgatggctgttagggtttccaaaggacagaaccttgccttctttatgaaatggaataattttattgataatttctacatctgataaacctcgtgaacgtgtgatctgagctaacttcctgatactggctgcagctttgctcagtatccagggagtagctgagtgagctcagaaacacagagcccgtggctgctctgtgggtccatgcagttgttaatctcacgcagaacccagcggggaggtcagtgtggatggtttttgtcttagatccagtgagacatataaatgctgtaagactctggttgcactgttgaatgtggattttttttctttgaatatttttttcttattttgatggaacatttattcaaaatgtagcacctcctctgtcctttatgaagttatagtatgggacagttcattgtgacacacttttaaagctctttacttttttttttttttttttttttggagatggagtctcgctctattacccaggctggagtgcagtggtgtgacctcagctcactgcaatctccacctcccgggttcaagtgattctcctgcctcagcctcccgagtacctgggattacaggcacctgccaccacgcccggctaatttttgtttattttagtagaaatggggtttcaccgttttggccaggctggtctcgaactcctgacctcaggtgatccatctgcctcggcctcccaaagtgctgggattacaggcgtgagccaccgcgcccagcctatagctctttactttttaacatgccaccatatcttgtctgacatgagattattcatttagaaacattttatttggtcttccaaatacattagaatgtcagccacaaaagatagcttggggccttataattgaaccatttacttataagatttcaagtgtcaagttgcaataattttctgcaaaacataagtaactattttatgaatatgtatttgtgatgaatgatttcctacacaaatgaagaatctattttaatagaaaatggtaactggatatattactagatacaattttttttatttccctattttcagtttcaatagggaaaattaaaattttccctgttacttccttattttatttccctatttcaatgaatgaaatcataggcaactctaagtctcttgaggaaacttgggcgttatacatctctctcttctcccaaactcaaactagcttaagcaaaacatggaatttgttgacatgaataataggaaaatccaatgatgaagctggctgcagatggaactcaagagttttttgggtattggccttattctctcttggagtacaggggcctgagaggtggcccctggaagcttttccagcttcaacccaaaaagaaaaaagagagaccatctttcttctagtgctactaaatcaggtcttgtggaaggaatctctttggctgtggacagaggagtgggtctgtgcatggtctatttttgcagtgaggggtgggtggggtatggttataaggagagaggaagaatttccagatgaatagaggggtataatgcaggcaaaagccatacatgtccactgtaacatgcaaatatgatccatacctgtgtgcacacttcagccctgcatcagctcaaacacaggcggcagggctggagcgtggagaggaaggtggccctaccagctgggtctacagcttgtctccttccttctgagaacagtcaggtgagccttgaagcgatgggctaaggtgcagtgcttctcaagcttgtttttgttaatactcaaataaccaagaggactgaaatcgtgattgcaggtgggggtaggggtgccacaggtaactcctggctcacataaagaatggaaatagtggccaggcgcagtgactcacgcctgtaatcccagcactttgggaggccgaggcaggcggatcatgaggtcaggagattgagaccatcctggctaacacagtggtgaaaccccgtctctactaaaaatacaaaaaactagtcgggtgtggtggcgggcgcctgtagtcccagctactcaggaggctgaggcaggagaatggtgtgaacccgggaggcggagcttgcagtgagctgagatcgcactactgcactccaggctgggcgacagagcatatctccatctccaaaaaaaaaaaaaaaaaaaggaaatagtaagaatttcttctctgtgttataagctatgggaggggagtcactgagcagtgtgcccaaaatttttcctgtgtgacattttcaggctgtagtgggtggaaagattttgtaaatgtatcttcttggtgagagggtgtcctctgaatctgctggtaggttggagtgtttgcagggaaatgttcatcaaagggcttgctctgtgaagaatgtgacttaggatgatctttattttacgtgcattccatcatatgtaaacaaagttagggtctcaacattcccactagcaccttcagccaactcccaagcttctgtctcagcaaagcgtttgctgtagaagcctacactttgaacccatccttattttaggtgaaatcatttatttcgtctatgtttttactctctagtgtgtcatatcttactttttcacttcttgaagaaaaaaaccaattctgtcctgagtttggaaacctttccttggtaagccagggcccatttgtgtagagtaagcttttcaaatcactttacagttccttccacatttgttgaaagggagagtttagaatacaaatcactgttcagtagccaactgtgttaccagcccatcaatgccctgaggacactgcatagcagacattctcccgctggtgccttcaggtgcccggaggcctgggcctgaactggccttccacactcttggctggagatgtggctccatctggcttcaccttcagtgcctcctaactcgtcagtaacactcagtaaagaattgagcagaacttactgaaaaagcaaaacgtctttgtgagtttttatggcttcagcgtgtcctgagctatctttaaaaatagagcaacttgggctgggcatggcggctcacacctgtaatcccagcacttttggaggccaaggagggtggatcatctgaggtcaggagttgaagaccagcctggccaacatggcgaaaccccatctctactaaaaaatacaaaaattagcctggtgtggtggtgcacgcctgtaatcccagctactcaggaggctgaggtgagagaattgcttgaacccagggaggcagaggttgcagtgagccaagattgcactgcatttcagcctgggtgacagagcgagactccatctcaaaaaaacaaaacacaagcaaacaaaaagaggtggtcatggtgatgcatgccagtagttccagctacttgagaggctgaggcaagaggattgcttgaacccaggagttggaggcttcagtgagctatgatcacacactgcattctagcctgggcaacagagcaagaccctgtctctaaaaaaaataaaaaataacatacagcaaccaaacagcagttcagttattaaaatctgttcatgtattcagctattagacaaagacaaggaccgagttagatccagcctgtggaccagttgttccaatttgtctctgagcacactgaaatacagttttatagtgtcattcgatgagggtgctttatgcagcccgccggctcctttttgctggaaacaggtgtagtcacagccggagggagattcactgcagagtcaccagttgtgtagtttttccattcatcttgattctgaaaagagcttaaagacaactttaagcaattgttactttgtttgtatgcatctgcttcctaaggtctatacctagcgcctagacttctttttagatacaaaatgtgtgatttattttccttcaaaatttgcttcttttttttttttttcctggagtaatatgactcatgcagcagggttttattttattttatttttatttttattttttttagattataaaaacttcctctttaatcaaggcttttaacatgaacagatttcttgaataaaatggaaagtttccagtacactgaaacataaatccacaagtcaccatacatacaacacccggcaggaaaaaacaaaaacagcaagtttacatgatccctgtaacagccatggtctcaaactcagatgcttcctccatctgccaagtgtgttctggatacagagcacatcgtggcttctggggtcacactcagcttaggctgtgggtccacagagcactcatctggctgggctatggtggtggtggctctactcaagaagcaaagcagttaccagcacattcaaacagtgtattgaacatcttttaaatatcaaagtgagaaacaagaaggcaacataataatgttatcagaaagatgttagaaagtaaggacagctgtgtaaagcttgaggctgaaaagtagcttgccagcttcatttctttggtttcttgggtagtgggcgccggaacagcaagatgtgaggttctggttcatggatcatataatggacccatccctgactctgctgaacgccaagattcctccattcagattcagacatcagatgggttttagggaccagcttggctatgtccttgggcagcatgacatgtcgatactcaaactccttgtcatcgtatttgtccgaatagtaaatttgtttgtgcgacataaatgatttaacttttattctgaaaagcctcctgaatatttatatccctagaacgatacataagaattgatcatctttccttatgggaggacttttttttgttgttgttgttgttttctttttaattttattttttttttaattgatcattcttgggtgtttctcacagagggggatttggcagggtcataggacactagtggagggaaggtcagcagacaaacaagtgaacaaaggtctctggttttcctaggcagagtgtttgtgtccctgggtacttgagattagggagtggtgatgactcttaaggagcctgctgccttcaagcatctgtttaacaaagcacatcttgcaccgcccttaatccatttaaccctgagtggacacagcacatatttcagagagcacagggttgggggtaaggtcatagatcaacaagatcccaaggcagaagaatttttcttagtacagaacaaaatgaaaagtctcccatgtctacttctttctacacagacacggcaaccatctgatttctcaatcttttccccaccttgcccccttttctattccagaaaaccgccatcgtcatcatggcccattctcaatgagctgttgggtacacctcccagacggggtggtggccgggcagaggggctcctcacttcccagtaggggcggccgggcagaggcgcccctcagctcccggaccgggtggctggccaggcggggcgctgacccccccatctccctcccggacggggcggctggccgggagggggcgctgaccccccccacctccctcccggacggagcggctggccgggcagaggggctcctcacttcccagtaggggtggccgggcagaggcgcccctcacctcccggacggggcggctggccgggcggggggctgagccccccacctccctcccggacggggcggctggctgggcgaggggctgacccccccacctccctcccggacggggcgtctggctgggcagaggggctcctggctgggcagagggactcctcacttcccagtaggggcggccgggcagaggcgcccctcacctcccggacagggcggttggccgggcggggggctgagccccacctccctcccggacggggtggctgccaggcggagatgctcctcacttcccagacggggtggcagccaggcggaggggctcctcacttctcagacggggcggttgccaggaggagggtctcctcacttctcagacggggcggccgggcagagacactcctcacctcccaaacggggtcgcggccgggccgaggcgctcctcacatcccagacggggcggcggggcagaggcgctccccacatctcagacgatgggctgccgggcagagatgctcctcacttcctagatgggatggtggccgggacgaggcgctcctcacttcccaggtgggatggcagccgggcagagacgctcctcactttccagactgggcagccaggcagaggggctcctcacatcccagacgatgggcagccaggcagagacgctcctcacttcccagacggggtggcggccgggcaggggctgcaatctccgcactttggggggccaaggcaggcggctgggaggtggaggccatagcgagccgagatcatgccactgcactccagcctgggcaccattgagcactaagtgaatgagactccgtctgcaatcctggcacctcgggaggccgaggctggcggaacactcgcggctaggagctggagaccagtctggccaacacagcgaaaccccgtccccaccaaaaaaacacgaaaaccagtcaggcgtggcggcgcgcgcctgcaatcgcaggcactcggcaggctgaggcaggagaatcaggcagggaggctgcagagagccgagatggcagcagtacagtccagctttggcccggcatgagagggaaaccgtggaaaggagagggagagggagacgggagagggagagggagagggagagggagagggagacgggagagggagagggagacgggagagggagagggagacgggagagggagagggagacgggagagggagagggagagggagacgggagagggagagggagacgggagagggagacgggagagggagagggagacgggagctgtttgtacatcttattttttattttatttatttttttgagagggagtcttgctctgtcgcccaggctggagtgcagtggtgcaatctcggttcattgcaacctctgccttctgggttcaagcaattctcccacctcagcatcctgagtagctgggattgcaggctcatgccaccacacctggctaatttttgtattttagtagagacgggtttcaccatgttggtcaggctggtctgaaactcctgacctcaggtgatccacccaccttgacctcccaaagtgctgggattacaggcgtgagccaccacgcctgggctattttttaaattttttaaaatttcaacagctttagggatacaaatggtttttggttacatggatgaattgtgtagtggtgaagtcagggcacttagtgtacccctcatttagtgtacctgccccctgaatagtgtacattgtacccaataagtactttttcatccctcactcccactaccccttctcataggagacgtcaaggtgagtcaaccttcaaaattactaattgggaatcaattagtattttaaataagcagctcgtacattccatactttctggagtggctgctgcttccggctgcagaagccctagtgttggtggtgccacatcttcattcctagtttgtcttcattgctttgggacccggaggtctctcttgacctcaagcagaaattgttctccaaggctctggaaccccaattcactagaattgccgaatttctgccctcagaagtaccgtgcattgtgcgaggcatgcagaatggaggagcgctcaaccctgcagagagagataactcaggcccctcccttcctctagctgcctttccttaggaattcacagtttccttataattctgtccctcgggctgtttaggtccaacggcttatagcgtatgaatctctcaccttgagctttcctataaattccaagttcttccttagttttccttttcccctttggttatattaagagaacgttaaattgtattttggggccaggcccagtggctcacgcactttgggaggccgaggtggaaggattacttgaggttaggagtttgggaccaacccggccaacatagcaaaaccttttctctactgaaaatacaaaaattagctggatatgatggcacacacctgtaatcccagctactggggaggctgaggcaggagaatcacttgaacccgggaggtggaggttgcagtgagccgagatcatgccactgaactccagcccaggtgacagagtaaaactcgatctcagaaaaaaaaaattgtattttgggaaatgcttgtaatgtaaccatgctcacaataactgtatcaatttatttttttaagagacaggttgtactctgtcatccaggttggagtgcagtggtgtgatcatagctcactgcagcctccaactcctgggctcaagtgatcctcctgcttcagcttggactataggcatgtgctaccatgcctggctaatttaagaaaagattttttttttttttttttttggtagacacagtgtcttgctctgttgcccaggctgcttcaaactcctaacctcaagcaatcctccggcctcggcttcccaaagcactaccctgccaatatcaatttttgttattcctttctttgtttacatcttctgactttgttcgttcattacaattctgggtaggggggctgtctatgggatgggagaggacactgggctccttagcccatcataggatctagaagatggaattgcaattttatctatgtatctatctatgtatctatgtatgtatgtatgtatgtatatatgtatctatctatctatctcaataactatgtcttaggccaaaacactccattttttaggcttgcctctaaaatgaggataatgatctaatgaagaaagaagatttgattaatgtgggtaaggaacttttataggccaaacacgtattatttttccactgttttggtagtagctattagtatcctggcttttctcacatttgagtaaggcattcctatttaagaaggtgctttgaaagacgttttttcgggagaaggaaagggctggcacttgcaggtgtcttgtgtgtgtgcagttgtgatgcacacagcggcttggctctggagtgcagtgaggtctggcgcccacctggctctccaggggcagcttagtcctgctgggtgctcaggcatctattctctcccatttttccaggcatctctaggaacttactgccctttcaacgcaaagtttaaattttttatttgaagaaccagccaatgagaatgtatttggtgatgtcttcatagctgcaaccttttctatgtatgcgtgcctgtgaaggggtaggagggagaaaccttctagattgttttcttttttccttcctcttctctccttgcctttgctcctctcccccaccccccatccccaaataaatacacaaaacagaggtcctatagtgtcatgcttgagaattatggattcgggccaccctgcctggtttgaatcctgacttgtctctaacacctgggcaagttggttagctgttctgagtctcagtttcctgatctgtaaaatgaggatgaagacagttcttacctcacaggattatgatgagggttaggtgagttaacatatggaaaacactcggagtgcctgccattaacccatttatgcctgaggttgcagtctttttgtgtgaaaaatcggaccttggcgatgaccttgaggggtgggatataaataactcccacaagcttagcgttccaataatggaacactaggcatatatggttaaggactatgtcagcgtcagtgaccatgagacaaaaaccatatgggtcatagctatttgggagtagttgttaggaaaaagaattttagaatggagcattctgaaatactagtgtttctatatttttacagtaataggaaaaaagtcccgcctgggcacagcagctcacgcctgtaattccaacaccttgggaggctgaggcaggaggattccttgagcccaggagtttgaaaccaatctgggcaacatagggagaccttgcccttatattaaaaaaatatatttttatatatatatcatatatacatataaataagcatttatatgtattgttatatatatataaggttcagagaaagtagaatgttattgtattccgtgtgtagcaggaaaaataatcatcacagatctctcctgaacatttggtgtatgccaagcactataatgagtgcttgacactgatgatctcattgcaggctcttatgagtttgttcctgtgcttattttccagaagaggaaagaggttttgagagattaaacttgcccaagttaggaagtggctgaatgcaatgggattcctgagctcacctgctcatacggggtggaatgttctgtctccatccttctgctgagcagaaccagggagagttcatcggctttgtcatgaaaatcacatcgtctcatatggttgttagtgagtctagtaatgcatttcctttaaaaggcagttttcatgttgacgaacctctacttgcttctacttgtaagccagaatgccaaaaacaagaaaccaagttcacgattctttgttttctatgatttgacgaaggtttctggcatgagaaccttctttttgtagctgtaaagcaactgaggttcttcactgaggttgacagtgtcttagctgagtgagctgcggcagggattcccctgtttcctgtgtttccagttgcttattggctgatccaacttccagatgggtgctaatttcattccaggaaggggaccagagctgagcagctcatctgttttccttagcgtgctgctcagttatttgaaagggtgatttgagcttatttttcttcttgtttgtagacaacagtggtgagataattcgagtgtctacctataacagagtgttacagggattccgtaatctttgctctccagcatctgttggccggggtagatggggggtttgttgtccttggaaacctggaaggaactattagtcatgtcttaatcctgagccataaatttacactcatttgagagataagcaaatttggcagaaagactgagtcaaaaatctttgtcttgatctctgagacaggattagtggacaaactaaatcataaattatttattattttggtcacagaagctggagcgtcgccaagaaaagaatctttaaaaattattcattattggggctgggcgcggtggctcacgcctgtaatcccagcactttgggaggcccaggtgggtggatcacgaggtcaggagatcgagaccatcctgcctaacacggtgaaacaccgtctctactaaaaatacaaaaaattagccgggcgtggtggtgggcgcctgtagtcccagctactcgggaggctgaggctggagaatggcgtgaacctgggaggtggagcttgcagtgagccgagatcgcaccactgcactccagcctgggcgacagagtgagactccgtctcaaaaaaaaaaaaaaaaattattcattatccaacatactttacattgttcattattggtcatttaggctccaaatactgttacagattgaaaagtaagagaaaaaaaaatctttctactatagaacattgcagttttatttaatgggaaaaatattcttttagtctttttactcttccagaagaaaatgttccactgaataattgatgcttctaaaatgaagctttgcgttttatgatactagaatagctttcattatctgaacgaatgaatgttagccctgaatattaactatcttcatataaaaaacatttgaacgtaagaaaaatcagccaacttgattgttctcaggtaaagttcagaccatgaattatacagaaccccagataattgcagatgatggaactaatcacaatatgcaaatcagcaatgattaacaaccatatgcaggtgttctcatgggttgtgttcgaatgaaataggatattaaaactggaaacttaattatgtaattcaggatgataaatacattattatgctttcaccttttttaaaagaattgagacaaatgtagtcatttgtgattttgtaatctttgtttttattttatataaattaaaatataaaattcattattttttatgacagacaggtgaaataaaaacatagggccttctagtattgcatattctgatctgaagttctgcttctgaaatgtatgcttggttctaaatgatataaatagcctccatattactgacttatacttctaaaacttctttctgaagattcaacagcagatccttgttatccaaggataatgagaaccagaaaaaaggccatttaaggtcaatccacttaaatggggaccaacatttcatataatgaaaaaaagctttgggactttatcatgaaaaaaattaactgaaaactatgaaaataagttattttagcatacatttatcaaaatttaggtgatcattgtgactatggctagctcttagaatgagcagtgtgaaagtcaagtgttgattattttgaaaggagtaaattttttgtataaaatgaggcgattctacattttggtactttttatatcacaattgacatttacatcacagcataaagatgaccagtgttacaaagatattcaaggtcttggtcattttcctctggagccgtttagatttttaaatactaaaatcactgtagaaagttctatcttgtcaccaacgttagatttttctctgaagtgattgtttcctaatcaaactgctcagctcccactggccattgttttacctgttattggggaaattctctaatgccattttgattagcctcatgaaattctgtatttgggggaaagttttgcagtgttgctctgcagtggacatacatctgtgggaggtacgagacagtcactaacagaattagggatagaggctgactttgaacaatgatggatttttaagagggactcaagtcaaaaaaatggctatttggaaatattttagtattttgaaggtgtgcttccctgaacaagcccatcatttgtagggatttgggtcatgaatactccaataacaagggctccctgacctgtgtgtatgaatgcattgcagtatgcagtatgaaaaagagactcggctgggcgcggtggctcgcgcctgtaatcccagcactttgggaggccgagatgggcagatcacgaggtcaggagttcgagaccagcctggccaatatagtgaaaccccatctctactaaaaatacaaaaagttagccggatgtgttggtgtgtgcctgtaatccccactactcgggaagctgaggcaggagaatcacatgaacccgggaggcggaggttgcagagagctgagatcgcgccagggcactccagcctgggtgatagtgcgagactctgtctcaaaaaaaaaagaaaacaaagaaaagagactcatgagtcggggagataccagttctagcctcagttctgccagtgggtagctgtatacgcatggatgaatcacttccttttggcataaatttacttatctgtgaaaagaaaaagttgagctaaggtcccttctactcattctgtgattctaaattggatattttgagttggggaagagctatatcactgtttgcataattcctagagcttagcaaatatcaacaactccttcttttagtttatttgcactgtatatatatgtgccttttatgatttcagtatcttcatccatatgtaattatgctctgggtaaagttgtaaacagcactttggtaaaattttaaattctgctcttttcactagtcttatctcataaatgtttgcatatatattgtaaacttaacatttttctctgttttcacatttacctttcctaatagctgatagcacataataagtgtattaaaacatatacttaaaacatatttaaatatattaaaacatactgatacacatcctgatcactgggcaactgagcatctccatacttcagagatttttttatgtttttttgggccgtgttaccctagacatttttgtagatagataattttttaaaaagagctcctcacacttgtagctcagttctgtgtgcatttcagtgctcaaatgacttttgccactgctgtaaacaggaagaaacaaactaaggcaaagagcccagctaagtgaaacagagaggaacaaaagaaaattagaacttggcttttgctgctgccaagctgggcaaatagcgatcccagggagcctggtgttaaataacaaagaaagcagggaacgaggcagaaatcccagtgggatctgaacggcatcttcagatgcttggctgcccctgccacactctagggagcatctgatcacctgggaggtatggtgacctttggcttctgacgttgcactggtcagaccaaccgtctccagagagctaagccatcaatcatcccctgaggggagacagtcaggctcactgcctcaccgcctcgaagcatccacaaactgaattagctaatgctacattattagacatttctgcacttttcatttatattcagaagcttggaaattttcaatgtgtctttgggggaaaatagtttgttcaaccattataattagattttctaccccttatctagataaatgaagcgtaattgacactttccccttctaccggggaaagtgtcattgctgcttctgcatatgtgtgtgaactatttgcaatgcttgtttctcatggcttaccccagaactagggcggttattgggcaagaaagggaactatccattgctgaaactgggagtaacttgtgataaccaaattagtgactgaggcaaaagtctcagtcgatgagtttattaagccatcttaagggcataatccaggggaaaaacaaatgccatagacagacctgtggctgttattccaaagaagttttcaggaggtttagtatttataccttttcttaaagggggaaggcattgtagaaaaaggggcaggtaggtggtaaagcaaatttacggggtttttgtttgtttgtttattgagaaagagtctcaactctgtcacccaggctggagtgcggtggcgcgatcttggctaactgcaacctcccttcccagattgaagcaatcctcctgcctcagcacaagtgtgcactaccacggctgcctaatttttgtatttttggtagagacgggggttttgccatgttggcaaggctggtttgaaactgctgacctcaggtgattcacctgcctcagcctcccaaagtgttgggattacaggcatgaaccacctcacctggccaaacttgacatttttgggagattttatttagtgcccagtaaatctacattttgcatacggtaaggtgaatgtttgaagagaaaaaagggaataaaggaagaatcaattatgcagagtttttgggtaggtggaggaatgattgatctggtcttgtctttgttctataccagggaagataagcttgtaattgacattatcagtgcggaatcgaatagactttagttttaagagctagacttagattgtaaacataaaattacaattggcatgtccttgtttatgggagggcagcaaaaagtttacttacctatggaggcagtcctgaggccttctcctctggataatgctagtaacagctcttcatttgaaagagggtgttgcatgactcagcctccaggcttaatcttttattttgcgtaaggagtttgggggtcttgagatttttttaaatattcccttgcacgtggttgtttgcaagaagtaatggcaaagcctggttaaagtggattcaatcaaaacaattttagtcatgatttaaattaccaagtaggaaaaatctagaggattctagaaattgtgtgtcagtttcaaatcctactgtgctggtcatatggaagtgaggaatattgataaagtaagaagcagtgcggtatttccagaggttaaatgcaaaccgattcattccatttcatttaagtatatatttctaggctttggaaattacatcctatgatttttttaaaacttttctcccccagattctggctacattggagattggttgctttctaaaactgaaggagaagcccatgaagagatggtggattctcactgagttttgactagcggaagaaaaggtaattattgatgatttcggaatatgtttgcagtatcatgtggagttcagctgcagtagcagcaaagacaaaactgagagttttagacattttctgttataataacaactggtaccactctaatttcattgtgtgagatggactttttaaaaacaaaacttaaaatgttcttcttaaataagcttttccaggtaggtctacctgaggattaaggtgttaccatcaaagcagttgactcctttccttagaccatgttcctgggcctgattcccagcttgttctgtgtgacagcctcacatttatagggattatgaaagaatttccaagatagaggttacaggaagaccactaaagtgtaggaactcattttaatcacaggttccttgcttgtccattctgaaagtatcagtttattttttctctctacttcaagttgctctgcctaatgattggatttatagttaaaaataaaccatatttaaattcatattgatctactttgttaggcaaattggtcctagggccaatgggtggaagatataaagaaacagatttgaattcagtataaggaggattttttgaacatctgactgactaatgaatgggttgcctggcctggacgaagctctccattgatggagatatttctattgtaaaccaaagattaaattctaagccaagtgactgaatggaacatcctctcagccaagggacccaacaaaacctgaaaaattagttcagatcatgatggaaagggagggtcaggcatgcctcattacactctcctccctttggagttcaggcaaacaactgaccagcattaacttttcaaaagaagacatacacgtggccaacaagcatgtaaaaaaatgctcagcatcactaatcattagagaaatgcaagtcaaaaccacagtgagataccatttcacaccagtcagaatggctactgttaaaaagtcagaaaataacagatgccggcgaggttgtggagaaaaggaaatgcttatacattgttggtgagagtgtaaattagttcatcgtggaaagcagtgtgacaattccttgaagaacttaaagcagaattaacatttgacccagcaatcccattactggctatagacccaaacgtgtatacattgttctgccataagggcacatgtacacatatgttcatcacaacaccattctcaatagcaagacatggaatcaacctaaatgcccatcaatggtagtagactagataaagaacatgtggtgcatatacactatggaatactacacagacatgagaaagaacgagatcatgtcctttgcagcaacatggatagagctggaggccattatccttagcaaactaatgcaggaacagaaaaccaaataccgtatgtactcatgcataagtggaagctaaacaatgggaacacctggatactaggaggggaacaacagatactggggcctacttgagagtggaggcttgggggagagaaaagatcagaaaaaatactcattgggtactacgcttcctacctgggtgatgatctgtacaccaaacccctgtgacacacagttttacctacgtaataaacctgcacgtgtaatacccctgaacctaaaataaaagttaaaaaaaaataaaggtcctaagactgacagaacagtaagataccaaattccaacctgactctactgtagcatcatatggtccatagcaggcactgaaaacaaatcacagtattttatccctttgacatattttgaaatagctttgtaaagctgtttcttttgggagaaatttacattccatagagaatcctttccctttccaggtcttttcctaatactgaagagattggctgagagtctagcaccttttaacggtctgcataggaagcattgaccatctattgcgtttgggggcagccacctatgagactatgagacttcatctacataagaacttttgcctccacaacccccatattaacccaaacactcctctcctttctgtttattccaggtctttagacaataacttaactctttcaaccaatttccagacagaaaatctttgactccacctatgacctgtaagcccccaccccccaagttgtcccgcctttctggatcgaaccagtgtataccttccatgtattgattaatgtcttctgtctctgtaaagcacataaaaccaagctgtaacccaaccgccttgggtacatgttctcaggagctcttgagtctgtgtcacaggtcatgatccataaccttggcaaaataaacttctaaattgactgagacctgtctcagatactttttggttcacactatagaaactctgtgtttgtctgacaaggatgttgctgcagaagagcctccctgaactggagttggtcaaactgaatcttcctaggtctattttaaccaaaaggaattctacagtttctctattgatggcccaaaggaagcagagttttttggagtttttttcggtgggggtggttggctttttgttttcacacattaaaaaaattacgcaaagatgttcaactcaattatggcacttgtaatttctggtgcttctgtcatgatttggggtgactttcatgaaatgcttattctcaagcatatttcctgaccagtgtgccatgaggttagagaggctattcagagtgaggatgattttgtgcttccatggtgaagtgcagcacagaggggttctctggggcaagttgggggagcccagagtgcatggagagtgagggcctggcacaggctgtgtttggatcctaaggaacctcttagtgcaggtgaatcagggtaaatgacaatgaaaatctgcccgagggagaagatgtgatcaaagtatgtgcaaagcaagtgtgtgtgttttgctaggttgggagggagaagattgctgtaagttgattataataagcctgtgtaaaccaaaaataaaattctaagcccctcagccatctgaatgaacccctcctcttggccaaggccattccaaaattaacctgaataactagttcaggccctgatgggaagggcgaatcagacatgcctcatgataccctcctcccttttggaattcagacccagctgaccagcattaagatgaacacagaccttaagactgatagaacagactctttaagtctaataagaaacctttacaatcagttttctgaagcctgaagcctgctacctggaggcttcatttgcatactaacaccctggtctccacaatcccttatcttaaccagacatcccttcttattgattctaagtcttcagacagtaatttaactctttcagccaatttccaataagaaaatctttgactccatctatgacctggaagccctcacccccactcccagcttccagttgtcccacttttctggaccaaaccattgtacatcttacaagtactgattgaagtcttatgtctttctcaaatctataaagccaagttgtagcccagtcaccttaagcacatgttctcaggatcccctgagcctttgtcatgggcccttggccactcatatttggctcagaataaatctcttcaaatgttacagagtctgactctttttatcaacacctgacttagaatctcagcaccatctttggacccacctgctctgctacctttgagcccttagtttctgcctcccttggccaactctccccattaaccattctatgaggacaggtgaatagtcattaaacatgaggtgaagcacagtgttttttgagaacatctgaatgtcctgtgaccattcctgtagctaacatacacttgaacctagaaaagcatatctgaattgtaacagaatttgtatactcctctttcttcaccaagcctgtctaattccaggcagaaatgtttctccttcttccttctaaatgcaacatcattttgtcctttgcatgtttcattggtttggttccttttattaattatgtaataattatggtttggttccttttattaattgtgtgtaaagggtatctcctcactgatcactagacgataagctccaggaggaaaaggatttctttctgttttggttgctactttatgccaggaacctagagcagtgtctggaacttagtaggtgcttcataaacatttacttaatgagataacaaatgtgtctctctggctaaactgaaagcttcttggggacaagaagagtctcttcgtctgtgacttcatcattgggctgacgcagcagctgccttctcctctggctatgggactgtgggctgagatacctacacgtgggctactctctcaaaagggctgaggagggggcgtggtattggagctgtgttggtgactagaggttaagatctgccaacctgctgcttaaggcgtagaagattctttccaagatgcatacaaatgagatttggaagagatgcaaagcccagagccagcatgggtgtccatgctaggaccttttactagctaggatcaccagcccctcccaggaaactctctgatgggctgagggagtggggacaggaagggcgtgtgctgggtgtcacaacagagccttcccttcaagacaggtctgagcggaagtgtgtggtaagtcacatggaggcagaaggtctgttcctgatcagggttaaggtgcccctttggtctcccttcctagcctgtgtaagaagccctgcatctgttgaaataaacaaatgcgacaaggaagcgcagaagcagcaagccttattgcaatgtgcctagtgtggtttgtagcaaggaggaagtcctgctggtgggagcatccagcccagctctgatgatctgaaaccatctttgagtaactggtgcccagagggaatgttttactttttggctgcttttctgacgtgatcattaggaaagagataggcacacttttgcacaacttctatgctaagcttctttgtctggaaaggaaattttagttgcaaggacttaaaatttccttcttgtgagctgatacttttgagacagtcaagaggatgttaatttaatgaaatcatgaacttatgcttcttatctcctcctcctcctcctcattcttctctctctctcaacacacgtacacacacacacacacacacacacacacacacacaccattccatctttagaggtcatcatgcctttgcatgtcatgctttgtgctgtggtggctggagactctctttccatcaccagctattccctgggctgtcattctgtgtaaaatcctttctgctgacttctcatccttccttgcctgcacgtgccctaaatctcacttttctgcccatcctctttggctcatcctcttctcttcccacacaattcccttctcccagtgccatcctccttcccagttgtaccagtcacagccccattccctaccatgccaattacaaatgcaacccctttatgacagcttcctgccccacctccacagggaactcacctctcttccgccctgcagtgctctgagcttctcccatggactttccgtctcctgcccctgagccagttgtttgtgaggcaagcccagcaggtagtgtccatgcctgctggttgccttctccttccctcccactttctttgctatttttttttttgagatggagtctcactctgtcgcccaggctggagtgcagtggtatgatctcagctcactgcagtctctgcttcctgggttcaagatattctcctgcctcagcctcctgagtagctgggattataggcacacaccactacgcccagctaatttttgtatttttagtagagacagggttttactatgttggccaggctgatcttgaactcctgacctcaagtgatccacccgcctcggcctcccaaagtgctgggattacaggcgtgagccactgtgcccagcctctcttgctatttttgatttgccctaaactccatcacccttcttaaatgcatggtacactttttacagcataaatatttggtgatagccctgaggctaaagtgcaagatcacagcacgcatcggggcccatttggtgcaggctcccatcccacggccccctgcccatgcgccatgctgtagcatgtgtaattcctatcaactttctgaaaatagcaggctccaggcctcgtgttgcatactacctggaacaccttccctcttccttctcaactggctgcatctgactgatcactaaagatgccattcaggtgcctcctccaagaagctagctgggtcatatgcacctccactggtgggacggggagagtggacagaacgcctatgagaacatgtgccagtctgtatgtttctggtgctgatctccttgactaaacagacttttattattactgagataggatcttattctgtcacccaggctggaatgcagtagcacagtcacggctcactgcagcctcaaccccttggacttaagagatcctcccacctaagccccccaagtggctgggatgacaggcacatgcaactatgccgggtaatttttaattttttatttttaggagagataggatctcgctatattgccgagggtctcgaactcctgggctcaagcaatcctcctgcctcagcctcccaaagtgctgggattacaggtgtgagccactgagcctgacctggacttttttttttttctaattttagattcagggggtacatgtacaggtttgtgacatggatattctgtgcaatggtgtagctcgggcttctgtaaacgaacttctgtaaaggtggaactggatccctgacctctagcagtgccacccaacagaaaggtatttagaaagtggctggcttggcggggcatggtggtgtgtgcctgcggtcccagctgctcaggaggctgaggtaggagaatctctagagcttgggcagacgaggctgcagtgagccgtgatcagcgccactgcactccagccagggcaacagagtgggacccccatctcaaaaaaaaaaaaggaaaagaaaaaagaaaaaaaagtggctggctttctaatcattcatcttcagactttccaatctgtactcaatgcttttggttttaggtttttgtttttctaataacatatttgatgaagaagtcccatctgatgcagaggagacttgcatgtggaaaggagttgtcactatttcttaaattgtggcttcactggcttcattacctgcaccttctcttctcacaaatatatgtcatttttatttaccatgacatttgagaatttagtaaaagttagtggagcaagttagtccccttagttgcctacaagcagctctaaacccaggtgtttttttgttttgtttgtttgtttgtttgtgacggagtctctctctgttgcccaggctggattgcagtggcacaatctctgctcactgcagcctctgcctttcaggttcaagtgattctcctgcctcagccacccaagtagctgggattacaggcgtgcgccaccatgccaggctaattttgcatttttagtagagatggggtttcaccatattggccaggctggtctcgaactcctgacctctgttgatccacctacctcagcttcccaaagtactgggattacaggcatgagccactgtgcctggccacccaggtgtttttaattttatacacaggctgctacaagcaaaccaatgctgggagatggtcatgcagctcaggtcaactcagggtaccctcaacctaaaatgtgagaggagagctgcagaagcaatggacgagaagggagcaggggttttaatatcccccacacatcttccagcttctactctgctcactaatttcattttggacaaaagcttgttgattcttcttactcaggctagttacctgcattatactgaacagaattcctccagggaacagcctcttggctaaatcaacatacacctgccattcacagatgcagggtttctagcaagattctagagcagggtccccaacccctgggccatggatcagtactggtttgtggcctgtttggaacctgcacagcaggaggtgagcggcaggtgaacgagtgaaacttcatctgtatttgcagttgctccccattgcttgcatttccccctgagttccgcctcctgtcggatcagcagtagcattagattccataggagcatgaaccctattgtgaactgcgcatttgagggagctaggttgcatgctccttatgagaatctaatgcctgatgatctgtcactatctctcatcacccttagatgggactatctagttgcaggaaaacaagctcagggcttccactgattctacattatggtgagttgtataattatttcttatatattacaatgtaataataataaattgcacaataaatgtaatgcacttgaatcatcctgaaaccatccccctcaacccctggttcatggaaaaattgtcttccacaaaactggtccccagtgccaaaaaggctggggattgctgttctagagcctttgtctttcagataaggtagaccctggcttcacttctaaaaggaagataaatgactttctagtgatatttgcccattttagacaaatgtttctgcaccttagactgagggcaggtaggcaggatcattgctggggtggcttcctgcttgaacattgtagtttctttgagttgaaggtagaacattaagatgtgatcactgaaggaggagcatcaagcacaaatgagctcctgatgtagtttacacagcacttgggtggaaagggccatccctttccctctttccttatggaattgggaatccgacagtaagtggccaatgaaaatgtatcctcgctggtcacagtggctcgtgcctgtaatcctagcactttgggaggctgaggatggaggatcgcttgaacccaggggttgagagaagcctaggcaatatagtgagacctgtttctataaaaaaataaaaattagctgagcatagtgctgcacagctatagtcccagctacttaggaggctgaggcaggaggattacgtgggctccattgcatggagtccaggagtttgaagctgcagagagctatgattgtgccactgcactccagcctgggcaagagtgagaccctgtcattctgacccaggtgttattccgagcagcactgacagcattcagggctaggtcatgcttggttctcttggcagaattttttctttggtttggggatatcgcctgtacatgacaagacaaaggggcaggaggaatggaagccttccagcatcgttcacattgcatgcttggaaacactacttgggggtggaaagtgaatgcatctttgtggcatctgagttcccagcaaagggtgtctgctgagctgaaggcaaaaagggaagggggagaattttatagaataggacatctggggcactcacatggagggagatttaatactatttagtccctggcattatttctctttccttaagtttacactttttaaatttgaaattgagaaatgatcacatttaaatagcaatgattaaacatgtagttgatccagttactttgtcatcctttatttagaaatgtccgtaagtaagtgatctctagtctaggaggcagatgggttctgatgacctgggaagaactctgttgttaccaaggctaaatctccacaggtgtttccaagacccaagggtcacagctgtgtgccagtaggaaaagaggggtggaaaatcgactccaaacggccaaatgggcgttacatcctaggcaaatgccaacctaaatgtagccctttgtgtggtcaaggctgttgtcaaaagcagaaaaagctagctctaatttctccaaaccaatgtccagctcagtgttccaactgccagctgctccggccccttaaggtgataactcagggcccagagtgacctctcttgctccattggagccagccaaacccttgtggatttttttgtacttacctttgacaagaggaaatctctgcaaacctctgtgtgcagttccagaaacatgttttactttatcatcatgctcaaagactgctttgtaagctctctgcattgggggtaagctggttagcatttacctagtatttgtgtttattaagttagtctttgctctcaaagagtttatattgtgcgtgtgcgcacacacacacacacactcttttttttccacttaaaaacagaagaatgaatgagtgtgtatgtgtttaggtgacactgagaggtaatgttaccaaaacaccagtggttcggtcttgatcctgctgctgttcaccacacagaaagccaatcactgagataatcagtactgccagggaagaaggctttattcaggtgctgcaggtgaggagatgggagatcagtctcaaatccatctctctgactgactaaaattaggggtttatatagcagggaagaaatgtaaccatgcatgggaaacaggaattagagagaggtaaggatgaggaattggtcaacaggaagcagggggtcagtagttatcatgatgggtgaggggtctggtgttttattgcccagatgcagtaatctggtaagtttcagctctgtgatactatctcagaggactgatggttggtttcctgagaaaggagctcagataagacaaatgtaactttcttatgtttcaagactgggaagggtcaatttctatgtttattcaaaagaaaccataaacatcagttctatgggcaattggactgatcagtcatgtagcaataagatacccatgaatacatctttactatcatgaacaagtctttgtgtaacacttgggcgaagactggaggaaacggtatggtttttctattgggagggtggataagggggaaaaaatcattagttttattcttagaacagatgagggtgaagatgtaacacggtttgatggacaggaaatggaaacttgctacagtgggactggtggaagagcagaggtgtgctttgtgaggttctgggggtctgtgtgggtgggagtaacatcctagcctggagagggctggtttcttcttgttctttttgttttgttttgttttagagacaattgcagtgcagtggcacaattgtagctcactgtaacctttaattcctgggctcaaatgatcctccagcctcagtctcctgagaagctaggaccacaggcatgcaccaccatgtccagctaattggttaactttttctttgcagaaatggggtcttactgtgttgcctaagctgatctcaaactcctaacctcaagtgatcctcccaccttggccctgcaaaattctgggattacaaacatgagccattgtgcccagctgagggctggtttctagaaatggtggtatgccaggcttcatactggggtcatgcatgtggactgggctcattggcctgattgctctagcaatatgtggggtaggaagaatcatgccccctctctcctcctcttcgaaaaatgtccacatcccaatccctggaagctgtgaatatgttcagttatatggcagttgggaattaaggttgcgagtcagctgtccttgagatggggagattatcctggactatccaggtgggacttttgtaatcgcaaaggtcctcggaagtgaagaaggaagtcaggagagtcagtgtcagagtgatgccgtgggacacagtcttcagggctgttgctgccttgaagatgcaggaaggggccgtgagccaaggaatgcaggtggcctctagaagctggaaaaggcaagaaaatggattctccttgagagcctccagcagaaatgaggccctgccaacaccttgacttgtagcccagtgagacccaaacatctaacatctaaaactataaataagaatttgtgttgttttaagtcaccacgtacatagtcatttgttacagcaagctatagcaaacaatccaaatggagacctgtctctggtttggaaatgcgagacattcttatttatttgtggaatataatataatggaaaatttatggaatataagtaactccaagaagattcttgtcaacattaattctgagatttttctaagctaatttattttactacagtaaggccaggaactttattgctttgctgttgtctcctcactgcctcgatcagtgcctaattcattcctttttgaatgaatgaatcttttctaaccaaactcatgaaaaaccctaagaaacaccccccactttttttgagacagaatctcattttgtcacccaggctggagtgcagtggatcacagctcactgcagcctcaacctcccaagttcaagtgatcctccccacttggcttcccaagtagctgggaccacaggtgcacaccaccacgtctggctaattttttaattttttttttgtagaaatcaggtcttgctatgttgcctagactggtctcaaactcctgggctcaagtgaacctcccgccttggccttccaaaatgctctcattacaggtgtgatccactgtgcttggccccaccttttcaaaaaaaaatttatgctaaattgtaaatgttaaattgaggctcttgttatagacaaggcatatcatacttcgcattatcattcaaagatgagaggcttaattagagaattttctacagttgggttttaacaagagccattcttaacttccttggggtctaagaacttcttggtacctacacatggttgaaatgttaaccctgtactttgctgcttagcaagactgctgtaatgctgatatggtttggctctgtgcccccacccaaatctcatctcgaaattgtaatccccacacatcgagggagggacctgatgggagatgattggatcatggaggcggtttcccccatgctgttctcgtgatagtgagttctcgcgatagtgagttctcgcaagatctgatggtttaaaagtgtttggcagttcccccctagctctctctctctctctctctctctcccccctaatgccatgtaagacgtgccttgcttcccctttgccttccgccatgattttaagtttcctggggcctcccacactatgcagaactgtgagtcaattaaccctcttttctgtataaattactcagtctcaggtagttctttatagcaatgtaaaaatggactaatacaaatacatagcaagttaggaccttaagtcagtgattaaaaaaaaaaagtattcattatttgtgaaactcagcttggaatatctgatattatttactaacatataattaataatcattgcatggcatcttttagaataagaatatttctagtgtagatttatttctttactcattctctaaagaaatctttgctaaggcaggtcacagtagctcacgcctgtaatccccgcactttgagaggccaaggtgggtgaatcacctgaggtcaggaattcaagacaagcctggccaacatggtgaaaccccatctctactgaaaatacaaaaattagctgggtgtggcggtgggtgcctgtaatcccagctactcgggaggctgaggcaggagaattgctttaacctgggaggctgcagttgcaatgagccaatatcacaccactgcactccagcctgggcaacagagtgagactctgtctcaaaacaacaacaacaacaaaacaaaacaaaaactttgctaagatcctgctgtgtgccaggcactggagaaacaaagataaataaacaagatatggaattttttccagaggaagccacattctagatgcaaagaaagataagtgagtagctcaagagaacatggaatagcagtgctaaaataatttagggtgccaagaggaaggaacttcccactctgcaggaagagtgcagcagagaggaggagatatttgaacctagtactgaagcacaaggaggagcatagcaaatgaaagaaataaacattattaattgcctactgaataccaggcaccatgctgggcacttatgtgcgtaattttattatttaatttttaccctaaggaaaattggatttagttaagtaactttgcaaagccacccagagtggcatttctatttttttcttttttctttttttagagacaggatcttgctctgtcgcccaggctgaagcacagcggtgtgatcacggctcactgcagcctcaacctcctatgcttaggtgatccaggatggcatttctggttattgtcttagaaatcattggttttaacactctagaggagagactggcagacttttctgtaaagggccatattataaatgtttcaggttttgtggaccatacagtctttgctctaattattcaacattgccactggaacatgaaaacagccatagataatacagaaatgaataagcatggctgtgttcgaataaaattttattggcaaaaattggcagtgatgtggcccacaggttacagtttgctgacccctggtctagaagagcaattacaggtaccattttgtttggagatatttctggagagggagcctataggtttcattagcttcttaagtgggtcagcgactactgggatttctggtcagtgacagtttcagaatgtattatagaacctcacagagaaatgatagcaggctggattaataatagagattcagactgacccaattttctagcattttacatcataaggattaatattttacagacctctgagaatccagatataatacatctttaggtcattagagaggagtccaaagagaaaaccacactagttcagtgttggcagaggatttgacattgtgtggccatgtgtatattttaacttggagatttaaaaaaataggaatagagatgatatgtctggagccattggaaagaaataaggtaaatatctgaatggatgacctaggagaagcctagagtatacagcctcaatcctgctgtcttctggaaagacgcagaaacagctggttagtgtagcaaggaaggggatatgtgatcggaagtcccagcttcagtttggaaaagcagaatgcatccttgacatcttaaaacaataagccagaaaaatctgtcttgaatagttgatactgtgggaaaagtcactaagttcagagattcgagtaaggaatactttagagcaacacagcgaattttcttttaagaacggatctttccaaagcatatcctaagagatgtagtgtggtgggaaaacacctgggaaaaccaataaaggacttccaaaatgttattgaaaggaaacattgggaagctgttgaaggcatctatcccggggctacgtgactaagaggagatttttctcttggctgataatggaagggtggataagtaaggttactttggggagctaatttcttttgagtaaaacttctcaaaaatgaaaagcagatgaagttttaaaggtgggttcaaggtttggacggttccagctggattgaaacattttctctccaacagaggaaatagatgaaaagtgaagtcggtgcctgcagtctctggggtctctgcgcctggtgttccaaggaggattttgatctggtccctcatcagactctgttgttgctcttagggttggatgggaggaaagaggaggaaaagatggaaaatagaggagttgttggactcctggaagaagcacatgttagccagccacagttactccaatcaaaacaatttaaactttcccttccattttgaatcctgggcacgattcctgtcttggctgaaacagatgtgattttgggacatgtacaaaatcttataatatggaggctgagccttgctggctttcctgccactgcacttcactctaacttgcagggatcaattccataccgttttacattctcttgttgtttctggcctctttctagatgaaatgcagcttcataaaaactcagagtttcctgaacctataaatcttagagcagctgaagaaaataatctataaagccgataaatgctttgatatggattatgtcaaacaaacgatgtttacacaaaagactttaacatgtagaccaattaaagattcttgtaatttgacttctctttcccatcagactaagcctttgtatcacagaaatgtgacagaaaatacccacactctgcaacctggctgacatacttttgttttagcaagggttaaataaaggggctcttcaaagcattgttgatctattttataaagctttgaagcttttattagctttgctggaaatctttgtttcctggaaagttctctaatggaatatatcgcttctcacagaaatccatttcttaggtgtatatagtcagtggcctagttggtggagatgctattacaagattaaattaatatctaaactggtcctgagtcaactatttccattctaaaatgtttaaagtcttaaggtttaaaactattggggtcaaattaaccttttctttatcttttttttttttgagatggagtctcaccctgtctcccaggctggagtgcagtggtgcaatcatggctcactgcaaccttgaccttttgggctcaagtgatcctccctgctcagcctcccaggtggctgggactacaggtgcacaccaccatgcccagctaatttttaaatttttttgtagagataaggtctccctgagttgcctaggctggtcttgaactcttggactaaagtgatcctctcatctcagcctcccaaactgctgagattataggcgttgccaccacagccggcaactttcctttatcttaaatcatgtcactaactcccagacagcaatatcaatacattttccagcaattcaggtggctgctaacctgcttcgtcccaacatctcgatctccatctccatcaacggcaccttcgttcactcagcggcccagtctggccacttctcagtgcctccactgtgacctcccagcccagggccatcatctctgtcaggatggctgtgggggcctcctatagagctccatgcttcttctcatccacctccctgtctacccattccccaaagtctgttttcctcagagcaactacagtgagtctttaaaactaaattgagatcatgtcactctcttgtttttatccaactggggcttctagaaactctcagaataaactccaaagtcctggcccagagcctgtgtggccagcactcagccatcactgaacagcacttcctgctggttatccgggctctcttcctttcactcactgcacgccagccaaactggccactttgcaagtttcgtgcacagaccagtcatactcccatctcaagagatgggagttgatgcttgttctttcctccagcaaaactctccctgcagatgtgccccagccttcttccccaattcttctggggctctgctcaaatggtagctcctcagagacacagaccactttatctaaaacagaatcccccatcctcttaatctacttccccttccctgctcttatcagctgacattcagtctcttagggatcaatacatgtatttgtccattcatttatttatttgtcagttactcccaaaagaatgtgagctccatagagacagggacattggtttatcattgtacctatagtgcctagaacagtactcagcacacatgggcaaccaggagtattgactctagaaaaaaactggaatccttcacattgtttttggtctgggtgtgtaggctgaatcatagtgcagttatgttttttcaatagtacagtaatttgaaaaaatctttctgctccactaaaggtttgccatttgacggtcaagatttatcttagatttggctgggcgcagtgactcacacctgtaatcccaaccctcagggaggccaaggtgggtggatcacctgaggtcaggagttcaagaccagcctggccaacatggtgaaactccgtctctactaaaaatacaaaaattagccgggtgtggtagcacgtgcctgtagtcccagctacttgggaggctgagacaggagaattgcttgaacccagaagacagtggttgcagtgagctgagatggcgccattgcactccagcctgggcaacagagtgagacttcatctcaaagaaaaaaaaattatcttagattttacttcttgcctgaagattttagcagtaaccttggcttactttcaacataattaaacatttggattgcagtagctgagtatttcagtgagttagtggttttgtaggcctcatctgtgtagacagacagctactggatcctttctgccttctttccttggtgatgagcaggtgcatacttagcatgaggagaaaaagccccatattcctctgttttttctttttttgagacagggtctcactctggtgcccaggctacagtacagtgctcctctatttttaatacaagagagttcccattattatctaaacactcagaggtagctttaagaaattttatatggctaagggagctttattctctaaaaataagctattaatagtcgtcctgtaaatatagggtgagaataaattggacctgggagttagtaaaggaagttagacacatggtttgtagaaccttgtagaagatgacaatagccctattccatgagataattttattggcatcatttctctgagctgcttttagaaagtcagatttattggtatataactcatatataataacgttgcctctttttagtgtacagcttattttttttttttttgagagacagggtcttgctgtgtcacccaagctacagtacagtggcacaggcatggttccctgcatctttaaagtcctgggctcaagcagtcctcctgcctcagcctcctgagtagctaggacagtaggcgcacactgcaccaccacacctggcttatttttattctttgtagagacatggtcttgctatgtttcccaggcttgtcttgaactcctgatctcaaatgatccttccctctcaacctcccaaagtgttgagattacaggtgtgagccactacacctggcccaggtgtgttttgagaagaccataccattgtgtagccaccgacataatcaagatgtaaatatccatcatcctgaaaaagttccttgttgccccgtgtcatcagttcccacactcagcccccaaattctggcaacgactgctgttttctatccctacagttttgccttttccagaatgttatgcaaatggagtcacacaggatgtcttttgagtctggcttctcttaagctgatccacattgttgtgtgtcaatagcagttcctttttgttgctgagttgtgttctattgtattgttgtagagtttgcttattcactcaccaaaggactttgagattgtttccatattttagtgattatgaataaaacaccagttccatttatgagcagatttttatggaaacataagttttcactttttcttgagtaaatacatagggtgtggagttgctggttcataaggtaagtttaacttgatgaaaaaaagaagaaacacctgctaggctgtttcccaaagtacctgtgccacttttttgcattccaaccagcaaaatgtgagcgctcctacctccttcagagccttcaagcactaacaccctgtattagtcttttctcatgctgctaataaagacatacccaaaactgggtaatttataaaggaaagaagtttaatggactctatgggagctacaattcaagatgaggtttgggtggagacacagccaaaccatattatgcccagtgtgattttcctccttgaagagaaacctcggaatatgactttcccttttcttcccctcaattttgtgttccaatcccttctacttagaactttaaattacttttatttagaagtccttctagcttcactattgccggagtttcttttttccttctctgcacataacacagtgtgttgtactcaggagatgctaagtgcacatctgtttctcttgggtgtagtaaactaagtaaaactgagctcaagggtaatacccacccttagtgagaccttggcgtaagtgtaccaggctcacgggtcgtctgtacgaggcagtggactcctatcccaagatctagggagagatccctatcacgtctttccaggcaaaaaggtatccttaggtgtgggatataaaactatgttgggacttttgcagtgacaaagatcctttttgccccaggcagagaagtcagatgcaaatctctatggttattaaaaggcatatagatttatcttggagatactacttaggatgtcgtgaaatcttgtgaaaacctttttacctctctcaaagctgttgtattatttttttaaagagtggaacatcagagcataatggttaggagtaggccaggtacacggtggctcacgcttgtaatcctagcactttgaaaggctgaggcaggaggatcacttgaggccaggagtttgagaccagcctgggccacatagtgaaaccctgtctttataaaaaataaaaaaattagccaggcatgatggcatgtgcctacagggctagctactgttgagacgctaaggagggaggatcccttggtaacatgcatccagaaggcatcacttaaaccttgagaaaggaggtgaaagtcatccaggatcaatcaggacccatccccttttttcccccgttatgggggttgataggcagagagtatgaagagtgaactggagcccttagtgtatgtttgtcttaccaaacatagtttgcatagcagtagggttttttgtttgtttgtttgtttgtttgtttgtttttgagatggagtctcactctgttgtccaggctggagtgcagtggcgcaatcttggctcactgcaagctccgccccctgggttcacaccattgtcctgcctcagcctcctgagtagctgggactacaggcgtccgccaccatgcctggctaatttttgtatttttagtagagatggggtttcattttgttagccaggatggtctcgatctcctgacctcgtgatccaccagcctcggcctcccaaagtgctgggattacagacgtgagccactgtgcctggccagcagtaggtttttaagtctggtattagttgtccacctagacaaaaaagagcaaggcctagcataataatttattttcatgaaaatgtgcacctatgaagtcagtagagagcaacagaaaatatttgccttcgccaggtgctgaattgcatggattgcaactgtatgggattcaggagtccagagagggatcaacatatcttgagacaccacgattgctttgactctactgcaagctcctgggaagaccatcgtttgcctccttttttttttttttttttttttttgagacaagatcttgctctgtcacccaggctggagtgcagtggtggcaatcacagctcactgcagcctcgaactcctgagctcaagtgatcctcccatctcagcctcctgagtagctggcactacaggcttacttaaaaaaattttgtagagatatacatagggtctcactatgttgctccagctggtcttgaactcctggcctcaagcaattctcccacctcaaccttctaaagtgctgggattacaggcataagcccttgcctctttcttagttctctttttattgaggtgcctacatgaatagtgtctcctggacctttctgtaaaaatacacttatatgattgtatgatttgcaaacttcttcaggtttgaggacagttggaggaaatcatggtgttctttgaggcacactgaaatgttgaaatgttgcattctgtttttctgttttacgacttagctcattatatgctttatcatcatatatacaaatgtatgcatccatatatgtatgtgtgcatgtgtgtgtgtgtgtgtatatatatatatataaaattacgaaatataaaattgactcttctctaatgggtagatggttttgttgatttgacattttatttatttactttttacaaatgttcaaataacaacagttattattattgttattcctgtggctaaaccaaccctggatggctgagaattaattagctgtaattgttatttataatcaagatcaggcatttggcatgaattaaggagacagggagaggtcgctgagcttgaatccaggcagccagaggtctcctgctatagacaatattacatcatattcacacatgcatgtatctgtcacacaccaacctgagtttttcttcaatgtttgctacttatttattcattttgtgtttgctattaagcaagtggtaggagccatcaaaaaaaacatacatttaaaaaaaattatgaatatacattttgaaaaagtgtatgagagattcttaaagttgagaattctgcccattaactcaatttttccacttgtgattttggttaataccatatccttgaatcagaacatctcccagggttttgcaggagtgtactaaaaaatgtatgaggacctgatgtgtccttttaagaacctgtgctgtcatgggatacacgggaaggtcatccaatggcagcataaagaccatcaaatggggaacgtgtcccgtaggaagatatccccaaggacagaggggtagtggagtttctggatctcaccagggaggattgtggttcttattttagctccctctccttgatgtgcccttggcgtcagttgctattttgactgtgagcatcttcttgcagttgccgatgtgctgattgccagcagcactcaccgggagaaccagcggctgctctgcccactgcctccctgtcagtctttccgcatctctttgttgagcatggggctcatgcccatgaaacactgaaaacatacagtgcaggagaagagtcccgctgataaaaaatgagtctgattttagagggaaaagtccatatggaatataggcgtctctcaaccagggcatggtggctcacgcctgtaatcccagcactttgggaggccaagcagggcagatcacttgaggtcaggagttcaagaccagcctggccaacatggtgaaaccccgtctctactaaaatacaaaaattagctgggcattgtggtgcacacctgtaattccatggacctgggaggcggaggttgcagtgagctgagattgtgccactgcactccagcctgggcaacagagggagactgtgtctcaaaagaaaaaaacaaaaaaaagaaatataagtatctgttgattgagaggtaaagtacagaaaagttgtcaccatcaaatctaatatgttcttcatagtggaaactaccgatgtttacttactgaaaaatccagtatttggaacaatattcaccattctatagatactgtcttactgtgtaaaaatattacaagtctaggatcacaaagtcttctatagttttcttgacaaataaaatgggccattggttagtgctcttaaaatggtctattcttttattattactattatttaagagacagagtcttattctgttgcccaggctggagtgcagtggtgtgatcatagctcactgcagcctcaaatccctggcctcaagcaatcctccagcctcagccttccaagtagctagggctacaggtgcatgccaccacacccagttaattttctttacttttttgtagagatggggtcttgctttgctgcccaggtgggtctcaaacttctggcctcaagtgatcctcccgccttgggctcccagagtgctgggattacaggcatgagccactgcacctggcctattatttgtccttcgtccaagtgttccgtgtgtgtgtgtgtgtgtgtgtacgcgcgcacatacatccctgctgccctgtcttctaatgccagcttcccactttaattgttgctcattgcttctaacttgcctcacacatgtgacagtccagtcacttactagtggctttcccatccatgtgtttgcttctggaattattgctgtcagaatggcaagccttgggcactaatgtggtaggcagctatctgaggggtgatggatgcctggaactactccagacacagtgatgtctgcaggtcactgtgcagttccaatcaatggggaccttctctaatggggagatggtcttgttgatttggcattttatttatttactttttacaaatgttcaaataacaataatgattattatgcttattggtattattattcctgtggctaatccaacccttgatggttgagaattagccatattgttatttataatcagcatcaggtgtttggcatgaattcaggagacagggaggtctctgaggatggatgaaggcagtcagagaagctctcctggaaactgggggcatccaggctgaatcctgaaagatttgtatgagaccggggaggaagtgcctaaggctctgtgaaaatgtctggaagaaccaggtttccttgctaaaggcatctagggaaaaaggttggagaaagaagccagaataaaagttgggtctcatggcagcatcatccctgaggtctgcagtgggggttgttggctgcttggtgaagagggataagttgctgctcaatgccccagaactagaggcacttgctactctagtagtttggtagtatgtgaataaaactcactggggccgggcatggtggctcactcctgtaacctcagccctttgggaggccaaagacggaaggatcactttaagccaggagtttaagaccagcctgagcaacataatgagactccatctcaaaaaaaaagaaagaaagtttatttgattttcagttctagaatttggaaaatgaaaataaaaactcaccagaaacatccattcactgtgagcacctccatgggcaccatctgtcaaagcacaggcttgaaacattaacctaaaaggatgcctttgtctggcatatctctcttccagatgcaattggtctagatttagtcccagagtctagtcagagtttttgcacagggggttggtaacctggtgaaagtcagtaacagtttgttttgtccggaaagaaatgccttggaaaggtcaagagagccccggagagaagagacaagccctcctggtctggctccagcttagctagcatctcctcctgctgcattaatcatgctcattctcctttctccggtgccctgttttcctctggaattcttttctgcttttattccggtttgactcgtttctcgaacttcaacctgtccctaaatttggaccttttcctgtttgtattcttgcttttttatttttcctaaatgatcctgactgcatgaaagctggttgatggtggggttttcctgtcaatatattctgaagttttactctctagtgactgaggttttccctttgtctttaagcaaaccagatttctaggactcaagtgtttcaggcacaggcttttttttttttttcttgtgagacggtgtcttgctctgtcgccaagctagagtgcagtggcgcaatctcggctcactgcaacctccgactccctggttcaagcgattctcctgcctcagccttccgaatagctgggactacaggcatgtgccaccacacctggctaatttttgtatttttagtagagacggggtttcaccatgttggccaggatggtcttgatctcttgacctcatgatcctcccatctcagcctcgcagagtgctgggattacaggcgtgaggcaccacacccggcccaggcacaggctttttaaactccttctttgtccctgagctcatgatttcactgcagattttcttctatctggactcacagttgtagagccccaaggcgattgctgtgcacactatgagtttgagagcccatgctccagaggtcaggaggggaatgagccaggggaagacgtgagcgtctgggcagagattagcactctctttaagaagagggagggatgagaatgtttctattctgccctttcttcttggcttcttgtgattctcttggcccgttccccccaccagaattttgctctgtggcctaggctggagtgcagtggtgagaccatggctcactgcagcctccacctcccaggctcaagcgatcctcccacctcagcctccctagtagctgggaggtgtgcaacaccatgcctggctaattttttatattttttgtaaacacagggtcttgctatgttgcccaggctggtctcaaattcctgggctcaattgatcctctcactttggcctcctaaagtgctggaacaataggtatgagccaccccaccctgcctttttaattttttttttgagtcaagcaaggtgttgctttgttgcccgagctggagcgcagtggtacaatcgtagctcactgtaacctgcaactcctgggcccaaacaatctttcttcctcagcctgttgggtagctgggaccataggcaggcccagctaatttttaatttttttgtagagacaaggtctcactgtattgcccagcttagtcttgaactcctggcctcaagccatcctcctgcctcagcctcccaaagtgctgggattacagacatgagccactgtgcccagcccctgttttctttttgagtagttttctttttctttcttttgtggctggttcaataagagggtctccttttcctaagcaggcaaaggattttttaaaccagtttggagccctaaggaggagtcccaggggaaaaagagaggcttacattgatctagcccagttctcaaggcatcaaagctttttagtaataaagagatttgtggaggaaagggaaaatgattttttttattgttggaacaaaaaacggtctgcttaaacccaataatttgtctgtgtttaccgcaaccatctctgtggcttacaagaatgagttcatgactgtctgaattccaccaggcagtggtgacaataatttattttttaaccttgtgggaacttcacatgggctgactcccctttgaccccgcacccatcacaagatgattttttcctagaagttgcctctggggctgggcttctggagatgaaccccattctctctatgctggataaaccaggcttctgacatccttcctgtggaatatttataaaaatgagcgccaaggaattcagctgtggtttcttgcaatgcctggtgtggtgccagctgttgcccagttcagagccctctgtgcttgagtgaattcttttctgactttttccggcggtaagaatacaaggaagtgctgagtagacaacagagaggagatgagaagatggaactcaatagcctaagacaaaagacttcccaaagccacgcttgttaaccactaaccagctgataaacgaggggctttcctctgtagtctgggattgcagggctggagccttctgtgttggggacctctcccaggctgagtcattaagaaccacacagagtgtcaaccctcgagtctaaagaatgactctgtaaccttgtgagtcatctttcatacaaattgcacctcgtcaggcaaaccacaaggggaaatgcatgtttgccttaattctactctggtacattctagcataggtggggtttcccctcactctttgaggaaaataaatgcagagattgtctctgcctggaatgcttgacatagaccaagtcatagccaaatcactcaccctgatgccttcggtgagttattccagtctcctaactctccacccagcatgtctttttctgtggaattgggtctttgttagttccatccaacttcgtgatgaatttcaacccatttcttattttctcagttgtccctttgtggcaaggctgctgttcccaagcctccatatttgttcttttgtttttaatttttttaaagacagggtcttccttgttgcccaggctgaagtacagtgatccaaacatggctcactgcagccttaacctcctggactcaagtgatcctcctgccttggcctcccatgtagctgggagcacaggagcacacctccacgctcagctaatttgttcaattttttgtatagacagggtttcactttgttgcagactggtcttgaactcctggcctcaagcagtcctcccacttcaaccttccaaagtgccaggattacaggtgggagccaccatgcctggccatccctatatttggatctgattttaaatttgaatttagaaagtactcatatttaccaaaaatgattcttgcttatagaccaaataatacaattttagtcctcccagaaaaataagagctttggagaaccattgcatagaaatgactttattcactgagtttacgatgaatgggaaaaatgcattcttttattgagcactttttataagaggtttaaaaagatactttaaccactgcctgtaatctgtagttgctgatgttgatgagtatttgaaagggaaaaagctctttggaggcagcagattaatcacagcagagtatccagtttcattcgtacgtgtggttgtcttgtattgtttgctattttctttctcagatttttcagtagagactttgtcctttttcagagagagttcaagtggatggccttgaggacttgaaaagctgagatatgatgattttgaagtcatttcacatcgaagccatgatttaaatatcggcgttaaggtaagtattgaggaaagaaatatgacacttttgtggttaacacattattggctttgcttgcactgttagaagagattaaagcacattgtgaagggtgattttgtttgaatcatgttcaacaaaccagagctcgaagaagattaaagcggcctctgtgatgcggtgtggaaccatagacatacaggagagctgagccactgtgatggttggaaatgtcttcatttttcctcgatggtcatgtgtcccagtgtgccctttatgaacttcaggaaagaacaggaaagcttacagctgtggttttctttctgagctgagccgtggctattagggagctttcggggagtgtgaattagataggacctttacataggagcagagccagccaaaggagtgagaacaggagcacccttctggaaactgtgctatttgacctgcctctctggagcaggagttctcaaagtgtgttccctggaacacagctccctacaccactaatacagtggggacctgggtcagaggatgggtctatgcctaagtgcgtttggaaagcattggattaaagttaaatgaccttcttcaaaactaatgagctttgtgaatcttgatgggtgtgagtagtgggcagtgctcaccagagttccatggaactattttcttgtgaggcatcttaagaccagtgttccatttgttcattaaatattgattgcgcaccagccatggatggtgttagatgctagggatgcagcaaaaactgaggttgacagtgctcatgtttagataataaatacattaacaattaaggaaaggtaatcattgagagacacaatagcaaatgtttaagagcctggtatctgcagctcagtggcttgggttttaatcctgggtttgacacttaataaactgcatgatcttggaaaagacatgtaacctctctttcaatttccttatgtgtaagatgcttataatagtattcactttgtagatactattattgcaaggactaaaattatgaatatgtgctggcaaataccaaactttatattaatacaagtgtcatcagaatatgtacatatattaatagtaattgttaccaaaacaccaggggttcaatctgggtcctgctgctcactgcacagaaagccaatgcctgagacaacaagtgttgccaaggaagaaggctttaattgggtgctgcagccgaggagatgggagctcagtctcaaatccatctctctgactgaccaaaactggctatatagcagggaagaaatgtaatcatgtgtgggaaaacaggaactcagaaggggcttggaagcaatcatgttgaatcagcgtccacattttattgtctggatgtgatctggtgagtttcatttctttgatactttttttgagaggcctgaaggtcatttcctgaggaaggatctcagataaaacaaatataagtttcaaatgttaagaccagaaagttcaatttctatgtttatttattcttttttttaaaaaaaaaagctatatgggactgttgggttggtttcataatggctgagtactttgaaggttctgtggttgcatgaatggagaagatagagtgatgggtggggactttaaaataggatgatccaggaatgccctgaagtagagacttgtaagaatgagaaatagcaagttatgcgggtggcatagaaaaagcttccagattgaaaagcaaaggcaaagaggatgtcttgtgcagagaaagcatttgacaaaatcgaatgcctcttcatgtttttaaaaaaaaaaaaaacactcacactcggccaggcacggtggctcacacctgtaataccagcactttgggaggccgaggcaggcagatcatgaggtcaggagatcgagatcatcctggccaacatggtgaaaccccatctctactaaaaatacaaaaattagctgggcgtggtgccacatacctgtagtcccagctactcgggaggctgaggcaggagaagcacctgaacagaagtctaaggttgcagtgagccaagatcatgccactgcactccagtgacagagcaaaactccaaaagaaacagaaaaaaaaaaaaaaaacccacacatacacactcaacagactaggaatagaagggaacttcttcaacctgaaaaagacatctatgaagaacccacagctaacatgacactgaatggtgaagggctgaaagcttttctcctaagctcagagacaagacaaggatatccattctcaccacttctgttcagtatttgtgaacagtaaattttaggtgctgtgatggttaatattaggtgtcaacttgattggactaagggaggcttagatgcctggtaaagtattttttctgggtgtgtctctgaggggcttgccagaggagattgacatttgagttggtggagtgggagaggaagacccacccttgctgtgggtgggcaccatccagtcagctgcccagcatggcaagagcgaagcagtagaagaaggtgggataagcagcttgctgggtcttctggctctgtttcctcttcctgtgctggatgcttccttctactcctcctgcccttggacatcaaattccaggttcttcggcctttagactctgggacttgcaccagtggcttgccggggggtctagggcctttggccacagactgaaggctgcactattgacttccccagttttgaggctttaggacttggactgaccactaccagcttctctcttccccagcttgcagacagcctatcatgggacttaccttgtaattgtgtgaggcagttctccctaataaattccctttcacatgtatatgtatcctgttggttctgcccctctggagaaccctaatacatttgtcaacctggctggattaaaaaacacctagatagctaataacacattatttctgcgtgtgtctgtgagggtgtttctggacgagattggtgtatgagtggtagactaagtgaggaagatccaccctccatgtgggtgatcactgtccaattgactccgggcctggatagaaaaaaagacaggggaaaggtctttgctggagctgcaacacttcttctactgcccttggacatcagagctccaggtcctctgtcctttggactctggcatgtgcaccagtggccccaggattctcagatcttgggccttagattgatagagtgatgccattggctaccctgattctgaggcctttggacttagatggagacaggctgccagtcttcctggttgtccaacttgaggacaaccggttgtgggacttctcagcccccattatcctgtgagccaattcctctaatacatttcctgcctacttctatatatctatcctattcattctgtctctctggagaaccctgactaatacagtattgtgctggaggttctagccagagcagttatacaagaaaatgaaataagaggcttccagattggaaaagaaaaggtaaaactatctttacttgcagatggcgtgatcttgtttatagaaaatttttaggaactcaccatactattaaaactaataagttcagcaagattgcaggacataagattaatatacaaaatcaattttgttatatatacttgtaatgaataatatgaaataaaatagaaacaataatttgttttctaatagcatgaaaaagataaaaaacttaggaataagtttaacaaaagaagtgtaaaacatataccttaaaactataaaacatcattgaaagaaactaaagaagacctaaataactggaaaaacattccatgtgcatggatcagaaaacaatattttaaaaatgacagtactcttcaaattgatctacagatttaatgcaatctctgtcaaaaatctcaaatgaatttttttaattgacaagtagatactaaaactaatatggaaattcaagggacccagaatagccatgacaatcctgaaacagaagcacaaaataggagactcagcttcaaaacgtattacaaaactacagtaattaagatagtgtggtactggtattctattctattctatagaatagaattgagtctagaaataaactcatacattatttgtggtcaattaattttcagtaaatcagtggaaacaatacaaaacaatgccaaaacaattcaatggggaaaaataatctcttcaacaaattgtactggggaaactgtatatccatctgccaaagaaaagctggactcctacctcatatcataaacaaaaattaactcaaaattaataagaggcttaaaggtaagccttaaaactctcagaaaaagcatagatacaaatttaatggccttggattggatttttttaagatatgataccaaaaggacaagtgacaaaataaaaatagataaatgtatcaaaattagaaaactttgtgcagcaaaggacaatatcaagaaagtgaaaagggctatgcattagtccattctcgcattgctataaagaactacctgagactgggtaattcataaagaaaataggcttaattggctgatggatcttcaggtcatataggaagcatggttgcagaggcctcaggaaacttacaatcatggcagaaggtgaatgggaagcagacacagcctgcatggctgaagcaggaggaagagagagaagggggaggtgctacacacttttaaacaaccagatctcatgagaactcaccatcacaagaacagcaagggggaagtttgcccccacgatccaatcacttcccaccaggcctgtcctccaacattgggggttataattcaacatgagattggggcaagaacacaaatccaaaccatatcaggctgggcacagggactcatgcctgtaatcctggcactttgggaggccaaagcagaggattgtttgagtccaggagtttgagaccagcttggtcaacatagcgagaacgactcagaaaaaaaaaaaaaaggaaaaggaaaaaggcgattcacagaatgggagaaaatagttgcaaattatatatgtcataaaggacagtatctagaatacataaagaactgttaagactcaataataaaaagataatttgattaaaaaagggcaaaggattggaatggatagtcctccaaagaagatatgctaataactattaagcacatgagaaggtttttactatcattagccattagggaaatgcaaattataaccacaataaaaaacacttcatacccacaaagacggataatgacagttgtttgtgaggatgtgaagaaattggaatgcccgtgtttccaaagcaactgttttggaaaacagtccagcagttcttcaaacaattaaacacagatttaccttttataacccaatatatccactcctaggcatatccccaagagaaataggatacatacctatacatatacctatacctgtagtcccagctgtacaaaaataataatatttctagcagcattattcataatacctaaagaatggaaacaacccaaatgtttgtcaactgaagaagagacaaataaaatgtggtatatccatacagtaaaacactattcagctttaaaaaggattgtagtgctgacatatgctaaaacatggatgaaccctgaaaacatgctaagtgaaagaagccagacaccaaagaacacaaactgtataattccttttatgtgaaatttctagaacaggcaaatccatagacacaaagtagattaatggttgcctacgacagggggtgtatggtggcaaattacgagtgactgctatgggtctgtggtttcttccgggaatgatgaaagtgactagaattgagtttctaatggtcgtacaattccgtgaatatattaaaaaccattgaatgatacattttacattagtgaattgtatggtatgtgaattttatatcagtaagcctggtgtgtgtgtgtgtgtgtgtttgtgtgtgtgtcttacatatattggacggttaactgtcagcacttcatgatagatgagacttagggagtgaggacaagtgaggaattaagaatgacctctaaattttggtcttgagcaatttctcagaaggagatgaaagactgagattaggagggtttctttttgctttgttttgtttttgttttatggagagggccagctttgagaatcaagagttctattgtggacatattaagtttgaggtgtctattaaatatccaaacaaatcttaggcagacagttgaacgtgtgtctagaactccgaggagtaatctagactggagataacatttagatgataggtgaatctgcaggaaaggatgaaaacagagagagagagagagagagagagagagagaatgcatgtggcacaggatgaggtagaataggagaggggagttacaaagcaaactgagaaggaatggccagccagggaggaaggagaagtaagagagtgagcacaaggtcactgaactcaggcacaaagtaagtcctaccgagaggtagtcataggaggacagaaggatctattggaattgccaagatggatgttgcccatgaccatgataagagaagttcagattggaaactccagatccgaatggtttgaagagggaatgtgaagtgctacagtggagacaatttggcacctgttttcagaagtgttgctgtcaccagattctgatgaaaaattgctcttggatctttacctgctctgctgaaatgcccaaaaaggtgctggttgggtttggaggtcgtgtcttcctgggagccagcccttctgggtatgaatgttgcatctgtgtagggagttgctaacttgtaggcagggttggggcgcgagggtggtgtgaggctggggttcggagaagagtgccattctttgccttgttctctgatggttttgattttgtttagttattttgattgggagaaaatgtaaagaaggggtttactaatgtgctttttcaaagtctaggtcaaattgataaaaagaaatctctgtttgaaatcagaataaagagaaaagacattccatgctcttgttttggagacagggtctcctgttgctgcccagactagagtgaagtagcacaaactactggcctcaagtgatcatcatgcctcagcctcccatgtggctgggattacaggcgtgtgccaccatggccaacttatgatttttatttttgtagagacaaagtcttgctatgttgcccagttgttctccaactcctgacctcaatgatcctcccagcttgggcctcccaatgtgttgacattactggtatgagcctgtgcacaaacttcattccaggcttttttttgtagtgaaagtctttatgaaacacagtcctaactgttcatatataatttattatatatgcatttattaatacatcacttggttgtattaaatacaaccatatttatggtaataaatgtggtaataaatacatattatatatgcatttattaatacatcagccttgcatttattaatacatcagttggttggggtttggaccctgagactgtagcagttcctggagtgaactgaaaggcaaagtggtaactttctcaaaatgcacacacacagatgcttttcagaaacctcaaaagtgcattgcccacggctcttaccatttgcatcagtacattctttccccacgcttctttactaatttagattatgtgaaaacaactttttaagacagatgttccttcaagtaacaacccactctttctcttctcttgagaaaatattagttggaaatggactgttacttaggctagaaagtccatttgaaatgttttgagcaaacatcattgtctaagtccacttcgtgctgccataacagaataccacagactgggtagtttagaaacaataaaagtttatttggctcatggttctgatggctgagaagtccatgatccaggggctgcatctggtgagggccttcatgctgtgtcatcccctggcagaaggcatcacatggtgagagcaagcaacagagaaatgtacgcacttttatagcaaatccactctcgtgataaagaacccacttctgtgataatgatattaatccattcacaaggacagagcactcatgacttaatcacctctcaagggtcctacctctcaacagtgtagcatttgggattaagttcccagcacatgaactctgggggacgcattcaaaccatagcaatcatattttgagcacatgactagggactgctcatcttggatgaatccaagctgtgtttgtttttcttttaccagatgtgtgtgtgtgtgtgtacgcccatgcacttgcatattttggtaagtcaattgtttgaagttatatttgagcttcaatttttttgaagctaaaatttttttcttatatggaatacagatggcctaccataacacaatatttttaaaatgtagtgttttctagctggcttggcatgaaattagagaatgcccttatttctctaaccttaggtaaagtcttcttgtagcaattttcttatgtgtgtggtttaaaaaacaaaactttgtggttgtaattgcttggttgtgttttattgtatatgaaagaggcatgccgtgggggttcagaagaaagaattgttcagtattactttcataaaacattgaaagaagcatcttcatttgttctagagtgcagattcacaggatttttaaatttattattctgagaagatgatattagtagtgtgtcctatgtgattagaaggtagaatatcacccatgaaaaaatttctggcttaaaagaaaccctgcttttatttatttatttagacagggcctcgctctgtcacccagcctggagtgcagtggtgtaatcacagctcactgcagccttgacctcttgggcttaaaggatcctcctacctcagccacccaagtagctgggaccatgggtgtgagtcacaatgcctggctaatttttaatgtgttttttgttttttgttttttttgtgtgtagacgggtgccttagtgtgttgtccaggctggtctcaaactcctgggctgaagcaatcctccccacttggcctcctaaagtgcttggaatataggcatgagcctctatgcccagcccaagaaacaaaccctgcttttagaatctttttttttttttcccagctgtcctgtgtcctaggtttataactttgactaacttctagcaacttccaatcatgggagaattagagtggttatctgggatgaattgtttgaacttcaacctgttatcttggctgcagggctttcttggccacagggccgtgctaaagggcactttgatttcttgattttaaaagagcaagagaaagtgattgccaagaggagaggtttggttggcttttcttagaactaactgcctctccagagaagcctgcattggctgctcatcatgatgagggtcgggcaaggtcagtttccactgtcttctaattgttttcagagaattggacggtacaaagcaggtgccactgacaacatttcccatcattttatggaagagtactgattccgtcttttctgctcagagtggatctgtgcaaataacttttgtttctcaaaaatttctggtttgtcttgggatgcagccaggcctctaatgtggtggtgtgtgctgtgtcacaaacctcggccccaaaagcctgagcttggctttgtcagatctgatgagtgtgcatgagcaggaagccacccttcgggagaattcaggggcaaacgtacaagtaacgtttgtgaacctgtgcagacaaaggctttgggtagatgcctgtgagatgtggggatccaggtgacatgaagggagaagaacagaagacaggtaagggacttgtgggttttcttaactccatgtggctgcattgagaaaactagttaacatttcatgggctggtgggagcgtcatcttatcattctctcttttttttttttttctggtaatgattttttttgttttttttttttttgatattgacaaaagtttaatcatttcaattaaaaatgccactaatttgactttttaagtaaaaaatgtagggggttttaaaactactttcctactaccaaaaaatcagaaagtatctagctttctaaattgggaaagcaagcaatgttataaaaacactgaaggaatctctttcttcgtgaccttttgttaaactcggtttaagctgtagaccttatttaaaataaaatttaccacagaacaggaaatagaagctgtggaagactcgaaatacacctttgtacttctctgttcttcacctgctctctcactgtctctacacacacacacacacaaacacacacacacctatatttgcattaaaaatgggtagtaaaagcagtgaagggcaaacagaaggtacaatacaatcaagtaagaggttgaatataaactggaacaagtcttaattttttatttcactttcattcggatacgtttactaattttctttgctagctttaagacttttaaaacattctttggccctgggagggagttgtataaccataaaacttgagaatcctggccctagaataaatgttccttttaaaaccccaaggacagaaaattgaatacagctgtgcaaaaaagaaaaaaaagaaaaagaaagcaagaaaagaaaaaaaagccaagtgatggtttaggcttgcaggcaccctgaccaactttcccagtgcacttgggctgtggtttcctggagatgggagatcgggagctttggtgtacttcttgaaggtttcagaaaaaggccaagacttcttcagaactgtatgttcctgggatatggttaagagcgcattctttttggcatggttatctatcatcttgcttgtcctaagcatgtcctcttgttttcccctgcagaggattggggtttctaggtcattctctgtgatgccgtgattctgcaaaccttatagttcctacctaaaagtaagcttcagagtttaagcagtttccaccagtcagaaggtggaacggatgagtttttaagacgcaatcttgctcttctccctcagtcactgaatttgcctcagtatggccagttttcagacatggtcctgagaatacggcattgctactccctgcttctcctctccctggatggagaccaggatgttgcttctctgatgtttgcctcgtgggttcccatgttaggtttgtgacccacggggagctgtcactggggaccctactgcagcctggcattaatcactttgctctttgtcaggcagtgtcatgatgattcatacttcttcctctacaagattagattactgtaattttcatatcctggactgcccacgagggatttgaattaatacttgttggtatagaaagcaggatcatgtttctggggagaaaggactgaacttgcccacttggccatcatcagaaaacattaggcagggcctggctgaaaaataatcctgccttcagggcttaccacatcaattagcttaccatacgggccagtaagccgtgtctttgtgaacacatggtccctgggcagcggatttgtgaaagtgatgccaagcccaggagatcagaatgcacggaagattttgcaagggagtcctatattgaaatcagacactgcttaatgaggaaaatctttcccaaagaggtatttgagaaggaggtaaaccaattcaggcatgtggaacagcctgcacaaagccagcagaaattacgatcacagattgcagggcaggggggtgtctgtgagggataaagttgcctttggaaaagaactcattgccttgtcattttccctggagcatacgcattatttgccttattcgttcaagaaatatttatcgagcacttaatatatcctaggcactgaagatgaacagcagttcacaaaccagacaaaagtctctgtcctcacacaagtcacattttagggggcccatgtcactaggggtacaagcgtaagctgaagggagctgtagcaaggagttaggagtacctggaagaactcctgaataactatagttgtttgaaaacgtatttgcttatttattttctctcttccctttgatgcaacttgcacccactatcccactaacgagattaccagccatctttcgataaatccttgggagggaattacttgtacttgctaatgaataatccactttagtagtccaacagataataacttcagggtcttcaaagggttatctgatctgctttggcctgagtctctatgggagggaagttgaggcatgatcaaaggattttatctttgcttgctctcctactgtctaataattttttatttcagaatgctttgctttaacatattttatctcgcttggagcgctttattccttccttatttatttattttttgagacggagtttcactctatcgcccaggctggagttcagtggcacaatcccggctcactgcaaactccacctcccgggttcaagcaaccctcctgcctcagcctcccgagtagtttggactacaagagcccgccaccacacctgactaatttttgtatttttagtagagacatggtttcaccatgttggccaggctggtcttgaactcctgacctcaagtgatcctctcgcctcggcctcccaaaatgctggacttacaggcatgacccaccacacctggccccttccttctttttttccccctcattgttgaggcttttctttggagaaggtgagatggtgctatgcctcagaattgtagaatttcaagtttttagaatttgatggcactgtaggaatcttaatccagaccagcgattttcagtccccagactaaaaccaagcccttacctgagggcagtgcgatgagaaacctaagaaaatgaagtgaatgttgtattaaatataaagctaaatttattcagttgatttctgcatcattctgttattttcttttcttgaatttttcaggtttttttttttagtgtcctccacctaccccagaaatcagtcttcctgatctcagcctcccacctcccaccattctgtccccacaggctgactcctgtcagaccccatcctcccacgccccagttttcagatgggaccctcctcctcagtcttgtagcccctgccctcaatacagaagtcactggctaaaccttagggtaggaagttcccactcgtgctgtcaaggagacatggcccaggatccacagttggagccaaagatacattgtaagatacaacacatagtgtttctggtttctttctttccctctttctttctttctttctttcaggtggaatcttgctctgccgcccaggctggagtgcagtggcatgatctcggctcactgcaagctccgcctcctgggttcaagtggttccgttttatagaattattgggactgtggttccactctattacaagcttatcgggcttctgtgggttggccgagtgcatagccattacgtagagctctgtttctggaggaagatgagaatggaaccttcactgggctacagagtgcttggcccaggggatgtggggtttctcggtccttggggctgggagaacatgctcagagaaggctcctcgctcctgtgtgtctctaaggtatagatgatgctccctgaggagcacagtctcctggagtttttctttcaggaataagaatgatccattccctcttggtatttggaatcagccaaacaaaccacatgtggtgctgagctttgtgatgtcaacaacagcagggaagggaagagcctcccaggtcctcactccactggtcacatcaccgtcagctcatgtccccatttgagcagcagcctccatggttctgttcgtgcagtgagctgctgcttgacagcagacagaaatcccatatttttagatatctagtggcccaaacggagcatgtcacactttgtacatctctgattactctcaagactctgagcctggtgtccaggaacgcgatgttgctccagccgtgtgagaggctgggtctctggagccaggactcataaaccacggtccaggctcacccctggcaagttcacatctcattttgaccacgaggccagcagttctctttgtgttgagctctgctacacacccattgctctgaagctacagcccgggagagaaaagttggctggctcatcagtggttcaagccagtgacttacagatgaccttggagctcaaagattttcagctaaagccagtaaagttctccaaaagctttgagaaaaagcgagaccagacagacagaaagacagactcaattgattgaattattgattgattcagatttccggcaggggtggggggttgttggttgaaaaatattaactgaaaataatatcccctttttgtctttaaaaagaaatttatgcacaaacaaaatgacttgcccatggtacagaaggccacaagctcgattcatacaggtgtatcggtgtacatatcagtagactacagcatgtctctgtcttctcccatagaggtcaaaatcctaagctttttgggaaaaggaaatgattccaagtctggttccatcgtggcagaaaatagggcaaaatacaggtcctggttgcctagccttttcatctcctggaaatgagctgcttaaaaaatacctccagtgattgatcaagttcattgccctgtggaaagcagaacttttcagaaggcagaagcaaggagacagagagtgttgttgtcttactttcctgcactgacagtcctggccaatgctctgacatcatcttgagtccagaaataggagtgagaaatggacagtgaggccactacacagaaacatttgagctggtgatgcatgttttcttttctgcctgtgagctgaggatccaacttgtgactgtttctccagctctggagggatattgcaaattgattaatccaccctgacaaaagggagaatgttgtagctgcattaaaatgagaagagagcggccgggtgcagtggctcacgcctgtaatcccagcattttgagaggctgaggtgggcggatcatttgaggtcaggagttcaagaccagcctggccaacatggtgaaacccagtctctactaaaaatacgaaaacattattcaggcatggtggtatgtgcctgaggtcccagctacttgggaggctgaggcaggagaatggcttgaacccagcaggtggaggctgcagtgagctgagatcatgtcattgcactccagcctgggcgacagagtgagactctgtctccaaaaaaaagagagagagaagagatctaactgcagactattttgatattttcagtccacatcacaaacatttattaaatttactgagtggcacatgttgctaggtcctggtaatatgaaaatgtcatggagtctctgctaacagcctagagattgggaatcagagaccatgtctaggagagatttgtaggggaaatattctcaactaaggcttgaagtatgattaggggtcggtctttctttctttctttctttctttctttctttctttctttctttctttctcactctctctctttctttctgtttttgaggcagagtctcactctgttgtctaggctggagtgcagtggcacaatctcagctcactgcaacctctgcctcccaggttcaagcgcttctcagcctcgggagtagctgggattacaggctcgagccaccatacctgactaatttttgtatttttagtagagacagagtttcactgtgttggccaggctggtcttgaactcctgacctcaggtgagccatctgcctcagcctcccaaagtcctgggattataggcatgagccaccgcacctggccagattaggggttttctaagtgagaagggtggaaaggcattctgagcagagagaacaaactagacaggaataggaaggatggccagggtggctggtgtctcatggttgggcacaggtcacctgctggtgggagggaggataggaggttccagctcagagaagtgggactttggaatgtacccaacaggctggacatccttgagttttttgttttcttttgttttctgttttccaccaacacaagtaatcgcatccctcctgggtttatctaaatgtggtgctggtaatgaagctaaggcatcacagtccttgtaagcctcacagcttgtaggaatacacctgcacaagtaagtcactgcaggtcttagtctgtatgagataacctaagggttaagtgtcatttccaaactatttatttgtaactggataccttttttctcctactgatgagtatctaaatgcaagagagtgacaatgattctaagtatagtcttacatttgtcctttaacaaatttatttttattttttattttttatttatttattttgagatggagtttcgttcttgtcacccaggcaggagtgcagtggcgcgatctcggctcattgaaacctctgcttcctgggttcaagcgattctcttgcctcggcctctgcagtagctgggattacaggctcgcaccaccatgccgctaatttttgtattttcagtagagatgggtttcaccatgttggccaggctggtcacaaactcctgacctcaggtgatcctcccacctccgccttccaaagtgctgggattacaggcgagacctaccacgcccagcctattgttttaaactttattttttattatattcattttactatttttttaaagagatggggtctcactatgttgcccaggctggtctcaaactccttgcttcggtccttccacctcgacctcccaaagtgctaggattacaggcatgagccactgcacccagccccctttaacaaatttaattttataagtttgccatatgggccaggatctgggacgatttgctagattaaaaaataaaaacataaaatataaaaaagacaaaaagtttgccatgtgggcttccatgggtaagaagcaagcgctatccacctgtctgttggaggcagcacctgccaggcctatgcttgagaactgctgggggactctccaggagggtttttattgggagtgagcaggcagggtggggccgtttaaaggccattctggaagtggcggagaggatgggtttagagaggtggaagtgaagtttggaggctccaggcataagcctgactcaggcccatgagaacatcaatggggtggaaggagagaggaaggttaaaggcaggaaccgaggcttagtgactgctgagatctgaatgatcactcaagtgaggcagggccctgatttctggtttgggtggccaagttgccgatggggaggttgcggtcaggtaggaaaccaggtacaagtttcctgatgggagatgggagatgacgggtgtagcttgatttctcttgagttccatgttcccgtgagatgctcctggtttgctgaacttcagggaatcaatcaccagtcttctgacttctgctttaggtgtggcagacggagctcactctgggagaaggtaggatgataccagcaggctcggagtcctgggaaacatatggacatttgagggaggcagaggtggacactcagtgaaacaactgaggagtgatcagaaaggcatgggagagctgaggaaaggagtgttggagacattttacgaagaggacattccatggaggcggaagtggtcagaaagtgccagataccatacaggccacatctagatgaagcctcaggagagtgtgttgttgggagagcagtttctgggttgtaggggagccagaatccaatgacaaaacttgctgggaagcacatggggctgggggagaggagacagtggttctggaacattcagggtgataaaaagaagagaaggtaggcaagagcttgaagacagaggtggggcccaagggactttgggggcagaagatgagtcgctggagcatattctgggcttgtgctgcctcgtcaacgaactgaaaagaagcctcatctcttctgtgcatgacctggcattccccaaagcgccagaaaagtccagcataagttagactggcctccaaagtgggaattcagggagtttggatctaggttttatgttatggaaactgagaagataaagggccctgaaacctccatctgcccattccacttctgggaaggctgaactgttatatcatctatttattttcaagaataaagagttcagctgggtgtggtggctcacgcctgtaatctcagcactttgggaggccaaggcgggcagatcacgcgaggttagaagttcgagaccagcttggccaacatggtgaaaccctgtctactaaaaatacaaaaattagccagatgtggtggcatctgcctgtgatcccagctacttgggaggctgaggtaggagaatcgcttgaacttgggaggtgaaggttgcagtgagccgagatcgtgcattacactccagcctaggcagcaagagtgaaactccatctcaaaaaaaaaaaaaaaaagggccaggcgcagtggctcatgcctgtaatctcatcactttgggaggctgaggtgagcagatcacgaaatcgagagatcgagaccatcctggccaacatggtgaaaccccgtcgtactaaaaatacaaaacttagctgagtgtgctagcgcacacctgtagtcccagctactccggaggctgaggcaggagaatcacttgaactcgggaggaggaaattgcagtgagccaagatcgcgccactgcactccagcctggtgacagagtgagattctgtctcaagaaaaagaaaaacaaaaaagaaaggggaagagttctagagaacagatttcaaaaacttgttttctattatatttatagcagtattcacattggaagaccagtgcagtgacacactttcgttatcccagctactcaggtggctgaggcaggaggatcacataagcccaagagttcaagaccagcctgagccaaatagtgagaacctgtctctaaaaatgaaatataatcaaaaattgagatgacccgatctcctccctttccaaaaagttgttttcttgctatttctccagagttggtcaggttttaaaaattaataatctggggcagtagatgaaatttctgaaaattatgtgcaggtttccttttttatttttggatgggccctaggtattagaggtgctctttttaagtatctacacagcctgctaaataaacacattcaattggaaagcaatgctttccatttcttattctgtatcaaatattttactttcggattaactttcattcttatagggaaaaataaatatttccagtttgaaattcgtaagatggcattgataataagtaaatctctatagatttatgtgaagtacagttacagtaagtcacccatttacaaatggattatatttgaaagtttcatttgaagtaggtttgttttttggggttgggatgctttttccttggaaaaaatacttaattaaactttttttttttttgagacagagtttcacccttgtcacccaggctggagtgcaatggcatgatctcagctcactgcaacctccgcctcccgggttcaagcaattctcctgcctcagcctcccgagaagctgggattacaggcacatgccagccaccatgcctggctaatttttgtatttttagtagagacagggtttcaccacgttggctaggatgttctcaatctcctgacctcaggtaatccatccgccacagcctcccaaagttctgggattacaggtgtgagccaccccgccctgcttaaacttttaattttgagataattatagattcagatgtagttgtaagaaatagtacaaagtgatcatgagggctttttacccagtttctccagtgataacatcttgcaaagctatacaatagtatcacaaccaggatattgacactgatgtggtcaatccaatagaagagttccagaacaggggtctctcatgtggccctgttaaaccacctcatccccatccctaacctctaacaactcccatctcttctccatttctataatgttgtcatctgggaaatgctatgtaagtgtactcgtatagtatctaacattttgggattggctttctgtcactcagcataatttaattccctggattcttatccaggtcgtggaacgtactaataatttgttcctttttattgttgagtagtattccatggtatggatgtaccacaatgaggattgggtagaagctcattgcttttgcctaggggtgtctaattgctctagcactgtttgttgaatggcacagaaatcagtttggcatattcatgtgggcctgtctctgggttctccagtctgttccactgatctatgttatgtgtctctctttttgccaatgctgtgttgtcttgattactgtagttatccagtaggccttaatatgggatagattcattgctctaacttttttcttcttttgagacggagtctcactctgtggcccaggctggagtgcagtggcatgatcttggctcactgcaacctctgcctcccaggattgggttcaagcgatgctcctgccttagcctccctagtaactgggattacaggtgtgcaccaccacgcctggctaatttttctgtatttttgatagagacagtgtttcaccatgttcattaggctggtctcgaactcctgacctcaggtgatccacccgcctcggcctaccaaagtgctgggattacaggcatgagccaccacgcccagactaacttttttcttctttttcaagatggtttttagctattctagggcctgtacctttactataaattttagaatatctgccaaaaatcactgtgaggccaggcagggtggctcacacctgtaatcctagcacttaagaaggccgaagtgggaggacagctggagcccaggagttcaagacaagcctggccaacctaatgagactccatctctacaaaaactaagaaattaaaaaattagcccagtgtggtggtgcacatctgtagccccagatattcaggaggctgaggcaggaggactgcctcctggggaggttgaggctgcagtgagccatgattgcacacctctactccagcctggacaacagagcaagaccatgtctcaaaaaaacaaaacaaaacaaaacaaaacaaaaaaaccttgcaagattttgataggaattttgttaatctgtagatcagtttggggacaattgacatcttttgtgtgttgatttttcttccaattcatgattatcatcattggaaagaagtgagtatgatgagtcttctaagccaggcagatagcaaaaaaattaggaaagtaaatggattgcacaggaagaattaactgggatttaaataatcaaagacagaaaggatatataaaagaagtgacgaaggagatttaccctattagactccagtgtattaatctaggacagtttggttgctatggggaagcagtgtgcaaaaacttaagaggcacacaaaagactgatgtttattttgtgggagtgaatctttttttaggaaggaaatagcactattgtggtaacagtgattcattttctcctcctatcttctctttacagagaagacccaaatagtgaactgtttcatgtaagtttttatttatttttgccctacttttctctagggaggggcttaccacagcttataaaaatacgtaaaacaagatcaaataaactttaaaatgaggaaaaagccaatatggtccaagggaaaagaagatcagggtcaggactgagattaggatgcaaaagccatgctatgaaattttgtttgtttgttatcttgagatgggtaaaaaaaaaaaaaaacagttgactgggacaaatacccctagcacaaaacagtcatgaagccaatgtttaattattatacctgtcatcttttcacctggcctcaggactgtcctcttagggagaggcattgttctgtagggttaattagtaacaggaatttagatcctgctttgagaggcctcctgtgctggccgaagcagctggtggtctgagaaccctgacacccagaggcataccactgggaggccccgcgcagcacacagcttttgctgtactccagcccaagtcttatggggtttgtggtttatactgaagttggtgcagacaattaagactctctgttcttggtaccgacagggacagagacctacaattgtaagtattttgtaaacagggttgtgatatttgtttgagtgtattcaacatgtcagtggccttttaatgtttaaaaaaatgcatatggccatttaagaagtggttgtgcttcatagttaatatttttttcattaggttaggttcatctggtttttcagtgaggtgagctacctgagagccataggaagatagatcttgccagttcagaggactgactttggctttaagagaaaatatttgtgtcattttcgagaaagtacttccagcacaatgctttcttctgatgattcattttctacagttattggaagtgggaagaaatccacagaggttacagaatttgtaaacttgtagagacatgtgccattatatcatgctgtttcatagatgtgtatgtctgttagttacttttcgggcattcattgtatatatgtctgttacttacttttggggtgttcagtgtctgagctttgtcaacgattgtgtgctctttttttagcctaaaaaaactaagttagagaaatgtttgctcatccaaatctgtattgttgtagcttattcagtagactgctgttgtatttttaatttctctatacaacaagctgaaagacagtgtggacaacctaattgcatttgaagtagctgctggccaggcctgctgcaacagctgatgggctcctctgaatttccagggctatttctggtagatgagctggtatcaaggctctcgagttcaggccataaaaggcccgtcccatgtgaagttgcttcactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaagtaagtgaaaaatcttcctataaatctaaatgcagtaggtttttttttgttgtttttgtttttgcttttttttaagtgccatctgtctgagcatgtttcctgaggatttgttgacttcagtcattggaaaattcctgccagcgtttgccagttactgcagccattcctgtagatacccttgggcatatttcttgggttgagaaggattggacttttttttttttttaaaggatttactttatggtagagaaaggtttaatactaaaaatttgattaatataacttagtacattctgtctaaatgttagcacttaaagtcttggaattaaagtatattcacaatgcaacgtactttaataatcgtagcacaagtatgggggtggagttcagaagggcaagttttatttcactgccattataattcatgtaaaaatagaaaatcaccagtgatccttttgcataatctttgttctgagggttctttgccttggtactctcattcttcagggcttgatttctagaacttgcgatgttccagaatttatgagaaaaacctcactgtaggttctagagtttgaactgcattttatttttaaattctccaagaaaaaatactgcatcagccttttaaagccctggagattgctatggtctctttgtaatttagctcagtgatttgtttctgctgaaaaacagcagtgaactctagaacatagaaggcttatttgacgtgttgcttctttgaaaaaaaaaaaagattatttctttataccacatcagatggacaagtacgggcagtcattatttttaccaggtaggaaaacagagtatttatagagaagaacttcatcggtgaatactgcgagggttcttcaccggagatagtgtggcaaccctagggggcgtttgaaaatgcatgggggtgtttcaggttttctcaatgactcactggcatttgggaggatgtggttaagaattgtaaatgcccaatttacatggtgtaggggacagtcccatacagcattaccctggccaaactgctggtggtatcccctgttgagtaaaactgcaggatataaattgtaccctctgtctccaaagaagagcagcccagtgccaggcagatgtgtgctgtctcttctcaccaaaaccagtgatgtcttttttttttttttttttttttgagatggagtctcgtgctgtcacccaggctggagtgcagtggcacgatctcggctcactgcaacctccacctcccaggttcaagtgactctccttgcctcaacctcccaagtaactgggattacaggcacctggcaccatatccagctaatttttttttgtatttttagtagagacggggtttcactatgttggccaggctgatcttgaactcctgacctcgtgatccgcccaccttgggctcccaaagtgctgggattataggcgtgagcccctgcacccggcacccggtgatgtcttgaggatccagggcatcaagtgtgcactagtgtcagagaatttgtcttacaatggaaactttggagtctatactctgtgtgtgtgtgtgtgtgtgtgttaaagataatttatttggtcaccttgatcactggatgaggctgatgttatacaagctattgtagtacattaggtgccttcctgcctacctttatttagtactattggtgcatttaattttgccacatgcatagtcttccaagtgaaatttggttaatgcgctcagcttgcagtggacatcagtcagccattcaacaaacagttctttatctttgcttctactttggagacagactgttttgtgataaacagacttctggaagactttggagttcaattcagagtgaacatctttggcaacacctggggttatatagtattctttttttcttttttcttttttttttttttgagatggagtcttgctctgttgcccaggctggagtgcaatgacacaatctcagctcactgcaacctccacctcttgggctgaagtgattctcctgcctcagcctccctactagctgggattacaggcatatgccactgcgcccagctaatttttgtatttttagtagagacagggtttcatcatgttgcccaggttggtcttgaactcctgacctcaggtgatctaccagcgctcggcctcccaaagttctgggattacaggcatgagccaccacacccggcgagttatttaatattctacagttgaggaattgcatccaaaggaaagggcccttgggatttttataaggatgtctggtgagctccagcatgcagggctctcgggctacatggagcgttatggagagtaagctgctaggagccttgtgattgttagggtacaaaggcagccttggaatcatctcctgaatctgcagctgcctgggattttaggacactcattgcaattttatgttaaagcgctgatctcagggtgccttgctgtgactgggagtatccgtaggtctagaactttccagcagttctgggcttcattgatttgtgactcaactaggaatcttctggtcacccttgactcctctccctttaggtccccgaggcctctgccccaccacctcctcttaagcctcgccatcttttttattttttatttttttgagatggagtctcactctgtcagccaagctggagtgcaatggcacaatctcggctcactgcaatccctgcctcccgggttcaagggattctcctgccacagcctcctgagtagctgggattacaggtgtccgccaccacgcccggctaattcttgtatatttagtaaagatggggtttcaccatgttggtcaggctggtctcgaaatcctgacctcatgatctgcccacctcggcctcccaaagtgctgggattacaggtgtccgccaccacgcccggctaattcttgtatatttagtaaagatggggtttcaccatgttggtcaggctggtctcgaaatcctgacctcatgatctgcccacctcggcctcccaaagtgctgggattacaggcatgagccaccgcgcctggcctcgcctcgccatctcttacctgggctactgctttgcccttaatggatcccttggccctcggtttctcctccgtctggtctagccacagaatgaccttcctaaacaaagatctcatcttgcactcggccagggccaaaccctcatcgttcctcactgcttacatgcaaaagcctgggctctgtagcctccccttcagggtctttcatgcccctggagttctgttggcaagtctccccaaaatgttgtcttctcttgcctgccagggaagcaatatcaaaggagatgtgccagaagcttcctctgacatgcctctggcctcctgggcctcgactccagcctgtactctagggctgcagtcactaggtcctggtggccctttccttggcagcagggtacccagtgaggtgcttgggtctcacttctcttaccacccccagggtctagcccagtgggcaatccagaaatgtgagttgtttgaacggattgaattgtaacgacttgtgggttcttcatatcgaaatttggctgtgatccatccagtacttttgccctcatcctatattactcacagtagaagctggtgttctgtgttataagttctccttttttttccttcatctatgacaatgcaagcagaaacgttcgtgttgcggtaacaagtccgatggggtttctgtatatggggtttctgtacacgtgcttttgccaaccgggaaattaaggtgtgccgcatgaagtcagtcacttcattattggaactttgcctaaaatgaagaaactcatctagtggtgcaatttgacctaagtgttttacccatacagtcaacttcaacttgggtcacacatctcaggagcagtttgcactgttgatctcaggggctctttagtattggttcagagagatctctgtccctcttagagacactccctattgtaggaggttttgaaagaggcattctttttcctcctaatgtgcttgtccccttctgaaagttgatcctttaatcccaaacaagtttataacctatgtctaactggtttttgtgtaaatatagtaaaagaaatagtttccatatttgctttgggatcattggtctgcccatgtcacagccctgggtacattcatttcagtccatatttttggggcactttccctgtgcagagctccgggtgggtcctgtgggatgcagaagcctatagcgtattccctctcattggcagcctctttcccagagtgtctcggacagggatgtaatggagctattttaccagtcagagtagaagggatgaacaataataacatgccatccattattactgtgtgccagacttaatgccacactctttacctctacaatatatcacttaattatttttattttttgagacagtcttgcctggtcacccaggttggaatgcaatggcatgaccatggttcactgcagcctcgaactcctgggctcaagcattcctccttcctcagcctcccgagtagctgggactataggcaatcactactatgcccagctaattaaaaaaaaaaattctagaggcaggggtctcactatgttgctcaggctggtcttgagctcctggcctcaagctatcctcccattaaggcctctcaaggcactgggattacaggtgtgagccaccacgcccggactctaatttttacagtagcccccaagaaatattagtgcaattgtcttcattctactgaggaaaaaactgagggttagaaatgcttgcccaagcttgggcacataccatgtgcccaaatccagctggatttgaacccagatctagttgacttcagtgcctgtattcataaccgctgctttagccagtgcagcccaaactttaataggaatcacctgcagtcttgttactgcagcgtctgattcagtaggtctgcactggacttagagattcaacaaacaggatccaggtgatgctaattcctgtctgaggacctgctttgagccgccttaggttaattctttgccacgtgcctgagatggaagcaaccagctggggtgcgggactcgaagggggcttccgaggaggagaaggagtctttcaaggctcctctgttcctctaggcttttcatgccaccccttcccgctctctacctacaccattctctcccgtttgtcttattttccactctgctcttctcctggcttctccttgtgttgaaaacatcctcaggtttcatccattctaaataaagctccccttgacctcaagcgatcacttctttctttcctgcccactcactcctcagcactgatcaggagctcttctgtcttctcctcttggacacctttcaagacctcctggttactttgatgtccccgcagcctccctgggatggaacccctctccgtgagaatcccatctcaggtctagtgagggtgatggggctctgacctccatactcagcatccacaccctgctgtgatcttgaggtctcctggcggccttattttaaaaatcattttctgtctctttgcttgctcagctttccttcttaaggtccatttaagattttttaaaaaatcctggtgttcctctttataaggtgaattgttcaacatgtccatttcaggtggaatgcattcatttggcttttagaactgattttctgtttgtaagtagaaattaactcccaattagctgtgtgagaatttgtatcctctgtatctgctatcaatagaaaagaacaattcggttctgggcgaagacccaaagggctttttattaataatgcacctacgatttgtgaactgtgtttaggttcatcagaggcctctcgtttctttctggactttcaattacgttctgagcatggaaagttggcaaataacttaggcttggatggatagatacagtcattgaatagaaaaaccatattgatatttttaggtttttaagatctcacatactttaaatatttcaaaattttaagtaaatactctttcatacattctgaaacattatatctaatttatctcagccaaaaatttaagacatatacatgttgcagttgcacacctgttactccaaaacaaacaaaccgctccagccaaaacccaaatgggaaagcacttgattttcagtagcttaaaatatgttgaattaagaggtaggttatgaaagtgaaaatgacatctgaatgttttagtggttttggatataaattttcttaggaattttttgtttgagttaagctgatagtttagtttactgtgtgctatgttggttgcaaaattcagctacatttgtttattttgcaattaattcaatttgtttgcaaatattgcatcagacatctaaaccagctaataactctataggtttgagccaggttagaaaaaaaggcttggctgtaccgttaagaagcagctagctctctaaattgtgctgatagtcttaatttcccccggatgttcattttagccacacacacataaccatttggatttatgatttcatacattttttattggaagtgctgaatattttaaaattctgtgattagataaaattggtcattgtgcttcagaatagggtgactcagcttcatgggatgtactttacccaacacaggattctcccatttgagatggaatttattaatttggatttgtatcaggtcttcactccagaggcatcagagagctttcaggcagccaactattcttaaatatttcaaaaggaagttgcagtgggcacgtggcgtggagaacacagcagagcaaagtgatgtaggggccataacagccaacatgctttgtttccttcattcattcacctacctccccaaaagtccaaagaagtgttttccctgctctcggtgcaggaggaagattttatctggaaattgaaggtgtcaatggccagagaaagaaggaggaacattgattttcatgaataaccagctgtgtgaccttgggtaaattcttaacctctctgagcctcagtggcctcattcattcaaacaagggttggactagaggatttttaagaccccttttacgtattgggattctgtaatccaaaggtttcagagatcgagaataatctgtcttccttggaaaggcaacaccttgtatctggaaggtagtagttcaaggtgggagagcaggaacaaattagaaatgtgttgagaaagaagatcttttttaaaaagtcctctcactgtccttgcttgtttctgttgaaatacacagactgtttctcccttctctgatggcttcataatcattctttgtctttgattcttattatttattttattttattttattttattttcattttatttttttgagatggagtctcgctcagtctcccaggctggagctcagtggcgcaatctcggctcactgcaagctccgcctcccgggttcacaccattctcctgcctcagcctcctgactagctggaactacaggcgcccgccaccacgcccagctaactttttgtatttttagtagagacggggtttcaccgtattagccaggatggtcttgatctcctgacctcgtgatccacccgcctccgcttcccaacgtgctaggattacaggcctgagccaccgcgcccagcctgattctttattttggaaagtttctgacacctctttaaattaagctctcatagtttcttttgtgttcatttaagtatgtctattttcttttctctaacctaatttatttttatcttcttttggacatttgttttttctcctgatgtgaaaccccaaagtggtcacagcagactcgctcagggatgcctgagaccgtcagaatcttcgtgttcacaacaagatgggatgtgcttggctttcgtttccctttgagtttattagttcactgccaggtattcatttattctcaacagttgttttctgagcacttactgtgtgtcagggactggtataggtgttggggaaagagcggtgggaaacaaaattcctgccctcgtagcgtttaagttccaatggaatggtactaaagtaccctgagcgattctcttgatcttcagccctacatctgttgttcaagtgcttaggttaataacaaaatgtaaaatacctaccatggtttcacatagttatgtgtgtctgatgtaggggccataaccgtgtgtgtgtgccttgagaaaacttaagatctacttcttggcaaattttaaatatataatacattgttagcaactatagtcaccatgctataccttaggtttccagaacttactcgtaactacaagtttgcatcctttgaccaatgtctttccaatttctcctacctccagcccctggttaccacctttccattttgtttctgtgagttcagcttttatatcaaaacatcatgctgcacaccttgagtatatacaatttgcatttgtgaattatacctcaaagctgaaaaaagaccccaaaaaacccggcatggttcctaaccaaaggagacacttgtaaggctttgtatcctcctacagtttgcattttgtatcttctgaaattctctcttcccctagaattcatactgataaagcttatacgcatttcaaaatatatgtttgaggctgggcgtggtggctcatgcctgtagtcccagcactttgggaggccaaggcgggtggatcacgagatcaggagatcgagaccatcctggataacatggtgaaacctcgtctctactaaaaatacaaaaaattatcgggcatggtggtgggcacctgtagtcccagctactcgggaggctgaggcaggagaatggcgtgaacccaggaggcagagcttgcagtgagcagagatcgcgccgctgcactccagcctgggcaacagagtgagactccgtctcaaaaaaaaggaaaaaaaatatatatatatgtatacttgaggcaagtacaagtcaagtacccatctctctctatttttaaaattcatgctttctctgctatcataacattcggtctataaaacgttgatttcattaccaaggcaaaggttgatgttgatatcaagcaggatgttacagaaataaatcattggatccactttacttctttcttactttcagactttgtctcagaactttattaaacttagcaaaagttaaaaagaaaggtagtcttaactgaagactttgagatgattttagaaggagtttagtaacattggatgaactattgtgtgtcactaatcatgtcagagaatgtaacttacaactgaaactttggagtctgtaatctttctgtgtgttttttttttctttttaagacgattcacctggtcacttctatcactgggtgaagctgattgtatataagctagatctgccttctgcctacctttatgttagtactatttttacgtttaattttgcccaagttgaaagagattgcttggttcatggggccttaaacatttcaacatttgtccttcacaagataattatttcattaaaagtaaattacaatttattcagtagctctccacatgaaaataataatcagatggtaaatggatgccctaagatatgtggagaacaaattaccgtggtattttaaaggagagagttttctaagctaacttttatgcatgcagcatctccctggctaacatgagcattgatgataatttctaccattaatgagctcatttttttttttaatgagactttgtttttacttttaaaaaacagtaacctaaggcaggtgaagtcaaattgttattgctgggaagttgtgtttcaaatgagcactgtaaatgattttgttgagcaggcgttttttgttttgttttgtttttgagacgaagtctcactctgtcgcccaggctgacatgatcgatctcagctcactgcaacctctgcctcccacattcaggtgattcttctgcctcagcctcctgagtagctgggattacaggtgtgtgccaccacacccggctaatttttgtatttttagtagagatggggtttcgccatgttggccaggctggtcttgaactcctgacctcaggtgatccacccacctcggcctcccagagggttgggattacatgtgtgagccaagcagatggtttttaaactggggtccaagaacaagctttagaatgttagaatatctccccaaaaccatatggaaaatgctaggggttttttttttttttttgaaagctcatttaataaaggagagcatccattgttttcattactcttcttaaaggggctgtgactcccaaaaagtgaagaacaaatgcatgtgaggaaaagtcacattctgattagtcatatgttgcttaacaacaggagtacctgctgagaaatatgtccttgggtgatttcgtcattctgcaaccatcatggagtgcatttccacaaacctagatggtacagcccactacatactacggttgatggtgtagccattgtaatcttaagggaccaccatggcaaatgactgtgtttcttttgttgttgttgtttttgagatggagtcttgctctgtggcccgggctggagtgcagtggtgtgatctcggctcactgcaacctccccctcctgggttcaagccattctcctgcctcagcctcccgagtagctggactacaggcgcgtgccaccatgcctggctaattttttttgtatttttagtagagatggggtttccccgtgttagccaggatggtctcaatctcctgacctcatgatccacccgccttggcctcctaaagtgctgggattacaggcgtgagcctccgcgcctgcctggcaaatgactgtgtttctatagaaatgaagagcttagacgtgcctggatggctccagataacacccagctgagccttacggctcctaatgggtcccatcctccactgaaatgagatcagaacaacccatggggcctgacttagtactggccagtagaactggacaatctgttgatgggtgtattctcaaactggtactgttctgttgggtagcccctagccactggtagcaagtgccactgaggaattagaccttaaccttgacttcatgttaattagtcagaattgcagtggccccttttgttggacagcacaggaccagaggaagtggatttgcactttgcatctgctgataggaactgaaaaactgccatgcattgcctattgacctatccatgtaatttgtcatacttggatagcagaggaaaaatctaaaatactgtgtttttcaaaagaaatggaagcttattgtattaggggaaaatttcctggggattccttatttctttcacatatacacacacccagtgcaagcatgcacacacacacactcgcacacacactggatacagttttgtaggttctttgtgtcccgaaaacataaaatgttcatttctgcattttgaattatggatttgaagatccatgctgtgcaatctcagcatcactaataacgcttgagttgaatgctccaagctcacttcacaaggcagctctcgcttagggagcggtttgcatggaggtgctttgaattccgggacagagtggtttggggaactagggggattgcagtctctgttgacaacgtgtcctttggctgcttggttgttctttcctacgtttgtgtttcggtttaaggtcatggtgttgttctgggagacattagcttaaatagcgttttgtttgtttttgctttcgacgtgtttaaacgtatggatggaaactaaagttgtcctctgggaaccagggctgtgatgtgcatgattagatctttctgtgttgatggcttgtgtgagatcttgtgattacccagcgaactgtgccaaagtttcattatttattcattccttccaatgattttggagtacctgctgtggctactaaggatatcatgtattttcctcccaaatgtctgcaactcataaacctctgacagtttagaatgtgtgtggagccgggcgggatgatcataagaagagatggtgcgcttgtcacctgtacaagccacttagattcccaggcagttttctcacctgaaaaacgagagattgaccttcagtgtttccaaggttcttttttttttttttttttttttttttgagacggagtctcactctgtcgcccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccagtgtttccaaggttctttgctgctcccaagtcactgatgtttgtgtatgtctacgtgtatgtgtgcttgtgtgtgtgtttctgtatgtatgcatatttgtgtctgtgattgtgtgtgtttgtatgtgtgtgtgcgtgcgcatatatttagcttttcctcataaatctttattattaaaatgagctcacaacagaagaggatgagaactcttgggctatgtaggaaatgcagggccagagggtgtattaggatcaagaagaggccagacccccaggtcgtggacctcctcctgccatgggcccacagcccatgtggttttgtgaggtagcttgaaaacctggttaacctggaatgtaatttttaaacatgattgtactttgaggaaagaggctgttatttcttgttagagggatctggtcatcttttctgctctgttgtctttgtttatgctctcttgagagtcatggttccctctgcaccttgggcttggcccgctgcggggtagcccctgtttcccaagcatggtgggacccctgctgtgcctccacatctgtgttctccatctgctctggaatgccctccctgccaacgcacagagctctccagcctcggggaacttgctgctttggttgggaaattccccttgggattaagcgttcctgccttcccgcagcactttcctagctcagagcaggctcacagaccgtgtgagtgtccttgggtacagaataccacaggcaagtgagatcattctccattgcatttcttttcaactacaatttgagtgatttttcagaagtacaagatttacctgattcttacatggaggtagtgatgtattattaaatacacagaatacaaaggcaaggatgggtggggcgtgcacctgtaatcccagcactttgggaggccaaggtgggagaattgcttgaggccaagagttcgagaccagcctgggaaatatagtgagacgccatatctacaaaaaaaaaaaaaaaattttaagaataaaaaatcaaatttaaaaagtttatttaaaaagtcagggatagcccgggcgtggtggctcacacctgtaatcccagcactttgggaggctgaggtgggtggatcacgaggtcaggagtttgagaccggcctggccaacatggtgaaaccccatctctgctaaaaatacaaaaaatagcttggtgtggtagtgggcgcctgtagtcccagctactcaggaggctgaggcaggagaatcatttgaacccgggaggtggagtttgcagtgagctgagatcgtgccattgtactccagcctgggtgagactccgtctcaaaaaaataaaaataaaaagcagggataatacctcacttcccctgcttaaccctagcatcaagagtagatgaatacacaagttgaattggattaggtgactatatatcaaaaacaattcagctcagctgttgcactgaatgaacgtttttaaaataaccgcacagttgactatccgagttgccacctgcccttatttggtttgtcagagggtgggtgaatatttagggacactataaggggagtcctctcctttctctcccacctctttccttttgctctctctccccctttcccttcctctcttttcccttcttttctttcttttcttttccttccttttccttctcttttcctctcctctttcctcttcatctcttcctatattctcttttctcttattctctttctgtttctcccctttcatcttcaagacataacaacatggctatggatatctgtaagtttgactgattttaatgtgtgcaatgataatttttaaaacatgcatagtatatacataatatgtctccatttacacggttctgatggctttcttaatattgctaatactaaaaaaactttaaaaattattataatttgaaacatgaattctgatttctaggcttcatgataccttgtggaaagaagctgttatttcttcttaggattggtcattttttcttctctgttatctttgtgtatgtatgtattatacatgtatgtgtacctatgtatgcgtaacatccaaaaaaatccacatttaaaaaaaatgtagtttgcaataatctttttaaaaatgtagtttgtcataatattttttaaaatgtagtttgtaatgaggagaaaatgagtacatgacaatcgagtttgattttagtagagcaaaaattaaaatcaaccctcagcttatgctttggtgtttgttaactcaaatttaaaattagaaatgtggtaattatttggcagttgtggctttctcagggaaaccatatcatattgtatgtgtgtgctggcctttaaaaatagatattgccacgaagctcatcatctgaattcatggccgactcctggaagtggtgggctttggaaagcagggctgtgagtttggctcttacacttccagggagctctccattccagctttggttcccttcagtccatctgtggtcaaagctcttttgttttcaaagctaactgctgaagagtaaacactcttgaccctgactgtaaatatgtgtcatacgtctggttagttttagttttaactgaacaaaatcattttggcagaagagtcattaaagtttgcacaaaatcctgaccttcacatccctggttttcctcacatacgcatccgcagggagtcacaatccatttgaaaatatttcttctctgggactgaaaatctcctaaaacgtgtattcttcagcaaacaaagtatctcataaaatgtaaacgtggatgactgggggaatacaattttttttgcgcataatgacttctgtcagtcctctaagaaattcaaagaattttcacggcttccagtttaaattctagcgcctctggccatggccatggtttgttctgtgtttgattatctttccgttcaggggttcgattgttactgggctactttagacaaagctacctggatcttgagttgccacttttagcccaaaatccccttcctacctgtttaaggggcagtggagcacttggtggccacactggctctctgtgttaaggtgtttgctgaaaattagctgtctacggtggcctatgcccgtagtcccagctactcaggaggctgagggggcgggaattccctgagtccaggagtttgaggctacagtgagctctgattgcgccaccgcactccagcctggatgacaaagcgacaccttgtctcaaaaaaaaaaaaaaatctgctgcaagagcttatttgtaacctggaaggaaaggagtagtccagggtttggggcagagcctattgcctctgaaaagacccagtaaattctctggggactgcttgtatccttgtaactagatagtcgtcacacatgagtgaaaagaaggcatttgggctttgaaggtggtcaagagcgtccaggctgggccaggcatggtgggtctgtgtgagaagcagagcttaggaaggctggggtctgaacatgctttgacttttgctttgtgcaaccagtaatccagaaaaatcctacctgaagccccagaggctgtgcttcttcagcagggtgtcatattgtcagggagctgcaaacagcctgttgtagtcagaaaagacggtgttttcctttccacagctttatggacataaaataaaacttgaatttgacaaacaatacaataaatcctcctttcccaaaaattacgagttgaggtcatggttcctaatcggaactgtgtgcagctgttggatttttggcgctttctagagctttcactaaaatcaaatgcatttaaacaccctccctcctcaagaggacaggattagcccgcctccccaggagaacagtgctctgctgcctgcgtcagcaagctccttacacagtggtctcctgcctgtgtcagcgagctccttacaacagtctctgtgcacgtcccatcactttatcatggattagaggctgcaggatgttttcatatggcccatgataatgtaatgatggctggtactttaggacttgaaaacctcttaacgtcttggccagactgtggactgttctttcaggcatctgtcttttaaatcagttatctccatttgctgtcaaatttggcctgcattggccggctttattatttctattgttccatagagagccacactgaaactaatttgagaaaagtgtaatctctattgaaaacttggagtccaccagcaagtagactgtatattttggagtgtccaccaaaagctcatagtcactgtcacctcgtaaggatgcttccaatgaatctccaaaaagtagtttacatctgcatccttggtggagattttcttaagtagacagaatttctctttttttttctttctttctttttttttttttagattagttttcctttttcgcccaggctggagtgcagtggcacgatctcggctcaccgcaacctctgccttccgggttcaagcgattctcctgcctcagcctcccaagtagctgggactacaggtgcgcaccaccacgcctggctaattttttgtatttttagtacaaaatacaaaatagagaaatacattagaaatacaagtacgatgctcttgtcagggaagaaaaactctttctttatcctctcttgtgcaatgaccaggggcctgcaaatgtaactgacaaaagtcaggttcacagcagaaaagaatacaaatgttattaataatttatatgtatgggagttcacagaaaagaagtaacactcaacagatcagacttgggagcttatatacctttcttcataaaggaaaagagctttgggcttcaagggatgaacaattgtgcggaagcaactgggaaatacacgggggaaactaggggaagataagcgttattttagtgaggtttgtttgtgcagactcatctccatctctggtgttaagagttgcacttcagccaggtgcggtgtctcatgcctgtaatcccagcactttgggaggctgaggtgggtggttcacctgaggttgggagttcaagactagcttggccaacatggcgaaaccctgtctctactaaaaatataaaaattagccatgcttcgtggcgtgggcctatagtcccagctacccaagaggctgaggcaggagaactacttgaacttgggaggcagaggttgcagtgagcagagatcacgccactgcactccagcatgggtgtgacagagccagactccatctcaaacaaaataaaaaagagttgcacttccccttcctggtacaggagtgggagacacctgaacaaagggaagtttatgcctggcttttaggcagaaaaagtgggcgcagagatcctccgttgccttcaactcagaataatccttatgccagagtggcatattttgaaatggtatattccagaccctgcttcatgctttacataaaaaatatcagtgcagtacaataaatcctaatatcagattactgtgttttcagtgtgacattttgtttattggaatctgtcttgtatgtcagtttattgtatattttacttgattttggactaacttgcatgtattatatatcacaattgcccgaacctcagaacgagtttacacgcttttgtcttaaaaatggaaatacaggctgggtgcgatggcttatgcctgtgatcctaacactttgggaggccgaagtgggtggattgcctgagttcaggagtttaagaccagcccgtgcaacatggtgaaaccctgcctctactaaaatacaaaaattagctgggcaaggtggcacacacctgtagtcccagctacttgggatgctgaggcacgagaatcgcttgaacccaggaggaaaataaaaaggaaatgcaatttctcaaatagtaaaggtttaataagccacccacctatgtgctgaaataaccttgaattgataaagatttaaacaaaaactaaatttggtcatctgtataagcatattatttagatatggggtatcatgccatgtcattgcaaattgtgtaggaaaagcatcaacttctgtttaaatttgcttggctgaaataaatgtgaggaagtcagtgtgggagtttatggcaaactctgaattattctgaaaatagtatatttcaaagaggcagatatctctaaacaaatctgaacaggatttggaaaacatttttgtacttaaatttgatattatgcctgatatttaggacttctaaccattactgcccaatgcttgatatatagcaataaatatttgtgaaatgaagaaattaatgaatggaacacacatacttgaatgagcagaaagactgaaagtacacagagctgaaagcctgtttgatttcttcatctgtcaagctccctagtgaaaatttgctttgtgacacttctgattcattcaaaccttctccagaaggaaagtaattaagtgtttttgttttagatagttccatttttatactgcaggtgacaagcgaggaataaccagctttagcttttaacacaatgagtaattaaacacagaagttactgccaacaaaattgaaatcaaatctgtcatttgatccagtgctgtgttgcatttgctttgtgaattggtggggaaaatatggtaaataataatacaccattgtatgttaagaaacagctgggagaagtaggatcattttaaaaggctaagaaacaaggtggcaaacatctagaaaattctttaattaaagctaaagcaaatgagataagatcaatccttcgattgtgatatgatagttttttaaaaaatagcaattgtttggtctgtttcttaaatagatgctgtcatttaccttaaaagctttgctaacctcaagtctgactgtgggccttctctgtggccgctgaagctactagtgttggttcaaattccaacactttttgttatgatttgtattagcatggggggataacttaacttctgcctcaatttcctcatctgtaaaatgggaatgatagtagtacatatcacatagagttgttatgaggatcagataggtttatgcctgtagaacaccaaaagcgccacttgcagcatgggcatgtttattgaatgatgatgattaatcttcattaggacccaaatgattcgtggatttcattttaaccataagctgcaaggattttttttatactttaagttctgggatacatgtgcagaacatgcaggtttgttacataggtatacatgtgccatgttggtttgctgaacccattaactcatcatttacattaggtatttctcctaatgctgtccctcccctatgcccccatcctctgacaggccccggtgtatgatgtttccctccctgtgtccatgtgttctcattgttcagctcccactttggagtgagaacatgtggtgtttggttttctgttcctgtgttagtttgctgagaatgatggtttccagcttcatccatgtccctgcaaaggacatgaactcatccttttttagggctgcatagtattccatggtgtatatgtgccatattttctttatccagtctatcattgatgggcatttgggttggttccaagtctttgctattgtgaacagtgctgcagtaatcatatgtgtgcatgtgtctttatagtagaatgatttataatcctttgtgtatatatccagtaatgggattgctgggtcaaatggtatttctggtcctagatcatgctgcaattatattttttttaactaaaatgttattgtaattctttttgtaacttcagtgataaaagtaaatgatttgagcctatgatttccacaaaatctagggaaatgatttaatatcctttaattttttaaaaaaaatggctttaaaaggttctgttgtggtatagttagtgataatagaaagctcctatttctggtgcctcagtggccattccagagccagtttcctgaggaggctgagctcagtgcctaagacttagccaggattctgcagctgattcaccgaggaaaccttgaccacagtggtctcatacattccataaggggaaaggaaaactttcttactgatgagttcgttgggcttttggaattcatatgtaaggtgattatctggattttagtacccttaggtcaatcctttaaaaaatacgtaaaagaagagaatattcttccggttgcaatgtcaaattataggtgagtatctgcatatttattcatccagggaaaattctggattcactgaaataaaatatttcaactagaaccatatcaccatgggtttggaacagatcatcattcatcaaggttattgttttccaaattggatgatcattagaactccttgataaatggccaggccccacgcctgtaatcccagcactttgagaggcctacgcaggaggatcacttgagcccaggagttcaagacaagccctggcaacatagtgagacctccatctttacaaaaaaaaatttttttaagtggctgggcatggtaatatgcacttgtaatcccagcactttgcaaggctgaggcagaagcattgcttgagcccaggagttcgaggttgcagtgagccttgattgcgccactgcactccggcctgagcaacagagcaacaccccactctaaataaataaataaataaaatacttgataaagatcttgaaaaatatggctttctggtccccacccagacctatttactcaaaaccagagggtagggattatcaacctctccactgcaccagagcatcactcattcggcccgcatccctcctccttcttctttttttttttttttttttgagatggagtctctctgtcaccaggctggagggcaatggcacaatctcagctcactgcaacttctgcctcctgggttcaagcaattccccttctcagcctcccgagtagctggtactacaggcacgtgccaccacacccagctagttttttgtatttttagtagagaccaggtttcaccatgttggccgggatggtctcaatctcttgaccttgtgatccgcccacctcagcctcccaaagcgctgggattacaagcgtgaaccaccacgcccagcctcatccctccttctatagcatcttggcccagtgccatccagccatcagcttgagtgaacccaccagcatggggctttgtgaacattgtcctaattgtcctgtacagattggacgtttgtgactaggaaaagcacatttactaaggatctacgttttttaaactttttgaaatcttttttcctttgctatgttttttcttttcttaactgcataacataaatctcttagaaaatcacatttaacatccaagagaactcatgatgtcctcttcttgtgttttctgggtgcagagctccagagctgtttctttgaaatacaagttatctgttgaacttaagcatatttggcagagcaccctgggaggacagcactgcccccaaactctgagtctcacaaggagggaggtcctttatcagcgtgcaagtgattcccctataattccacccaacccaccaaaaagcctcacttccaactccatccctgataccatggatgatgtaaagaatggtcagtcatttcactgcctgatgtcactaccaatacacaagaagctagaaaggagataaacagagagcagggaactctaaaatattttccctgagaatcactggaacaaggggtctgattacttctctgttggctgttgaggatccatagtcaaccgactgtccatgctcctcctattccctgggacccttgctcgaatgacctcaccacctggctggcacatgctaccctggggtggaagcacattctcttatgacttgcaatgggaaaaagggctgaggatcgattttttttttcctgagatagctgaggaggtgagtcctgccaacatctgagctaccccctagggcaggcagaatatttctggagaaaaacgagccagcatattgctaacagattccatggcattccaaaccccaccctcccactgggccatttggtatctcctggagcgtaaagtccatggaatgagagattctccccctggttctggcgtggccccattttctaataatacccatctgcagtcttaagcctttaagctgtcccaagggtagggggtctcagggaaccagttggctccagtcaccttgaaggattcactctgagttctgactggttgagaccagaagttctcgtaagtagcagcttcgcttctgagatgctcctttgcctcacctgcacgattctgcagagctggggtcctgcctaccttttaaccacatctgacaataactatccttaccttttgctaccccttaaattcagacttctttacctttggcattggtttgctcctgattcctctccaaaatattctagaatgctaaaaaatgtcaaatgctctttatcttaaacaagggccagtgtttgaaccatcatatgtcatagtgacacgcctgtcagagctaaaatgagacttattacatgccgtcctgcttgggagtagttggggatgagtaaccacttgacacgttccagcagtccccccacctcggtccctattctagacaggctagagctgtggccataccagcatccagtccttatgtttaaaacagatcaagcctctaaaatgagggacttttaagtgctttttttgaaagtgtgaaggagcagtgtactgaagataatgaacaagcttccttctcactaaacaagagttaaccaagaattgcattcacagggatataggcaaggcaggaatagacggcgggactgtagatcatgctccagtgaggatacttgactgaggaaggagggggcgacattcctctcaggcacttagtgagttgggtataagtgttacttattggtatccaaaaaggcaactagaaatcaaggtgattcatgtggaaagagcagaagagtatccatggtaattatgaagtagctgatggctctgggcacaaaagtgagctgaacacagttacggggccagtgtgctttgggtagcgaagagcctccttcagcagctcagaaatgcatgagcgagagtgcacctaaagaatcacaagtgatgcactgcacaggaattacaggaaatgaggagccaggggctgagggagtctgggaaggtttcataggcccaaagggtgggtgggatttttgattcatgaaaagatggaggttggtgggcaggaggaaaggacacatgaaggtagaatgggcagggtgcagtggctcacgcctgtaatcccaacactttgggaggttgaggcaggaggatcatttgaggccaagagtttgagatcagcctgggcaacatggtgaaacctcgtctctactaaaaatacaaaagttagccaggcatagtggagcatgcctggagaactgcttaaacccaggaagtggaggttgcagtgagctgaggaccatgctactgcactccagcctgggtgacagagcgagaccctgtctcaaaaaaaaaaaaaaaaaaatgcagagtgaatggagcttgtttgggcaggggagagccttgattgacaaaacaagtggtgtgtgtttatggacaatggcaaaccttgggagtctggaaggaacagatgctgtggccctatggaggatggagaggaggaggagacaccaccagaggtaattcagaggctgttgtgattgtacaagtctcagattctgcaatgatggcagcgaggagggaaaggaagggacgagggtggggcgtgagggaagaattgcccaggttgaggaactgattggagatagagatctgcaagaactcagagataaaattgggacaaactacccagattggcagggagcccgccacagtgtggaaatgagaaaagggtgaggggttgctctgacttcacggtgatgagcctgtccagtccttaccagtctctcagggggagggaggtcacagtgtcacaggatccttagggtgtcgctttaccagctggaaacctctgttgctggtggcacctctgcctgagttttgctcatgcctgctggacttgttctgtccactcagcccagtaagatgtgctcagcttgtgctaccagcctggatcccatgcctgccaagggcaagccaggcatggagcagcaagtgggtatgtgagtgagtgaacacagggtctggccactgcacagccaggcacgctggctgctgtggcagggtgggaagctccatatgccagctccctttgaggctgtggctggaccagatgtgccacaagtggcttccactgtgggcaccagcgtctggatgaggggaatgtggtggtgcccgaaagctcagagacaccaggaactgcagagtccccaaataggtgttacagcatgtcacagccatggctcagggagcaccaaggtctgggcttccagaagggctgcagctcttctctacttcttgttacctacagtgtggtgagtggggggacatgtttcagcccatttgtgttacagctctttcagtcccaccaccttgctctggcccgtggctcatgggctggaccagccccactgctgtttcccatcatgtggggtggccactcagcaccagcagagggtgggagggctatagtgttaacagcagctccagctctgaggtctgggcccccagaagggttgccatcctttactcccatagcccaggagcatgtcaccacccacagctcagcgagctggtcaagaacatgttacagctcctttcacttccgccattcagcaggtcctgagttcttgtcctgtgtctaggaagaatgaggttatgcagacaactgggtgaacaaggcaggcaggagctttattgagtgacagaacagctgtcaggagacccaaagtgggtagctcctttctacaggtggtccagacaagtgtcttaggctggctgagtctggggtttttatgggctcagaagggaggaagtgcatgctgattggtccataggtggtcataggcaggcctggaaaaagcaccgtctgattggccaaaaggcatcagtgaagttctcactccaggttgcggactccacctggaacggacagctgagcccccaggcttcaggccatccctggcttaaaggtagggtttcactagagacccaccccttcctgcctaggaacctgtctgcctcccactgccatcaacatgccatccatggcacgcaggctatctgcactgaggggcacccacatgcccacgctcagctgccctcaatgcccccagcctccctcccacactcatcactgcccgaagtccagaaagggctgaggcagcagggtgctgggtctgccacaactttgcttcgcactggagcgggcacttggagagaggagaggccagagagtgggaacaggcacctctgcctgaaggaataggaggcttcccaggccctggagagtgcagggatgcccaggtccacggctgggcagctgcaactgcctgggagaacaggctcccatcctgccagcttggtagggtgcagggctcctgctgggatcacctattcctggcccctgccagctccacagagtgcacaatcccagccatggcttccccactgcagctggcgtcctcacagcagccaccccagatgggccactgctgccgtcaacagttggcaggaaggcaggctaagcctggtgtctcaaccagaggactttgcagcagaggtaattgccaaccccacttccactgccttgacgtccctcttgcagcagagaagctaatcctgcccagcctggccatgagtgagggcacctgaaggggtgaggaggcgggggtaatgttgtgtaggtgggagggggcagtagagagtcccatactcaaagtgactgccaaatccagggctgtgcatagagtgactgctgacagcgtttgataagctttgctgtgagtccaaaagaatgatcggatagatgcctgtcttgcagcgcatctacattaatctcataacaaattattcgtctcatattagagaaagtttagctttcttagaagcttgatgggaaagagcctcccagctcttagagtttgattttcgcaactcagttcacatcttcttcttactccaggttcccagctccttgagccttgcccgtgaaggggttggagtcaggatgggaagccttgagctgccttgacctgctccatctctgactcagggatgtgccctgcttgtcacagcatgggtgtgctgggccttggggcatcttttcaggcagagagcaagacgttggcattgtggaaagctgtacctccaaacagcagcccattcacagactacagaggaagaaaagaccacacttgctacagtaacaatgcaattcagtaccagggaataacttaacatgaaacatgtcaaatctatgtaaacaactggaaggcactcctaaaaaatacaaaaaagaatttgaaaaaaaaaatcatgttctaaattagggaagtttgaggttctaaatatatcaattcttcctaagttaatttattacattttacacattctcaatttataaaataccaaccattaagaaaaaaaataaactaggcaaggagattccgaagttcacatggacaaataagcaagagctgccagttattgaatgcattacacagcctcagtaattaaaataatgtggtactggcaagtgaataaacaagacagcagaacatattagaaagccagaagtagtcccagatatatatgagaatacataaattttgaaacgtgtcatttaaagtcaacgaagaaaactagattgcccaataaacataatggcaactgggtaaccataaggaagaatgaataaatcatgccccacaccaggataaatttctaatggatcaaatatttaaatagttcaatgtgtaggccaggcatagtggctcatgcctgtaatttcagcactttgggaggtcgaagtggatggatcacctgaggtcaggagtttgaggccagcctggccagcgtggtgaaacctcgtctctactaaaaatacaaaaattagccgggtgtggtggcacgtggctgtaatcccagctgcttgggaggctgaggcaggagaactgcttgaacacaggaggcagaggttgccatgagctgagatcctgccactgcactccagcctgggcgacagaacaagactctgactcaaataaacaaataaaaaaatagttaaatgtttttaaaaatgaaaccacaaatgcattattatttggaaaaaccaaccgtaaaaatacatttttgaggcaactggagaaaatcaattatagatcaagtattagatgataccaaataatattgttaattttgttacatataatagcattatagttatacaaggaaatattcataattttaaaatgcatattgaagtatatagaggtaaaatgagttgatattttgggtgtactttaaaataattttgttgagagacagagtcagagagagagaagagatagaagaaagaagtataacaaaaccttgatagcagttgaatttaggtgggggtatatgccagtttattatagcattgtctctactttgtacaggcttaaattttttcaaaatcaaaaatattggctggttgcagtggccagtgtctgtaatcccagcactttgggaggctgaggcgggaggactgcttgagaccaggagtttaagacaagcctgggcaaaacagcaagactccatctctacagaaatttttaaaaataggccgggagctgtggcgcacgcctgtaatcccagcacttaggggccaaggcaggtggatcacttgagttcaggagtttgagaccagcctggccaacgtgacagaagcccatctctaccaaaaatacaaaaattaactgcgcgtggtggcagatgcctgtaatcccagctactcgggaggctgaggcaggagaactgcttgaacccaggaggcggaggttgcagtgagctgagatggcactactgcactccagcctgggcgacagagcaagactccatctcaaaataaataaaaataaaaactaataagtactagaagaaaacaggagaatttcttcatagctgtggatttggcaaacctttccaactgatttaaaattaagaaaccatgaaagaaaagattgataaaaatcaactatctctctctacacaaacacacacatatacatttatttatataaaatatatattatgtaaataatatatatatatatttgaatatatattttttaaagccacttttccactaaggggaaaaaacccactaaagagaaaaaaaaaactaggaaaactatttgccactcacatcacaaacaaatggctaatatattaatatagacatttctggaaatccttttaaaaagttaaaactatcaaaatagacaaaagatctgaacagacagctcacaaaaaagggaaaaggaatttaaggagtctaaaacatatggaaagatgctcagcctcatttttagtaagaggaaagaaatgtaccatatctgggaaacctcagagcagcaaaactctagagctgctcttgcactctgctgaggctggggggagacgggaaccgtggctgatgggaatgtaaactggtgcgatttgacagtttttgtcagagttctttcagatacacttagattcaaggtgatgtagctttgtttgaaaacagcaaaagaatagaaaccttaaggcccatccgtagaggactaagtaaatcacagaccctgcgtacagtaaaatactatgcacctgtaagaaaatgaggctaatgcctgtgtgcctatatgggaagatctccaaagcacattgctaagagtactttgcacacttctgcttatatatgaaagggaaactaagtgtctatttgtatttgcttgcataaagaaactccataaggacaaacaagaaacaaataacagtattcccgcccttatcctgggggatgcatttgaagaccctcagtggattcctgaaatcgcagatagaacctaatcctgtatatactgttttttccccatactgtacacacataaacctatgataatgtttaatttataaattaggccaggtgcagtggctcggggctataaccccagcattttgggaggcccaggtgggaggatcgtttaatctcaggggttcaagaccagcctgggcaacacagcaagaccctatctttacaaaaatttttttaaaagattagctgggcatagtgacatgcacctgtagacctagctacttcagatgtcaaggcgggaggatcacttgagagcaggagatcgaggctgcagtgacgtatgattgtgccactgcactccagcctgggcaacagagcaggaccctatcaatccatcaatgagtaagtaagtaaataaataaataaaggcacaatgaaagatcaacaatatggccaggcgcaatggctcacgcctgtaatcccaacactttgggaaggccgaggtgggcaggtcacttgagtccaggagtttgagaccagcctggccaacgtggcaaaaccctgtctcttactaaaaataccaaaaaaaaaaaaaaaaaaaaaaaaaaaagccagacatggtggcacatgcctgtaatcccagctacttaggtgtctgaggcatgagaattgcttgaacccgggaggtggaggttgcagtgagccaagatggcaccactgcactccagcctgggtgacagagcaaaactctgtctcaaaaaaaaaaaaaaagaggaacaataataaataataaaatacaattctagtaagatactgtaataaaaggtatgtgaatgtggtgcctctctttctctcaaaatatcttattgtactgcaccatggataactgcaaccttgaaaaaggaagcgatggacatggggcgactactgtaactggcacctcagaaatggggaagggggcggaaatatttcactgtgaaatattcttctgccactttttaactttattcaatcacatgagtcaaaaaattacaaatgtaaattggatttttaaagactgtactgtgggcttattacatagtcacctttgcggatcaagtcctgactttatgtatgacatctattagcagcctaattttatatgaattgaatgcaattccaaaaataacagttaggtcatttgaaaacatatgccttaggtgcccattaaatgctcttttcaatatctgttttgttcagaatgtagtctggccggccctgggtgagtagttccatgaagtaagatactgtgatcactttgagagggcagggtccctttgctcattcctatatcatttcatcaccttcctcatgatccagccagctgctctattaaatttgaaaaccaagtatgctttcaacctacaggtgaagaaattagatgaactgtctggccataaattataattcttgggagccagagctgtttcactgtggttgagaccaaatttcaagcatctgctcactgaatgcttttccatttttgctttaaaagcttcatatgagtacatacagcattttatttgcttcacagcatgccccacagaactctttcttggaaatacagagattcctatttttagtctttcaggaaacaaaattactaacttctccccctgcttctctttttcttctttataaagaagaaagggttggaaatcttatttgcattttcattctctgtgatacgaggatgaggggggagggcagggtttgtgggggatctttcacatcgtttctcccagctgggactaaataccatgcatggccacagccttgtcctgttctgcacttgcttttatttatttacctccaaagcaaaacacatccagcaaggggaaggagtctcgagtttcagtcgtcaggatggtaagaagtccttcattatcatcttcctgggcatgaaacgattttaaaacaactgatatacctctccctttctttttttgagatggagtttctctcttgttgcccaggctggaatgcaatggtgtgatcatggctcactgaaacctctgcctcccaggttcaagcaattctcctgcctcagcctcccaagtagctggaattacaggtgcctgccaccacgcctggctgatttttgtatttttagtagagacagggtttcaccatgttgaccaggctggtctcaaactcctgacctcaggtgatccaactgcctcggccccccgaagtgctgggattacaggcgtgagccacagcgcccggcctctccctttcttttttaaaaaaattatatttagtcttctttcaggcttgaccatttgcatctttaaacattatattgcaaagccacttgaaagctgcagtttacaaatgtacatgattgataggtctatagattttcatagaaggcctgacttcataagaatttataatcatgaataaaaacatttgcattctctttcttcccccaaatcattctggcagtgaacacttcacctgcccaggccttttatggaagagtgtatgtaatacctctgagcctttggggcctgggatccaggttgtcccacagcagagaagggagggtgagacaaggcaggttaagcaggtacggcatgttggaaggtgtaccatgtgcccttaaaggtgaacccagtgcaccttcatgaaccgtggtacacctttaagaacttggtatgccttcatgaacacttaaagtaccagggggcacttcatgaaacatcattaagtttctcctaagtcattgcaaaatgatcagaactcttttgtcgtggacagcatttcttttgtaggtgtttagagttgccaatagctccataaattgttaaaagcaaaatattgaaatataacctaataatccagggccccatgttttgaaagatcactgccaaatctttcacgtagataccaaatactgtgtcaacatttagctaaatcgaactggtggtgatcccaacaagcaatgaactggtacaaagagaaacaattaggagaataaaggactcagccatcaacaaactgaataatgatcaaatggacaaaagtacagataatgaggaagagaagaaagagagagggagaggaaagaggtaaccggtgctgagcaggagatgatgccacctggtagcagaatcagaagcctgcatggtgcggagtgcactattacaaatgtgaatgtcatcaatccttagaacaaccttaaagtcattgtcattagaagaggagataattagcctgagtcacatggctaaaaagcactagagctgggctttgaactcatgtctgatgagcccaggctcttactctccaggctgttctttgcatttatggtaggccgtcagtcacctgtttctctctgcatcagagctgaaagccacaggttcaatcctgaaatgcgcctatggcaagaacctcattctatatagtagttgcaaattgtgcctcaggcttaaacctctcctagaactggggacaaaagtggctagatgctatggtgaaagaatatggatagttcagtttaaacacatttctacttttaaagaaagaatgcattaatgcattattctccctaataacgatttagaagcatcttgttgatagatacagaggagcacattttaagctttataattttcagtttcagctctggaattgggtaaaactgatgtgtacattggttttaggttaaaatgtggcatgtagcattttggaaagcaaagtgaataaataaaaatccagggggaaattttttttcaatgcttttgctctaggaacttatttatgctggtatcattagctgtttttcttggatgaccaatgtctataattgtagtcacatatttctgagataggatgaaaaccacaacaaaatacaaacctttcaagtcagcacataagttatgtatattaatgacagggagaaatggagccaggaaaagtggttttaaaaccgcgcggacaccagggagtgtctatgtatgtggttttattaaatctgacttctagaagcgagttgttcaccactgagtgtgagaaagaacccggaacttcataatcatatgtattgactatacttcagatcagataagtggtcccatagcacgggtcccttgaagagagatgccattgtggggttttagttagaacagtctttcggtccttctcctggttcacaggatttgtttgaatgttgttctcatcacaattctaccccttcgtttttgcatagggtccttttgtgccccaatatttcatgttctgggactaagaaaatgttaattgcctattctctaataatatgtgtataaaatgcatccccaagtgacaaactttactatgtaaatgatgctgctgtttataaaagaaaatggtgagttcttacagtcctgattttgccactgacagcaccttagccaacctgtgtgtttctccatctgatgtggaggtgcaacaggcctgggctgcacgctgattcacctggggaactttaaaaaaattcccatgcctgggtcccacccagagattctggtgccgtatgtctgggtgtggtgaggggcatgggaaggttaagactccttaggagggtctaacaatgctcagctccagttggcaatgactaaaccagaggacttctaaagacacctccaaccttcccctttgtgatttctagtctgtgtcatacataactaatggccaaaattcagagtaaaaatttttcagtgattcatgtaacgagctcatccagccagacatggtggctcatacctgtagcccaagctattgggaggttgaagtggggaaattggttgagcccaggagtttgaagctgcagtgagtcatgactgcaccattgtactccagcctgggcaacagagtgagaccctatctcttaagaaaaaaaaagaatcaaaaaaatctcatccagcccaaagcactcaatagtagagtacctcttttgccacatgtagtggattttattggttcttttgtgggatgcatttaccagattaccctactcctacctctaactcttccattaggatagcaaaccaaacagaagagggctgtcattaataacgttctacttaataggcacttgatgaacatcttccacatttggtgtaaattccattcaccctgcgagccacccatatcctgtctatctgaccgttgggaaattgattttgttatttttgcttctccctggaggactgcacaaagttttaagacaggcttggcatggtggctcatgcctgtaatcccagcacttggggaggccaaggtgggcggatcatctgaggtcaggagttcgagaccagcctggctaacatggcgaaaccccgtctctactaaaaatacaaaagattagctggctgtggtggcacatacccgtagtcccagctactcaggaggctgaggcacaagaaccacttgaacccgggaagcagaggttgcagtgagctgagatcatgcctctgcactccagcctgggcgagagagcgagactctgtctcaaaaaaaaaagttttaaaacaaaaaggcaagactgaacaaaaaaaaatggagggcaaataaaagaaagaaaacaacattctcacgatgttgaatgtgttctaaattttccaggcaagagaaaagaacagctgtgattctgcgagtttgcctgagtgtcaaggtcagacttaggagttgagtgttgtcctgcgtgtcaggctgaggttcctcgctctcatctcttacttgcccagactcgtgattgcagggatgagatagtcctgctataggaaacatttttttttctttgccagatcagcatgatcaaatgtttctaaagctaaaccaaatgacatattggcttgcaaggattacccacacccttgcatcagtaaaaaaagaaacaaactgaactgcctggagggagtggagagaggctattttgtgctctgaaagatgcccaaggcagctgtagatagcattgttttcatgaaacgttggctgggctggcctgtgcattagctcatgttccaaatctgtcaccagaagaatgtagtgagaatcttgtttcaatcttcttttctttctcgcttcactctttcctcaaccagagtccagcatctacacagccgctgtggccaaggtttgaaaacagcagttttgaataaaacctaacaggcttttcacattattctaaaaaggaatggaggccctttgatgcccatttccaggccttatttccccactcaccccagagacagttgctgctgagttttcaaacatatggattatcctttctctgaggaatctccactgaaactagagatggcagagggaaaactgggggcagccgtaactgcatgctggcatttgcagctcaggttggtcatttctgtccacaggggcacaggcagcaatccagggattttgtacaaccttcagggaccaaacaaccttttggtcctcagtcccacacccacaggttcagaacccacctgttaacccttcatgttttcctctcactagccctatggggctttttccctcaaattttttttattgtggtaaaatacacacaccataaaatgtactatcttaaccatttgaagtgtacagtttggtggtattaaatatcagtatatccacattgtcgtgcaaccatccccatccatctcccaaattcttctcatcttggaaaactgaaactctatacgtattaaacttcccattcccccagcccctgacaatcaccattctaccttctagctctgtgaatgtcacaagtacatcattatgtgggatcatacagtatttttttgtgactggcttattatacttagcatgatctacgttgtagcaggtgtcagaatttccttcctttgaaaggctgaataatattccactgggtttagatacaccacgttttgttgacccattcacccatcaagggacccaagttgcttccacattttagctacagtgaataatgctactagaaacataagggcacaaagctgggtctgtgacaccctgcttttaattcttttgtcacaagccctgttgttttaaccttgctgtgtgagcggtggcagagatgtgagttaccctgagttaccggctgtgaatctgtaagggtccacagcaacttcagtccttgcctcctaaaaagaaataattcaactgaggggcatcaagcagaaagagactaaggcaaggttcagagcaggagtggaagtgtattttaaaaggttttaggcctggcgtggtggttcacgcctgtaatcccagcactttgggaggccgcggctggtggatcacttgaggtcaggagttcgagaccagcctggccaacatggcaaaaacccgtctctactaaaaatacaaaaattagccaggcgtggtggtgggcacctgtaatcccagctactcgtgaggctgaacccaggaggtggaggttgcagtgagccaagattgccactgctctccagcctgtgcaacagagcaagactccctctcaaaaataaaaataaaaggatttagaacaggaaagaactcttagaagagatccaggtgggcgcctgaaggcccaagagaaaaaaaaaggaggcatttacccttgatcctgggactttataggctgccctctctcccatgattcttccctcagggcgggctttctgcatgctcagtgccctctttcccctttggaagtgagcagtgcagcccgtttaaggagttatgcacatgcccacaatatcatacttcgccattttgtctcttaacgcgtatgcccaagaggttgcttctccctggggtctgcattcagttaacacttttaatgttaacaggtgtgcaacctcaggagccggtctctccctggctgccgaattaccgtttttagagaggcaatgcgatagttgctggaccatcaccagacattcctggtaggggggcgggagagccctctcctgccctgcccatgtctaactacctgtagcagctggagatcagtctcctcatcgtagcaatggagacagcatacacttaacttcatgctagcgggatcacacgaagctgccttgattaaagccctttgtgaattctcaaacactttaccattgtccatttatgcggtgtgaagatgaaacgagatatggaaagcattctgcatgcagtgaaatgctgtacaaatggacagtatagtgtgactcatttatgctaccatgggatgggttctgtacttggcccttggtgggaacttggtttccatacatgagaaagtaacaaaagggaggtgcaggaggggatgggggtcctccctctagcccaatgcccagtggccctgaaactccctgagttgtggcatcatcccccacccccacattttccaaacctcttaattcctctattgctggatggcttactgaaatgctcttcccatgatctctgtgggcaaaggcaaataatttttttttcttttacagacagggcctcgctctgttgcccaagctggagtgcagtagcacaatcacagctcactgcagccttgaactcctgggcttaagtgatcttcctgccacagcctcctaagtagctgggactgtaggtgcatgccaccatgcccagctcatttgtttttagtctttatagagacggggtctcactatcttgcttacactggtctcaaactcctggcctcaagcaatcctcccacctcggcctcccaaagggctgggaatacaggcaagagccactgcgcccatccaggaagggaatttttaaaggacaaattatggtggtgcatagctacagagcccactagacacagctctccctgaagaaggaatcctcgtgaaggagaaggggtgtgtggtgcttctgtgctctcatatgtgacacctgctcacatgcacacaggctggcctcatcatgcatgactgtaaagacattttgggtcacactgcagaaaagaaagtgttgggactggtctctaagctcgccctgcagaaacagcgagctgtcctagctgtcctgggaatgatggggccacagactacatggccaagagcaggcagagcagctactgtttccctagggccacgtgtggaatgagtcacttcatcagctcaccacaactgctggcctggcacctgggtcctacggagagggcaatggcaggtaaagtgccatcacagaaccaccaggcaccgaagaccgcgttgcctgcttggacgatatgggcctggctcactgcagaagagaggcactgatgctagagactttcccctgggccatatgtatttttgtcttgaaagaggagtcgtaagggtttgcctacccaaaagctattttgtttcatatttacatttttagttctttctccattaagaaaacgattagtgaaatgaatggaattcgccttctttgctgctattgcttatgtgttcctatttcaccatcttttgtaaataacagtgttgttgctgtcagggcacttctccctcactgggcacgtgcctttctgtgctgtggccagcccaccatcgcctgtcctcacctgccatccataccctagcagagccgtgctgctctgagggtgccgggtggggctccattcttaccctagcaaactcaccagaacaaagcccacctgcccaaccctgtccttgtctcatttctcagcttcccgaggctcccttccatacccacagaggcaggactgctagagccccactcatgagaatcacagtcatttcccagcttcctggggcttccttccatgcccgcagaacagaggcgggactgctagagccccactcatgagaatcacagtttccacagagaagaccagtctagcttggactgtgggttcctggttttgcagatgtagagtggtgaaggcctaaccgaggagaggaaacaggagtgtaacagagtctccattccaggaccagcatctcttccctccccttcaggggtttaccttcctgaacttctcagtgtatgaaacacagcaggggctggggaactatacaacccagaggtgtgtttgtttcaagtattttttagagcagtttcaggttcaaaattgagcagaggctgggcgcagtggcttacgcctgtaatcccaatgctttggaaggctgaggcaggctgactgcttgagcccaggagttcaagactggcctaggcaatatggcgaaaccctgtctctactaaaaatacaaaaattatctgggtgtggtggcacacacctgtagtcccagctactcgggaggctgaggtgggagggtcacctgagcccaggaggcaaagattgcgatgagcccagactgcaccactggacttcagcctgggtgacagagtgagaccatgtttcaaaaaaaaaaaaaaagaaaaaaaattaagaaggtacagagatttcccataaactcctcgcctcccacttgcacagcctcccctactatcaacatcccccactagagtggtacatacgctacaattgatgagcctacactgacacatcattatcacccagagtccacagtttaattagggtttactcttggtgtatagcctgtgggtttgaacaaatatataatgataatatgtattattatacaggttgagtatctctcatccgaaatggttgggacctaggagtgtttcagatcttagaatttttttttattttggaatatttgcatgtacataatgagatatcttggggacaggactgatgtctaaacaccaaattcttttatgtttcatgtataccttatatacatggccttaagtttattttacataacattttaaatagttttgtgtatgaaacagagtttgtgtccattgaacaatcagaaatcaaaagtgtcattgtctcatgtcgaagctcaaaaaccttgtgattttggagctgaaccaattttggattttctgattagggatgctcaacctgtagtacactacggggtattttcaccgccttgaaaactccactgtgctccacctatgtattcctccctcccctcccaaccccagagaaccactgatctgcttactgtctccatagttttgccaagtttcttagaactgggtataaattaagaataaaagggcatttctcagtctctaaggataagggcttgggcgcagtccatttaatgacattattttccttatgaaaaattataggattgatttattgactatttcttaacatgtgtatggtgttaaatattcttaataagttttggcacattgtccaaaatattacattgtaaatttgggaagttccatagttcttttacttagaaggtttgaattagaggtgaattgcccgagatttgagaaggaggccgggaggcagagagtggaaggcatttgatgtatctgggttttgataaccaccctgttcatgttttagtgaagaccatctttggcttctaaggacttgagtctgacagataggcaactggggggcccatgtgtggatttcccttggtctggaatcttcctgatgggcagatggggagtgagaaatgctctcgagtccacagttgaaatatttggggatctttagtgacaccagcctatatcctttatgtgaaggtccaggagtgagtttcaggcacttaacagttaacatccaactgtccgctactgtcagagcctgcagaggactgtgggacaggctgtgtcttgtgtgtacttttataatagtgtaaaatgttaatgaagtattgcgttataatatgattttactataaaatgacagaatatctctttttttttcaacaagtattctctaactctacaaatatcaatgtggctgctatcaaaaaattttaaacatagcgcagattagggccacagtcttcaaggtaatatttaaacctggatcaccatatttgatagctttcaatgtgaccttgaatatccaaagtcctgcttctgtttaaaacttccctacaacaatttaataaattagaattttagagactttttttcctttaaatttagaaagtgagttgaaattcaacctatttccaccacccttttgctagccctaaagaatgagatagaacattagtcattagaatgaactttaatctaggccttgatcatgaaggaaatatttagatgaatgatttgaattttgtttagactcagtgtaattttagtcacacagattttgcttgaaaatcagctaggcttcttttaccccaagagaagatttttacctaacgaagttcaccttgcatgttttaacattgattttttatgcttactttactgttaatttggatcaaatattgggtctggaaaatgctcctccccttcctacgtaactgtcagagtccatgcaacgatggacaccttgacattgaaacctccattacggaggtctcactgttaactggaagaatcgcagctgcaagaaactgaacagcacctggcgacttaggtagaatttgaaacagaaatgagaaaccaacatgtattcagcttttgtgaaattgtgtgcttctagaagcttcttcttgccccttgccttgtgaaatatcgaagaggctttattttcttattcggaaataggtaacatgttggaaaatagaatatgcaaatattacacttagatgcttaaaagcagtgacattgtttcagagaaatccccttttttctttctttctatttttgagaaagagtctcactctgttgcccaggctggagtgcagtggcaccatcttgcctcactgcaacctccgcctcccaggttcaagcaattctcccacctcagcctcccaagcagctgggattataggcatataccaccattcctggctaattgtttgtattcttagtagagatgtggttttcctatgttggccaggctggtctcgaactcctgacctcaagtgatccatctgcctcagcctcccaaagtgctgggattacaggcatgagccacagcacccagcccagagaaacctctttatgtcccatgagcattagagcagtacccagaaccatgtaaggtactagcagtggtaaatgcctggcaggctctttgctcatcttcctcctaagccaggaacaggcatcagccctcacccagagcacttggatctccccacgtgtgctaagatcccttcgcagcatggagcttcatgcagcaaggccgatgacataagctggcatgagttctgtctgctgccctggtatatcctatagcacctaatgtgctggaaggactcacgtatttaggaacatgatagttctcaggctgtcagttttttaaaaaggtgcagggtgcaggggaggagaatctggaagttactattgctttgtcagaggtgagattctgagtaaaatgttcgcacagtagcaatgcttatgtacaaaatttttactatggcacaggattgcatcaggttttatagagagagctattacttttttataagactgcctcacttttataactgtcagtatattagcttataatacagacaattgaaaatagcaaaagcacttttatatagctgacaataaagcctcttagtttggattccctgggtttcaatgccatggcccacagtcattttactcaacaggttcttcttgagggcatggggtagaaagttctggacctgcctgggaggtcaaggtgagaatgacagccaaggagctgaagagagaaaccagcaatgcagaagcacaggtgttcccagagtatttgagatttcatgcatgtaaacacatttcacttcacatatattaaaaaagaaggccaataagtgtgtgaaacattaatctttatttggttattactagaacataagtttgtgtgggcagggagtttgtctcactgtatccacagccccagaaccgggcttggcctcttgggtgctccataaatatttgttcagtggatgaatgaaataatttgctaacatttaatttcttgcatgtcttggagatattaaaactactttaaacaaagatgtccttgcttcagggtttctatttggagtgttttgtaaaattggctttgggagatgcattgattcttttctgccaccagggggaggtatagtgcagttcaggaatcaagtttttaagttttttcaaagaggggttagtacttcaactgatactcttagatgtggataactgtgactaagttaaatcagcactgcaggatgaggtttaaaggtatttcagcatatttcaagcttaacacaagcatgtgtccgggttaaaaataatatccataaatacagcctgataatgtgcttaaatataaaacatataaataggttgcaaaagatgactgaatctttcatcattttatgatcactttctgccacccaaccagatggcatatgtgatctactagccagaaggtgtaaagtacatgttaaagtgaacaaatactctttttttcttcagaacaggaaaagatctgataaaaatctatcattctgtccatgcggttggcaccgttttaatgtcgggggaaaatgcagtggttctagttctgcttcgtagacagtgactaaatatataccgtcaaggctgagtgtcaggggctggctcagtacaatcaagcatgtgaatagctcttttgtgctgggaacctgttgggcagccttacttaattggggagccacgggacaggaggtctggtaatatctttattattaaggagagagtcccaggggctggaagggaggaattttcctttacaacttttttttttttttttttttttttttttttgagacggagtcttgctctgttgccaaggctggagagcagtggcgcaatcttggctcactgcaacctccgcctcccaggttcaagcaattctctgcctcagcctcctgagtagctgggattacaggcacatgccaccacacctggctaattttttgcatttttagtagagacggggtttcaccatcttggccaggctggtcttcactcctgacctcgtgatccacccacctcagcctcccaaagtgctgggattacaggcgtgagccaccacgcctggccaacaacattatttttagtgagaacaaacttaattttagttcagtagacattgcctattatgtgggaaattaatgtattcttttattactatcttcagtttgcagttcctgaggtcttgaggtttggccatataagaacatccaggtagatcaaggtctctcggcaactccagaccccctgttccaggagtcttgattgacagagcttgctgcaagtcagtagccagcagctaaattgtctcacctcgttttcttttcttgcctggtctctgggtggaagttccaattagggctcaaacagcccccaaagccggcagctgaagaggaaagggggaatacggtggtgcttcagtgccatctaatttggccttaaacagtaggaaattagctgcttgtcattaaaataaacaaatgccagcctgttccgtgctgcatgctgcaggggacttgcaaggggactggtgaagtccccacagtttctggggtttacagggggcccagagccgctctcctcccctccagattcccaccacactgttggccagctgtggatcctctcctcctttgcctaagttagaggagacaaaggtgagtgtgagctgagtgcttcagtgtcgaggccgtgcgggcgatgatgtgatagggcggcatggggttggtgttacttaaaactccgtttcccaacgctgctttccacagagctggaggacaggcttttggtgtcgagtgtctcacatccttgttttttttccctttggcatgaatatctagacaggaatttctgataaactcctgtgaaccgaaaagtcaccgaggcatctcaatccacttaaaggtttattttgccaacattcaggatgctcctggggaaaaagggacacaagtcccagtgggatgaatgtcctgtgctttttccaaactgggtttgggtttgaggacttcagtattttaaggacaaggaataaaagggggggtgggggaggtaggaagtgaggcaagtggtcacattcttgtgaggctctgatgagcattctgtgaatctacattttacatgtgaaaacaaaggagggggaagtcagttacgcatttatctcttgcacagtaaatctacattttacataaggtaccctaagcctgtgaggtcacagctatctttctggggacaaaaggcaggcagcttttgtgtgactcggttcctaagcttcactttccgtttggcatagtgagtttggggttcccaaggttctattttcctttcacgctctgtcagagaatttcctagggactattttggtttggtaaatgctgaattagtgtaaattaaaaatcaatcgctatttacatccccaacataatggcccttaataggcaaccatttttcatgagtcttgtttcagacatcccagactccatttcccagagaagcagagaatgaatgggtgctgtatgttcactgctgggtgtccaagaaactgcacaggaagtgtcttaacgtgaagagagtccgcactggacaccggcacaaagggcagagtgaagggacgaagtgtcagatgcgtctctgccaccagcacacgtttcagcggtgctagatttgactaggcacaggactctaaactggtggtttgctgactattaacctccacggtattgctatctcatgctccttgaccccttcctaattttgctgtggttcggcagctccagtccactgttgaaatgctggtagatttcaaaactccgttgggacatattaaattctggtgagccagtgggtgggatgccttctgaatgacaaaggggccccgtggctaaaagctgaaggaaattcatgcaatgatgaatgtgctgcaattaatcaccagagatctgttcttttccttgtatgcgtagtacagtgcaggggccagggtgggggagagtctctgagtccagatcttcatagaattaaaaataatgaatatttgtaatcaggcatcgcttgaccaacaactccgcctccttagctggaaatacagacgtccacttttcgctggtgtgtaatcattttctggaatgctaagaattgttcccctgacctatggcttctttttaagcatccgggatatgcagtcaatttgcaggttgctgttttgaagtcagggagtctcggagattgaatatatgccacctaagttcctgcaagatggactttctgggagtcctctgatgaggttgggagaaggcaaagaggagacgtttccatgtaaaggctgagcaagctccaggccactgcagaagttcagctttcttcagctctgtaagctggaccctgtggctggagtctggccaactgcagggacaagtttctattattatgtaaatggagtcccagtgcggccttggaagagtttttggcacagggtaaccctttgtctgccaaaaggtagcctctccctttgcttcaagcccagagcgtgcattgtgcagtggtgacctgtaagccacccgtcaacctgcagattgccttattaggcagactgcggaggctggtggctggggactggctggcagaggcggtggcagtgagcttgtgtcctgtacgaagccggagaacccgagccccggagacgtggcctagtactgttctattaatgatagtgctctgtgatgacaggaatatgcactctccttggcaggcatactttatgggttggttggagaacaggaggtttgcagggggaggtgactgtccgaaggacagaatggtacgaggctttcttcactgcgtagcttgtgtgttcagttctgtatcagggcttattctacggagtatggactttatcgggaaaatttgtttttaacttttaagttcaagagtacatgtgcagatttgttatataggtaaacatgtgttatgggggtttgttgtagagattatttcatcacccaggtactaagcttagtacccattagttatttttcataatcttctccctcctcccaccctccaccctgcgaaaggccccagtgtgtgttgttcccttctatgtgtccatgtgttctcatcatttagcttccacttataagtgagaacaagtagtatttggtttttctgttcctacgttagttttccaaggatggtagcctcctgcttcatccatgtccctgcagaggacatagtttcgttcttttttatggctgcgtagtattccatattaggaaatgtggaatgttttccttttaatgcaagatgttttgtggactctcagaatcttgtttatgttttatagtaaacttttttgaatggtgaggtcatgtgtatagtagggaggaaatataactagatagtcaggtggtacaatggaaatggcagagttttaggagccaagggacctgcgttccacggctgccacaagtgagctaagtggaataagtcacttgcattagggaggtgatttccccaaggacagaatggtatagctcatgtatctagggcttagtgggcaatcactagtgatcactagtgaatctgtgatcactatacattatacatatccaaacatcactccgtaccccataaatatgtacatttattatttgtcaattaaaaactaaaataaaaatgtagagtagactgaatgcactcaataacctctccatcgtacatttctctcctcaaattgcattaaccagcctcccctctcctttttgttctcttcagtaaagctgtttaatgagtgtgtgtggttaatagccacagccgagcatccacggggaccgttttcccaacggaacctgtaaggctgaatccatcttttctcgtttgagtttcttccaaacttgctgcagtagctgaaagttagtgaagacggcactttcctgcactgaaatgctcgttcagatgcctcaggttctatgggttatggctcatggaccaaagctgcacatgaggcaaacgaacacctggaggagcctgcgttcaggatggggcagtgaccgcgctcagagcgctctggctcacatcccttgtctaagcggcttctcattcattgagctgaggcgtcggacacctgccgggaagacagacgcgaaccgcggctcactctgactcctgactgctccggaccccggcttcagttctcccctccctccagagatcttggggcaccagggctcataagctgctgcatgagaacagggacgctcttactgctggagtcagattcagagtgtgtgtgtgtgtgtatttttagcacagttgggagatgacatctgagatgctgctggctcagctctgctggtgtctcttttgagcatggagcggtgtcctcgttgtcttcttttcattgcttatatctgctgcttgctgttcagggaaagcacaaattcactttctcctcttgttaaaaaaatagtttggcgggcgtggtggctcatgcctataatcccagcatgttaggagaatgaggtggaaggattcttgaggccaggaattcaaggccagcctgggcaacatagtgaggccactgtctctataaggaataggctgggcatggtgacacactcctgtaatatctgcactttgtggggccaaggcaggtagatcacttgagcccaggaattcaagaccaacctgggcaacatggcaaaactctgtctctacaaaaattagccaggtgtggtggcacacacctgtggtcccagctgaggtgggagggtcactggagctcaggagatcaaagttgcaatgtgccatgatcatgccattgcactccagcctggccaacagagggagaacctgtctcaaaaaaaaaaaaaaggaagaagaataaaaatattagctgagcatggtgatgtgcacctatagtcccagctacttgggaggctgaggtgggagaggactgctcaaacccgaagtcgaggcttcagtgagctgtgattgcagcactgcactctctagcctgggtgatggagcaagaccctgtctatttctttaatgtattttctcaccacctgaagaccaagcagcatgatgtatcccagcttgatgtctgggtgtgacaagtatctgaattttctttttccacttgggctacagggatggctctgatgcttcttcacgggctgtccacggcctcccttcccacctcagaatgccctggctgggcccacagcacgttccgtctgaatgtgggtggctgtcttgccgaacccgtgtcgactccatgggaaggccgcaggttaaagaggccgaagaggagacccagagccagtgaacgaggcacggggttctgttgtgggcttgcatacaggggagagagtccagtggcagcgggctgagtgggagaaccacaaccgctttcaaaaggcatgcagtttatatagcaatagcatgtccacttggcacctccccgacaatctccacctggcagccttcacataccccaaaacaaacagtccagaccccctgtgcatgcagtggtggcagcagggcagggaagctgctcagatgttcctcatagataaggaacgaatctccagttggcctctcctggattccttagcttggaaccctgaaccccatgcaggtgccgctgccatacagggccattctcagggtgtgcctaagtgattgctgtcaggcgcatttaccatgcagagggatgggaccatttaagcccacgccccggttaggcctcttcccagttccagctcccacactgtccgctcttcttcctggcacggaggtgagggcccatggcctccctgttcacctattgccatcatctcctccacaagtaagctctccagtctcgtcctccaggaagccttccttcgtcacactcaccccatctgattatgctgtttccctgtttcttcccaggctttatatcatcggtggcttgtattcatggttttctaattctgtgggcgtatcctaatcacctgtggtgggaggactttcattttaaacaaataccgcaagtggtctgagggccacccaagtttgatatcctttgcttaatcagatgttacacccacgcataaacgtgtcttgagtcatttcaacagacagtgtggaatgtgcctttgatttattttgtgtcatgacctccccaaggcacctgcactgtgagcacgggatctgctttcctggtgcaataatatgaccatgaagaaagccaatcatgaaagtgtgaaatatcacaaacacgccctcccctaccccgcatcaatcagcaaggggctggggacctgttctgaaagactggtaggtcttgggtaccagttaatacaacccatggaggccgggtgcagtggttcacacctgtaattccagcactctaggaggccgaggtgggaggattgcttgagcccaggagtttgagacctgcctgggcaacatgttgagatcccatctctacaacaaatacaaaagttagctaggcgtggtggtgggcccctgtagtcccagctactcaggaggcagaggtgggaggaattggcttgagcttaggaggtcgaggctgcagtgagctgtgattgtgccactgcactgcagcttgggcaacagagccagaccctgtctcaaaaaataaaaaataacccatggaaaacaagggtgacactggagatcacaggttgatgagcttttcttgcattttcatactgattattattgctgagattgtcattgttgttactttattaagatgcccttctgagaacaaggagagccagaaattactttatttgaaactttccttcaaattattggagtctagctctagaacagctatgatctatctggtaccaacagacattttatatatgtgcttgtctgctatctggacttttagactcacaggaaattctcctctgtgacgactcagtgtttccctgctttctgttcatgtgaaaaccatcaagtagtgagcactgaatgactggatttggcagagccttctccgctctccctggacgattgtaatcaagtcagccccttcccctctgcatgaggtcttcttctcacgagaggagaggcatgggcccccgcagctctgaaggtgtggcatgctgcaccttatgtcctgggatgcagccacagaccccatacagtgaacacctaggtttactattattattattattattattattattattattattagagacagggtctcactctgtcacccaggctggagtgtagtagcatgatcaaagctcaccacagcctcaaatttctgggcttaagtaatcctcacttctcagccttctgagtggctggaactacaccatcattcctggctaattttaaaatgtttttggtaaagatgggggtctcactatgttgcccaggctggtctctaactcctggtctcaagcagtcctcctgcctcagcctcccaaagtgctgggattacaggtgtgagccaccgttcctgggaacagctagttttatgtttattcgtcacatcattgtttaagagccctttgtgggttggggctttgaacaggtcagaatcgtccttggcgtctcctggcctctggcaagtggtgggccggccatgtgcccctcacaagagctgttctccaggtgctcagcatgtgcctgcattgtatgtcagctgtgatttgccctcagtgtacattttattgtagattgcactgaaatatacacaccatgacatttaccatttcaaccacgtttaagtgaacagttcggtggcatttaggtgcattcgctcacagtgtgcagccatcaccaccatccctctccagaactttttcatcattccaaatggaaactctacctattcaacaactccccaattttccctctgcccagcccctgataaactcccttctactatctgtctctgaatgtgactgttctagaaacctcatataagtgggattgtacagtatttgtcctttggtgactggcttatttcacttagcataatgtcttcaaggttcctctacattgtagcaagcatcagaatttccttcctttttaaggccgaataatattccatcatatgtatattcagtgtgtaatttaaacacagaactgacctatgtctttcttttctgacaatcagctgaccattctctcttcctctgaggtacctgaatttttctttccaagagtcattagccatagatttggaatgaaccagaaactaaaacgattggagataatttcattacaaatgttaacattactcttttgaacattaactttaaagacactaataagtcttttaggtgattgcaataagccttttctttaaaaaagaattctgaagtttagaaaggctggcatggttttctttcaacacatccgataaagaaaaaatagctgtgacttgcaacatttcttattgaacgtactttgccttttcatctccacctatgtggtctgtttcaaattaccttatgcagtgatgtaatgcaacattttatttgcacgcttgtccaaaatattaccactaaccaaaattcacagagcatctcacagtgcacgcaggaggagaattagactaaaatgaggaatctggaaagtctgactgaccagtgagatgtgatcaaggggaaatgaaagggcctaagtgggctttccctaggggcaattttctcaggtcaggcagttctgcctcagattaaggatctgcacacataaagaaaatccaccaaagaaaatgagaataccatttatggctgttgctagcatacaaaatgctcctttactgggctatgaaaatatgttcttcactttggaatttcactccagccatcatcattagtagcttatagtagatttcattaaaatcatttccatagcacttcttgattttggaaatgtattgataagtcatgtcagtatgtattcagacaactgctagtcataatatcacactcccctatactgtacatttaaattccagctcatggttggtttgatggctcacgcctgtaatcccagcacttcgggaggccaaggtggaagaatcacttcaggccaggagtttgagaccagcctgggcacatggcaagatcccatgtctacaaatttcaaaaaatagccaggcgtggtcccagctactcgtgaggctgaggtagaaggatggcttaagcccaggaggttgaggctgcaatgagccgtgtttgtaccactgcactccagcctgggcaacagagccagaccctgtctcaaataaatacatacatacatacatacattaattagttaattcattcattccagctcattttcctgtagactgggagtgctttcattgatgttcactgagcacaacaaggtgacatgaggtgacatcgtacggacctctggaggagcatgtagtgcacctgaatcccttttcaatacggagttccttgtgtggattaaataatgcagtccatttttggagtgcttctatacgtgttctctcattttatcctgacctcaccatcctatttccctctttgattttgttgtggctggccagggaatggctgttttgcctttattaaaacaatttttttagagacagggtttaatctgttgcccacactggatgagtgcagtggcgtgatcatagctcactgcagccttggcctccagggttcaaacgctcctcccacttcagcctcacaagcagctgattacaagtagggattgcaggcatgtgccaccatgcccagctaaattttttttttttaaattttttgtagagacagagtctaactttgttgcccaggctgctctcgaactcctggcttcaagcaatcctcctgacttggcctctcaaagtgctgggattacaggcataagccaccaccaggccctgttttgccttcagagatgtattttaagttgttggtctacgcttgatgtatctatcctaggtcaggcactatcctggttttctcatctgcatatgaggataagtcaccgagaagactaaaggaattaaatactccaggaccctcagccttgcatccgccccccagtgatgagccaggggaggtcacaggcaccatcctgttcggccctggtgggaaatggctggctgcagtggaagtgctggctacttccctttcccttggctttgccctcgttttctcccccaggatgatggcccccaaaggagagttgcctcaaaggacagcgttgcaggggtgcttgtgtgtcatcagccagaacaagtgacagcgtctgactccccaaatagcctccctgtaagtctgagctgccgctgtgacctgcgctacacagtccctgaaggtttaataccgtgactgtcatctaacgccttagcttttgaccttgtcaatttgggaggtgacacgtctcacctggactcatactgagacattgtcaatagttggactgcaggaatcattgtccccgtttttgttttttgttttttgttttgtttgtttgttttgtttttttgagacggagtcttgctctgtcacccaggctggagtgcagtgacgcaatctctgctcactgcaacctccacctctggggttcatgccattctcctgtctcagcctcccgagtagctgggactacaggcgcccgccaccacacccagctaatttttttgtatttttagtagagagggggtttcaccgcgttagccaggatagtctcgatctcctgacctcatgatccgcccgcctcggcctcccaaagtgctgggattacaggcgtgagccactgtgcctggcccattgtccccgtttttacctttgcctagctcagaaatcctgttagatgcccaggaactcagatgaacacattgttctgaagaaaactaggaatacacatagtaacgaagtaggtgaaatagagcataataagatacttccagtttccccagcgaatctttagcatgttcttcctgattctccctacatgcaaatatttctgtttcacatcatggcttcagattttaggaaagacaagaagactttaagtaatagtctcaggctgaggaaagagaagtaatacttttcctctctgcaaactattcaagaaatgtggttggctaagaatgggagaaatttaaggatagaagtgatttcagtgcttgcctgcccatttgattgattgatccattcaagcagtattgatagtttacttgttctgagccaggctctgtgctagaaatgcacccggaagtgtgcatcacgtgctgtctctccagtttttataatcctttagctaggagacaataaaggcttttgagcaggaaaggtgtgattggtaataaagaagaacatttaggaaggggatttaacaggtgaattcaatgttggtaggcagggcaaggttcttctgtgcgcacctggtgtcaaggttaagcaacactggtgcctgttatcaaggatcttggtgaccatctagaccaactcctcaatttacagccaagaaaatgcatctgctggaagaagtgagcaggctgattttgagccataggcgccattcattcatgccaggattttctcctggatttttagcctatgtctaagctttggggatttaagaggtcttattgccttcatcttcatttgtatttaattgttttgcaattacagaaggaaatcgtgcatatggtggatactttggaaaatagagaagttactttggaaaacacatgaacagagttatctctgagttgtgagagaattaatgtcttggtttatttcctgtcattctgattaggtgtgtgtgcatctctaatataatatttaaaatttttcaaatcagtaatggagtttcaaccctggtttgctcgtgtaattgatttacccagtcttctatatgcaccccaggtagactaattcccattttatacatttataaatgtatacacaaatacacatttataaatgtatacgcaactgggtccattaactttaacaatattaattattccaattcacggacccatttatttgagtcatctataatttctttcatcgatgttttatagttttcagtatacagatctttcatctaattggttaaatttacaactattttattttttgatacaattatgaatgggattgatttcttaatttctttattatatagtttgttgttggtgtaaagaaatgttattggcattccttaaggaaccaaaagtagaactaccatttaatccagcaatcccactactgggtatctacccaaaggaaaagaagtcattatataaaaaagacacatgcacccgcatatttatagcagcacaattcacaattgcaaagacatggaaccaacctaagtgcccacagaccaacaagtggataaagaaaatgtggtatatatacactgtggaatacttctcagccgtaaaaaaagaatgagataatgtctgttgcaagaacctggatggagctggagaccattattctaagtgaagtaactcaggaatggaaaaccaaatatcatatgttttcatgtataagtgggagctaagctatgaggactcaaaggcgtaagagttgtataatagactttggggactctaaggggaaggttgggagaggagtgagggataaaagactacatattaggtacactgtacactgctcaggtaagggtgcactaaaatctcagaaatcaccactgaaaaacttatctgtttaatccaaaaccacctgtacccaaaaaactattaaaatttaaaaaatcatttgcagtcaggtgcggtggctcacacctgtaatcccagcactttgggaaaccgaggcaggtggatcatgaggtcaggagatcgagaccctcctggtcaacatggtgaaaacccgtctctactaaaaatacaaaaattaactgggcatggtggagcgtgcctataatcccagctactcgggaggctgaggcaggggaatcgcttgaatccaggaggcagaggttgcagtgagcctagctcgcgccactgcattccagcctggtgacagagcaagacttcgtctaaaaaaacaaaaaaaaatcatttgcattgttaaaaagaataaaagaaatactactagcagggagcggtggctcatgcctgtaatcctagcattttgtgaagccaaggcaggaggattacttgaggccaggagctggagatcagcctgggaaacatagtaagacccaatctctaccaaaaaattcaaaaattaaccaggcatgttggcacatgcctgtagttctggagactcaggaggatgaggtgggagaatttcttgagcccaggagttcaaggcaacagtgaactatggtcacaccactgcacttcagcctgggtgacagaaaaagatatactactcataattttatttaatttaataaatgatggggtatgtatatatcagaattagaacatgtcgccataatgccatagtctttatgttctgagtcatcatcaataaaccacaaacattgtaaaaacatagcaacctgacatataaattagaagttaataggttaacttctatatgtagaccaaatgaatatcacctcttagagatgataccaataatcacaagccttgtcaacattatatcaatgcaattttagtaaaaagtaaattttccctcttgcagatcccatcaagtatgctagtcactcattgagaagaagagtgcacaagggtaatcatgttgcctgaaggaaaggccctgattgtcattcttatgagtgtccataaaggtcttatttaccattggcatcgttcacagcatacactttcatcataacgaaaatgaagccaaacgtattcgggagagaaaagtcaggtaccagattgctcatcaatttatccaatttcaagtttcatgggaaaacacatattattgtaactcacatttataccccaattgcaagggtacttcagtcataaagattcatcagtgatcaaaacatatcctagcactgttagaatactatactaatattatagaaaatttagtctgtatttagacctcaatgactataatgcattgagcaaaattccaatgtgtcatatttctcaacccttaaaaaaatcaatcctaggtaaaaagtaaggattttctcatgaggattccatcacatgtgtctgtcagttattgagaaaaccgtgtcatgatattcttgttgtctgaatgaataattgtaattattatagagctcagtcttcactagttcaattatctatttggaatttttcagccggcaaaggtagccgctcacttccactcaatagaatagcaccagtagggcttactaaatcatccagtgagagaaagagagcaagggtcttagtgccaaatacccaagaaaattaggaattataggaaacttaaacacttaaagaatcagaatttatagtttacttagaagcacacagatagaagtgtgcaaaacaagtttcacagaaatatttcattgccagaatcctgaaataaagtctccacagaaggaaactaagaaatccaaacttcttgtctcacaattgttacctaggctgggcctcagtgtaatcctactaagcttaatttttacgtcatcatttctcgtcaagataataattcagcattggcctagcccatggcactcatatgcatatgcacacttagatcaaatatgcttaagagagatggtttccttaaacactggtgggaaagtggactggacaccacatcttcagtgccagacaattgggtggtatcagtatacaaatggtaaacacccttgagttcattcacagtaatttcatgtgcatttttagaaatagaattaatgagtcattgcttcctacacacttcaaagtagccacatccatatcttattcctctccagtaaggtgggagaattaggaagaaaaggaaaaataataatcaattgcttctttttatacacaacacccacaccccaccagggacactgacttctctctgagccttatggccttagctatgccctagttactcatatctgggggtagccctggtttcgagcaaggtctgtgggatcaaaactagacctagaaatcataaggtttatgaaagacaactgcagctggcctgatgtctccttctggggtcaggctggcccctttaccagcgacatccatgtgggccagggctgggaggccctatgacctcaatccaggacaagtttacaacagtggccccggttctcttgtgctcaggctgatcaggaatgtgggagttgtcctggggagagtcagagcatgtggattttcagcctggcacttccacgccacaagctttgtgaccttgagtattctacaggagtcatctaacatttcattacatgaagaccaggtgatcagaaaggccccttcgtctccagtcttaccagggtccaccagggcctgattcatttgttccagtgatatcactgtggggtgtcagcatcccaatggttcactcatagatccttcaggtctcctccagccaccgcccgtgtaccatgacatgacatggcatgtaccatggcccgatgtcatatgtaccatggtgtggtgtgatgtgtaccatgacatgaccatgttacatgacatgctatgacagtgacctccctcagcctctcccaggcacacagttttaccccttctcctaaagcaggttcgcacgcccatctaaaggcaacttcagtatttgcttttacttctctttaaagattacagccttaaaaatattcagtaaaatattgtacttccataaagcattgcccctgagtaagattagtgcttctcagtggacacagcagcagggaactttgtgcgttcatgctgagctggtggctgtgtgatgctattgaaaagggaatacaccaccatcagcgctcggttaaaacgtcttctccctgaaatttaagaaagtcacaggctgggcgcggtggctcacacctgtaatcccagcactttgggaggccaaggtgggcggatcacctgaggtccggagttcgagagcagcctggccaacatggcgaaaccccgtctctattaaaaatacaaaaattagttgggcatggtggcgcgcgcctgtaatcccagctactcaggaggctgaggcaggagaatcgcttgaacccgggaggtggaggttgtagtgacccaagagacatgccattgcactccagcctgggtgacagagcgggaaaaaaaaaaaagtcacaatcacaacttagaatttctctgcaaataaatatgttaacctacagaatgacgtgaggaaatgtttgggtattttgtagctcccctgtgtgaataagctagcctaaaacaataatgataataatagtagtaataattcttgaatgtcaagtggaaaaattaaaaataataattcattataattattggagagtaaatgaaaatttttcaaagatactttctatgaacataaaatagagatttttcttcacagtcttatttggtttcctatggataggatacctaaataatagattaaattttatatccataatttcataaagaatgttgtgcctttttcctttcaacaactatgtcatatttaaatcagtttgctttgtaccgtaatccatgggtgaggcaaagaattctggtaagactccgttaccaacttaaagataatacccaacaattaaaaaaaatgtgtactggaattttattttcaaatttcgaatacgggaaggggacaagagctgaaaaacaaatgattgggtactatgctcagtaccagggtgatgggacccatataccccaaacctcagcatcactgaatgtacccatgtaacaaacctgcacacataccccttaatctaaaataaatgttgaaaaaaaaggagaaaaggaaaagcaagcgacaggaaaatttgaaaaaaaattagaatagacttattccttaataataattcaaaataaacatttagattcttttagataactgtaattgagtattctacaggaagagtaattttcaggcacaaaaagggtgatgagcagtgatactgtgttccataaactgttacattctttataaaggattatttatcaacatgtcaacatgtatattatttcatcctatctctctattctttttttctttttctttttcttttttttttttttttttgagataggatctcactctgttgcctaggcaggagtgcagtggtgcaaccatggctcactgcagcctcgacctcccaggctcaagcaatcctcccacctcagcctcccaagtagctgggactataggtgtgtaccaccacatccagctcattttttattttttgtagagacagggcctcaccatgttgcccagaccagtcttgaactcctggcctcaagtgatcctcctgccttggcctcccaaagttttgagattataggcatcagccaccatgcctggttcatctctttatttccagaatcagttgcttttactatttcctctccttcctcttctcctcccaacactcccgtttttctttttgttgctaattatctatgaccttaccatcaagtttctaatttagttatccaaggtactgacgttgttcctcgctgagttttttttaactatcctatttgccatagtttttcctgattttatgactataatgtaatgagtttagagaaaaatggcaaaaatgccaccactgacccctctagtacccagggttgatgtaccttgtgtttatgtgcctttattaattcagcatataattcttcattttcaccttaagtgtgtttgtattttacaaattagtctaagtccacctggtttgaacacaggatactaactccacacacccattttagaaggagatctctagcttttagaagagattatcttgtgatttcctatggtcattcagcaaacatttcctgcagccctactgtgcaccaggtacagtgtccagaactaaagatacaaagagtaactcagagtccctgctcctaggtggggtgtggtgaatcacaattttgatcccgcctccccaagatcccatagctccatcaccaaacagttgtctatccaggagcaagctactcgtctagccctatttccttagcttgcaaatgagaccatttctcctggttctcttgaatgttccgtttttctgtacaatcagtctgtaattattgcgaatttttcttggaattgcatgagcattgcttgagctcatcaactacatattgtggttaaaattaagcgggggcaatctaataggcaaagcttaacttaatagcttctacctcaaattaaaattttgaatctctagtaatatctgccctttcttttcccacagtttcactcatatgttgttcataaatcttaagtatgggtttttggctctctgttaggtaaaatacttcacttaacttagccaaagccagacttgcagcagcctggaaatactcaagcgtcccttcttcccaatacacgagggtctctgtaggtttttctttgtatgtgtgtccgtagggagaggaagttgtatctgactcctccgaggatggttaggttgcagcactgtctccttaaccagagcaaatgctgggatgctccatggctttgccttggtcatctacatcacccacgtcccatcactgggctccagtctgttgcagcgcctccaggcttaatttctgttcataatctgattatggggtctgagctattccagccagtggcctcttgcttctcctgtaccataggcacaaagatacaagtgcctggtcgctctagtcctgcactgtgaaaaatctcaacccagttttgcttagaccagacgaaggtggttgctggctgagaattagctgtagagcaggctgtgtgaccgagccgtctgtgtgcagccatgttcagaagcccagggttttccagctatttgggagctttcaaattctctgagaaacaaggtaaggcaagataaatacgaaatgcacttatgtatggattgtataacacgatgaatgcctggggtcctctattttgccctatgtattctcctgtgttcagttacttatacacatttctccaaagacactttaaatatctaattgagtttataaatgagcttatcttgtgattgctgataatgtgaatttgttttcccttaataagttaaagttactactaaaccactgaaacctttttgtaggaaaaattgcaaatgcaattggaatgcccacactttggatcaaatgctagatgtgctgcactttagctaaaatatttttctaaatcaaatgctatacatactaaattatttccagtaggcagtggtgagtagcgtctttttattaactcttcatgtgagacagtttggaacaagatactgtcttttcagtggctttcttccagcacagaggaaaatacatgctttcaatgtaactactgaagtggtgtggcatgttcagttcactgattgaacaaaactgaaacgctaaggttattttgagtatcatatttgaaactcagccattatacatcagaactgctttccagctcaaatgcactattgggaagtgacttgaacaattcagacctcagattcaggaattttctcctacagcacttgaaagctttctgaattgatttctctttggttaattacataacaagatacttgcatagttaagagaaaagcttagatgttttactggcattatacctttcattttattgtatttctttagttggccacagttccaaattccaggactgaggatgtattttgatggataatgaagtgtcaacatctgatatattttgtacttatttttccttgggcttctgcccctaaatattaaagagcaaaaggcacttccttaggggaagaagtttctgtaaatggtctatttgtggttttcttagtggacaaatgctgtaagccaaaggctgtaaaacagattacatgccattagactggttataaattttgtctgtgcctggttttgattaacctgttcctttgggatgtttttcctgtatagaattgttaccagctgtctttacataatacctatcttgtcttcaaaatacaaataaatagttatttttattggttgttattgtgtagattttaatgagagcaaaagacacagctgagttgtcctttgctcttcagaccccacccccattctttaaaggcatctcaaacatttctagttgcctggaccaaaattgcttagtttctcctctattcctgagtatatagctgccttatttagcatttaattgctttgagttattcttgttgccataacaaatttaaatggtaacattgaactgtgttagaagtattattgttattattgttgttattattttcatttacccatggagtatgttggctactttccggaagagaaaagcaaaacttgcctatgtaaatttccatgtggaatttgattcttagaaggtgtcatttttgtatttctattttttgtctggttaatggttttctttttcttaaattatatgttcaaaagcagtttggagagttttttctcaccggatttttaacaatttgcataactatttcaatgttacattatttcttttcccttagatttcaacaagaaaaacttaagcttccttggattcccacgtcaaaggaaagtttcaaggtaaagtggccttgtctcaacaactgtgaaattttgaagatttgttgtagcttttaaaattattctcttgaatgtctaactcatgagtttaaatgtttggcaatatgttttctctctagaatttgatttattaaaatgtatgaagcagaggaatctttgtatttaattctgcttatggaaactatttggagaacagaatcttgctgtctcttgtcattgcaaacttttaaaggactattatcttttctttctcacacctgcctctaagcaggcactgtccttttgcaatctgtccatcaaagaagggagctagattctttttagaaatggtttaaacttgtttctcttccttctcccttcctccttccttcctctgctccctccctccctttttccatagacacacacacatacacaaacacacacacacacacatccatccatccatccatccatccatccatccacccatccacccatccatgtgagttattcttccctggtcttctcaactctctctcttaacctttctgaacttccagtccccttggccacagaatattatgggtgctaatttgattgacctaatgtgctaaaactccatgacacatcatcatggatgtaagagaagtggaaatgaatgcctgtgccatacacagtagctgtatctcaggtgctttttagtagattgttgtctatattaatagagtttgatattttcagatggaggcacaaagttgtcccctacgcagtcaggcaaagatctcaatctgtgcttcattatagcggaaggacccagcccccatttccacacagttgctcttgtgcctaaggtattatgacattgttccttgaccaaaaagggtttgcatttcaacaacattaggatagacaggggtctaactcctgtcctcctcaggctgagcctgctctgcatttgaaaatggcagttgatcttgtaaacaccctggatgggacaaatccttggtgtatttcctccacatcttttaagtgtttatgctttaatttttacacacaatatcatcaagcggcacatctaagtacaaggttaattagagcaatgatgatccagggtcatcagtgaggttgtcttaactgactcacgaaacgtcacttttttaatgggatgcatccgtatttctcatcttggccatgttttaataggatctgaggcttggtttctttctgtttttgtttttttttttgtttttttttttgagacggagtctctctctgtcacccaggctggagtgcagtgacgcgatctcagctcactgcaagctccgcctcctgggttcacgccattctcctgcctcagcctcccgagtggctgggactacaggcacccgccaccaggcccagctaatttttttgtatttttagtagagacggggtttcaccgtgttagccaggatggtctcgatctcctgaccttgtgatccacccacctcggcctcccaaagtgctgggattacaggcgtgagtcactgcgcctggcctcggcttggtctctaatatgtccctagcaggttggtttaactgtcatggagctaataagtgactaaggaaaaaagagacaggaaggcattccttattcaaggataggaaaagcatgcaatatgaaagtcacacacgtcagtggacagagactcaaagagacacagctattctcaaatcatggacattatgtcatgcatacctattaaaatgacagcctgtgtgccatggtgctaagtgtgaaatgggctggaggtacaagagcctgcttccttagaagaaatctggtcaaccagacaccagctaaaagagacgaaaatatgagctcatggggcttcgtctcccatatcttgtaatttaaacttcagtaatggaatgaacagattgtggaggagacttacaccgcatgggtgctggacagtcattgtaatagtagcatattccacgttgtgaaaaacagagatgataacagcggagcatcctgctctccctttaataaaattcccccgtgctgctatgggcaggcatttaagtaggttaacgggacacgtttaaaagaaaaattgtcacagaagcagggggcattctcttcttagaagcagaggaaggggggtggcggcacaaacaatcagtcctaaagaacgagcactgtttcaggggagacaaagagagttggaaaaaaatccaaaaggtgtttctcactgttagaaagttaaaatcaaaatgcagaaaatgaagtggacagcactaactttagtatctatggagagatgcttccctactgaaacacaggctcttacttttggttgagctctagtgagacaccaaggcctgcagaggttgaccctgcagacacccctttgtccctggggaagttggggttgaggggtgactgaggaggaagggcaggatccagcatccgagagctccatgcttttggggtcactggtcatgtgcattagtaatgggccctaccagtctcccgctggggggcctctgagtcagaagaagcagagaggagagaagagtctggaccctcacaggtgcttgtgtttcatcagcgtcagatgagccaaaaaaggtgctcactgatgaaccgtcctgaattttacaagcatgtcttacctgtgttttcattgatgatcggtgccctcgggtagagaaagttcagggaagaaacatgattttttttaaagaaagaaactcgatttcacatgttgatttgaggggtcttgcattaatcacagcttgtggcactgccttgagccagagccacactttccagcccagtctgcctgctcctgctcctcctgtctgctcatctgatttctcagaagcccccagtcatttagcgggagcaggggagagaggcagcggagacaggaccagagggtgatgacagccgtgtggactcagtaataaatgtttacctggaagctgcagattctaaaatcaatactttataaacacgtgcaattatgccagtttttcacacatgtatgcaaggtgagcaaaggtactaaagaatgatgtgttccaaattatgccctgtccaaagatgaaagaaggaaagaaaggaagaaaggaaaggagggagggtgataaggaagggagggaggaggggcttatgactgatgttattgaccgtatgctcttatagttattctcaatgtttgtaatgatgttacctctggccatcacatcaactttgcataaaaggtacacaaaaaatacttcagcgtgaattgtagtattcatttgaagtgttttgtagtaatcattcattcattcgacatattttaattttttaaaatatttttaattcaatcatttaatttttttaacagacagggtctcactctgtctcccaggctggagtacagtgaaatgatcatagctcactgcaacctcaaactcctaggctcaatggatcctgccacctcagcctcctgagtggctgggactacaggcttgtgccactgtgcctggctaattttcctatttttttttttagagatgggatcttgctatgttgcccaagctggtctcaaactcctgggttcaaacaatcctcctgcctcagcccccacaaagtgctggggttaacgaggtgtgtaatatactttgggtgatggtcacaataggcagtgggtttaggtgctttgccctgaggacatgaccagtcaactgaggcccagaccagaagcgaaatgaagccacacgatggcaggaggctggagaggagagagctcagggggaggaaacagcatgtcaagtgaaccacgttaagaagcatcagagactttcctcttagacctttggttttctttggtttctgacctgccatcaaaaggctgcacttcacatgggtgctggcactatttgtagcgtgtttcgagaaaataagtgcctgtgaagccagggagtgtccggtgatgactcgtaaagctcactctgtaaattcagcggagtatttaactcagggacagtttcttgctttttattagtggctctattgagctttctgagaaacagaaagaaagaggaaaataacggcatacagatgtttatttttgaaaataagatatagcatttgtaccgcaaggtaagtggcctgaaaagctgaatatttcaaggattgcattatttcacttcaatgtagaattttttttcctgaaaagattttagtttcctaaagaaagtatagagctttgtcaagatgtttaaattagcaattaaataatcaattaaaataacacgccattccttaagtcgggtacatttctgccattatttaatttttttaggtttctacactgaaaggagtagttactgccttacaattcagtgtttagaagtcggtgctaattctaagtttctgactaggcaggtgtcctaggctcttccagccaatctggagtgtggcttatgaagcataattattctcaagacttttcattaaataatgtgaacacacttacctatggaatgtaagctttgctacattgtatatggaaagacgaagatttcagatgggcttggttctaggagggcaggatggtggctgtgctttggactgtgtggaagttctttccctgtagtttttacagggggtagaggttatcaattgtcccacttacacagtatgcgcagtggcttcctcggtctcttccttggcctctatggaaatgcacccgaacagggggaaggtcagcttcacagtgagtcttttccaagcccatcttttccccctctggaggtcacactgaccttgaggaactgcagttccctctttccacaggtttgttttcttccttcgaggcagcagcaccctctgccctgcccgctccgaccacatcaaagaccatggagttgggtacacagcagtcttggggtgactgtggctagtatgaaactaggagatggatttgaatctcatctcctcttcttgtcaaatacgagtctttgggcaaatcatgtaacaatttccggatctgtaaactgaggatggtactagttccagtgttgtgctgcggccagacatgtgtgcctctctcccaactttgagttcagtgagtcctgtgggagcctgagatccgccatggtgggagtgttgacaccaccagtcaatattacaaagcaggtgctttttgcagggccgtgtggagggcctgggtgggcggggcaagagggcagggccattcgtacctttatcagcacctcgctgagtagttcgtacctcttagggtcttggagagataattaaggagatacctgggggatacatggggagataaggagatacatgggggaaagcagatacatgggggagatgtattaagatgtattaagatgcattaaggagatacatgggggaaagtccacagtaagggctcacttcctttattattctcctctttcatttcctcttttattccaacacgagtcttcatgaggctttccaaacttttgaccatgctttgatgccttggttgtttgaaggcatctgttactttaacataattttaacactggaagacagagtgtagatcacctagacaagttactgattttctgaagaagaaattgtagcacagagaggttgagtaattaatgcaagcttgcacagctattcttaggtcaagaagaggtggtcagtctgagttaaagctcacgactcccagttcagcaatgttttcacacatcacaccacgccacccgccaatcctgctgtaattagttgcacaaaaaatcaaatatttacagaaatataaataaatgaaaaaagttaccaatttactccccaatataaaacattttacctgcaatctatgtgtacatattgaatgatgtgtaacaatatcataatttttgtgttctgcattttttcacttatatatctttatttaaatggacttaactttattaatggagtaatttttagctttcagaaggagttctcactcgaagataaagaacagctcgctaaccacgaaagaggaatcgatgctcagcttttagttgcacttcctaaaggtaaggctgttcctaagtgaccaaccatgtctgggtagatgcgtattgtgttgtccgaatttccttgagcagaactctctccctaacctccagcttacagtctcctttcggcccttcctgcctcctcccagaattagcttcaattcccttccccctctctccatgcatccatgcatttttaatcctcacctttctactccttcttgccctttaattttaggcatcctcaggttttcgccagaggctgggtgtggcgggtgagacagggaacataaaatcgccctgccctcatctctttctccgtttaaccttctccaagggcagtgagttctgaccatacccccatttcttctctgtccacccactcctgctgcctctggaggctgccccaggccttacggctctttttttttttttttttttttttttttcttttttttgagacggagtctcgctctgtcgcccaggctggagtgcaatggcacaatgtcggctcaccgcaacttccgcctcccaggttcaagtgattctccttcctcagcctcccgaatagctgggactacaggcgcccaccaccacgcccggctaattttttgtatttttagtagagacagggtttcgctatgttggccaggctggtttcgactcccgatcttaggtgatccgcccgcctccgccttgcaaagtgctgcgattacaggcgtgagccaccgcgcccagccagggcttttacatttaacatcttgtagcttcctgctgagcggcgaacagcccgtgcagactttatcatgagcatctttcttcttccccaaggaggcactcacacgtgtttggtgaattactatttccactggtcaaggcgcacatgcggtaaaatgtctgcaccaactataaaccaattccccctagtgttaccagtgaaatgatgtaaacattgattggtctttgtaactgtaacactagcacaaggaatgatcattagtctcagctcacaaaatgtcttcatcctgactgagctgtggaaaccttccagtggaagaaacagatttgatggaagggcagattttttctactctgaaagaaaaagcaaaaatcatgccccaaagaaattagaacaaaaaacgtattcttttaatagaaagtaaatccagtaaaaaaaagtcccactgacgaattggaatatatcctgaggaactgaacgggtgataggccgagacacagtctgatgagggtgaatgtctgaaagactcaggggatttggcctggtgaaggaaacccagacagagacatgtggcaattttcaagaactgacaacgctgtcagccggaatacaggtttattctatgttgctccagaggccaaaagtaagaataacgtgtagaattacaaggaggcagatgagatttcatatcaaaaagaaaattaatcgttcacggtacctggaaatgaggtggtccacgctgtgctcgcatcggctctcccccagagttttcaagggcaagccagtggcctcgtgtccagttaggacgggtgcagatggggcatggaacggctgtcagatggaatggctctgccaatgtttaggactctctgtgaaagacaaaaaaaaaaaaaaatttcctctgagccaaactaaagtgcttaatacctatgcagatgatcaaaacaaagtataagaatgaacaaatccatattagcaatagctgagaaaagtttattaggcaaagttctacatagcagaggttgtttccaccagtcagaagcatccctctttcccttcctctatcccagttcctttatttgatgcataataccgcagacaatattatgagcagaaaaatcaaaaacaggatgaaatgctgggttccttaaggttcaacaaatggtaacttcatctgtaataaacttttagaacacctaagcttattagccagttgtattaaaaaatttgtcataaatgattataaaaaataatttttacaaatcaaagatgacgattttatgtgttcaccagattggtgtttctaaattaacatggtccctaaatctttaaaacatgctttaaaagtgccagtgccccggctgggcatggtggctcgcatctgtaatcccagcactttgggaggccaaggcaggtggattacgaggtcaggagatcgagaccatcctggctaacgtggtgaaaccccgtctctactaaaaatacaaaaaattagctgggcaagtcccagctactcgggaggctgaggcaggagaatcgcttgaacccgggaggcggaggttgccgtgagccaagatcatgccactgcactccagcctgggtgacagagcgagactctgtctaaaaaaaaaaaaaagtgccagtgccccatgtcccctgaatttcacctaaattctctacagtcttatttcacatatctttgctttttatgaaaaaaataggcagatttggaaagaccagcaatttcattgtttctctgatttaacacatgtatcaatgattttgtgtgtcagctcttagcaatattatgttaaaaaaagatttggttataattttattttaatgacatcaagttttatgtgtgagaagtttatggaagtctctttctgttcatttcctgtgaaaatgggcattaaagtggttgttactttttctctacgggacttcctctgtgtatcacaaacaagtaatcaagggattaaaaatctttacctatgtaacgtttataatatttaaaaagattttttatttaggaattatgaagtggaccaaacgtattactccactttctttagcaggtttattaagatacaacacacatccatgcaatcctatcatttaaagtatgcgattacgttggttctggcaattcagagttctgcctccatcggcacagccagttttagaacatgttcatgactgcaaaaagaaacctacacccttcagctgtcacctctcccccttattcctctagtttgtaattgcttggtttatgagctgcttgtctttatattagtggctgccatccaagagtaaaagttaaagggctttactcctgtgggaagtaagatcagaatattccaaatctggcctgggctcttgagctgtcgtgtgaaggagagaagtgttcttggcagtacccctgccacttatatttctttggaagattctactgtactcaagtttggaggactgaactcaacaatgtcttaaccagaaaccttctgtttcttagagctaatggaagaaactatgtttcccaagaaaagcaccctgcagaccaaattgtctagaatattggtgttatatagtcttattgcaaagcctattaggtggttgtaaataactttatgaagtattatagctctgctatcaaatttccttaaatcgccttacttgaaaactaacctccagctcccatcagaaataactaaagaaatagactcacagagtccagattgccacagtagtaccactccgaattactcaaagaagagtaacagaccaacatagcaggtaaaataagggacaggtggatatgtttggaagtcctaatgtatttgaaagcaaaatagaaaatgtctcattaaaatggaaattagaccatcgatgtttatttatatctggattacataataactactattactaaacatgaaccatatatgaattataattatgacacagcatataatcaattgaattgtagctggtgaacctaattttgaaaagcattcttattcttttttgttaagaaatacacactgaagaatttagagatgaaggggcctcatgctgcaattgactcaaatggttcagaaaaaatactatgtaaatatgtatgtgtatgtatgtacatagacacatatgcacatgtaaatatacttaagagaaagaagaataaaaataaacccaatatagtaaaatgttaacatattgtgaaggatatctcttacattttctgtacgtctgatattacaaaaaatttttttgaagttttaaaagaacacaaaccttcaagattttcaaccagaaggcaactttggtagaactgtaggtaggctttataaataaaacaacagcgttacaacatagatttccacagcaatggtgactttcatgcatgatgtttttagtattggctttatgctattaatagtacaaaaacatgttttatatgattaataatataaaataatataaaacatggtttatataataatataaaatatataatataaaccatattttttatatatatatatatatttcgaggcagaatcacactctgtcactcaggctggagtgtagtggcacagccttggctcactgcaacctctgtctcccgggttcaagcaattctcctgcctcagcctcccgtgtagctgggattacagatacatgctaccaggcctggctaattttttgtatttttagttgagacggggtttcatcatgttagccacactagtctcaaactcctgacctcaagtgatccacacacctcagcttcctaaagtgctgggattacaggcaggagccaccatgcctggctattattattaataataatataaaacagatatgtaatataatacacattaattatattacatgttagtacagacatggggaaaagaggcaaaactcaaaatgtctctctgttgcttctttttgtcttgtacatcatttcttataatcccgtttctgtaggaatgaggcatatcttggtaattaaaaatatatttgctagaaagaatagactgagaggtcatcatttgtttgctggggagacttttttattttccttttaaaattcactatagattttcactaggaattaataagctcaccaatacatttaaaggacaatttaatttataagctcatttaattcctcagtgaaatgatcagagaggaccctaaggtgtcccttcaagtacccactatgttgatggattctagcttccaggagcaataggcttggcatagctttgcgttgaatctaggcttgactgaaaagagtgcagtgctgggctagtggcgtctgtactgtgtaacctagggcctgggtgtctaaggcacaggctgtgtatttgaaattctagtactggggaatcagtgattctcaatggttctcaatttagggcagtccctaaggggctttagaaatatatgaggatatttttgtgtcacagcaaatgggggtgatttagcatcactataagaacctgggacattcaacatcctgcggcagagctcacagcaaagccacttcccattcagaagccattagcgcccccatagtgatctgggagctctccagagccagcctcctgagcccatgaccctgatgaggtccatctgtgtgtctgctagatcctatcctgagaatttctcgttttatgcccagaagtggatggctatcagagggcagtgttcactggaagggcagtaggaaagtctacctttcctgtggacaggaggcttgcacagtctcccaactagatctttctttctggaatatgggaaatagaaaatagcaggaagcaacatgttgctttgcttttccatgcactgttgtaatctttttttaaaatgcctttagttgcatttctatagaaaaattttaaaattaattaaaatttggatgaaatgaaagtgattttcagcagtctctaattagaaccaagaaaagtctatcttaactttttccagtggaagttacatgatactcggtttattaacggttttgatacttatccagttgaaataatgtggggcaagaaaagggacatgttaggccaggcgcggtggctcacacctgcaatcccagcactttgggaggccaaggcaagcagatcccttgagcctaggagttcaagaccatcctggataacatagcgaaaccccgtctccacaaaagacaaccaaaagctagccaggcgtggtggcacatgcctgtaatctcacctactcgcgaggctgagttgggaggatcacttgagtctgggaagttgaggctgcagtgagtcgagatcgtgcctctacactccagcctgggtgacagaatgagaccctgtctcaaaaagaaagggaggggggagaaaagaaaagaaagggaaggggaaggcaggggaggggaggggatgtgattatgctactcaggaccctattaatattttctatttctcagttagggtttgaggcatgggttcaagtcgtaccttttaggcacccttggaatttggttttgatagcttcttgagtggtcttttgaaaaatagggctccactttcctctttggggtttaaataattaaaaccctttggtttttgtcatccttgaaaatattttcaaaatatgtcctaccagccattaaagttgtatcaccataatcccactagggctaatttgttgacagggaagctgttgttattgaccaagcctcctctcccaaggccgcatggcggggtgcaccattctcattatacccctgtcttctaaataggaacatgattagaacaaggacttctctgcctccagctactctgattcctggggaggccaactgggagacctttttgaagtcagagggagagaggttttgtttttttgaagccggctatctcaacaaaagccaattcaactgaagttttaaggtggctatcacttaaaaataaatgaagaaaaacaaggcttctatccctgaacacaaagggcaatataaaactttgtgtgtgtgtatgcgtgcatgtgtgtgtgtgtagttttgactcattactaaaaattaccacttagagaaaagaaaatggaaattgaagcagtcaaacatcaaattcctttgagtttctcctgtgactcagcctttcaaaacttttcattggccctggccccaggctgtccagccacccctctctctttctcccaccccattctgagtccttcataggagtcactcagatgcgcccttatgaatttaagctattgaggaggaggcaaaaagagagacctttattctccatgaactttggccatttctccaaagaaacagttgtctggcatctcagtaatatccttgtagtcagtatcatgtgagaatctcccaacctcagcacagcgtttgttctgtttctccagtgctgccagaaacattggggtaattaccttacccatcatccacctaaattatagcaaggaaaccattgttaacatttgcttccagtgaaagcctgtgcagggaggcggaggacctgtgttcatctaaactgtagctaattgaagcggccactttaggcactgctggaaacacaatcagatagttacagccattgacaaattccgtgacagggtggaggagaagcggctgtgagttcatgcttgtagcttgccgatggccctgtggggttcacactcctagtctatacttctgtaaatgatttccataatagaagcttagaatactttgttaaatcaaacaaaagttagaaacagttgctgagatttctgcctaaaatactttcctagagaaagcttgctcgtcaggtctcccttgattcccctagatgaaataaaaccttctgccttaccctgtaggattttacttcttagccaacctatatatgtgacatatacgtgagtcacatagctaggtgttacaatatatatacaacaaaacattctatttaaattattttaatgtatgtgattttaaatatattacatatatatttcatattaaacagtatgttgagtgagcatgtcttagctttgccttgataactctgtcatttttatgggcatcaaatattcagcttgaccttagaagaggatgatgcgtcctagggtgtgtccatgtgtgtgtgtgtgtgtgtgtgtgtgtgtgtctgcacactcttattcatttggcatctgcctcccctactaggaaacagtttccaagaaagcaggaacttggtcagttttgcatgtcactgtgacataggaatcaagaactgaaatttgcagttcaataaacacgttgcatgagtgaataaaatgagcgcacgactactaaatactatattttgttcttttttggttttcttccagttgcagaattaagacaaatctttgaaccaaagaagaaagaattcttagaaatgaaaaggtaagatctttatagtgggagttaggaagtagaagagagcttggcaaagcagtattccattttcctttagattcgatcgctgttgctcactctgcctcttgtggtgtatttcacagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggtgagcgtggagctgggtggcccattttccagcaggctgcctggctggttacgagttgccctttccacccagtggtatcagaacatgagatattccacagaagtgaattgtgtggatataatttttttagcacaaggtttcactctgtcacacaggctggaatgcaggagtatgatcatagctcgctgcagccttaactcctgggctcaagctcaagggttctcccgccccagcctcctgagttgctgggactacaggcttacaccaccacaccaggctaatttttttttttaaacatttttgtagagacagagtctcactgttgcccaggctggtctcgaacttctggcttttagtgatcctcccaccttggccttccaaagtgctgaaaatacaagcgtgagccagtggacttggcctaattttttgttaaatgtatttgttttttgtttatttttatttttattttttttagagacagagtctcactctgtcacctaggctggagtgcagtggcctgataagctcactgaagcctcaacctcccaaggtcaagtgatcctcccacctcagcctcccaagtacctgggactatgagcgcgtgccaccatgcctggctattaaatagatttgctaaaaacagcaacaacatgtatgtcatctctgccccgcctcacggatctggccttccatgtcacagcagtatgaaatgattcccctcgcacattgttgggtaacggaggccagtcattttcctccctagactggggccctcaaaggcagaagctgtgtctttcttcaccctcagggcccagcacaggatctgtgctctaagataggggcctctcaaggttctaccccagtacagggagcggctgctctcagcagggagcgctagagtcaaagctgcaccttgaatgagtacggttcttactctggagatgcaagaaaactttctatctaagttatcttaatgtagataattttaaatacgttgcatatttatttcatattaaacagtatgttgagtgcacgtgactcagcttttccctaatcactcagtcattgttgtcatcaaatattcaacttgaccttaggagaggagaatgcacgcagggctgctcttcccaccacagtccctggctctgaggagctgtgctgctgctttttattttttttatttaattgtattttatttttggagatggagttttgctcttgtcgcccaggctggagtgcgatggcaagatcttggctcactgcagcctccacctcccaggtttaagcgattctcctgcctcagcctctggagtagctgggattacaggtgcccgccaccataccgggctaatttttttgtatttttagtacagatgaggtttcaccatgttggcgaggctggtctcgaactcctgacctcaggtgatccgcctgcctcggccacccaaagtgctgtgattacaagcgtgagccactgtgcccggccatgctgctgctttttatagccagtgttttctagtttctagctcagagacagctgttgatctcattttatgatgttatcagtttgcttgtctctacagtttccaatttcctgtggccagaaagctagaaaactaagatattttaaaatcacatgcaattattgaaaaaaaaaaaaaaaaggctgggcttggtggctcaacaccagtaattccagcactttgggaggctgaggcaggagaatagctggagctcaggagtgcaagattagcctggacaacacggccagactccacctcttaaaaagtaattacacgcttgaaatatcaatacacagatcagagtcccaaaatttatagccagaaataaaccgtagtgtacccgaaatggtaatctgtgtagtatatgtgaagtttaagcttcacatagtagtgagaaaaggaggaattatttaataaaatcataatgaaaaaaatgggtttgccagagggtgggaagaggcatatctctcttctcaattcataccaaactccaaaattagttccagttactcacctgtttagtttaaagaaaataatggaaaagatacatgaatatttaattcaggtggaatgaaaaaggccgtatgggaagggttaaggtaataatggaatgcctgttagatagactgttaggacccttaaatgatatcttcaaaatagatttccaaatatgggaattttttttttttttttttttgagacagagtctcactttgttgcccaggctggagggcagtggcatgatctcggctcactgcaacctctgcctcccgggttcaagtgattctcctgcctcagcctcctgagtagctggaattacaagcacgcaccaccatgcctggctaatttttgcatttttagtagagacggggttacaccgtgttggtcaggctggtctcgaactcctgacctcgtgatctgcctgcttcgtgatccgcctgcctcagcctcccaaagtgctaggattacagttgtgagccagctgggaaaacatttttatagaatacggaaaatatttttatagaacattaataactaactattttataaagaaaaaattatattaactagaaggaatatataaaaatgttattagtttgtagggtgatgattgataggtttttttttttgttttgttttttgagacaaggtcttgctctcttgctcaggttagagttcagtggcatgatcgatcatagcttactgcagccttgaactcctgggctgaagctatctgcccacctcagcctcctgagtagctggcaccatggacatgtgccatcatgcccagctaatttttaaaataatttttgtagaggcagggtctcactatgttacccaggctggtctcgaactcctggcctccagccaccctcccacctcagtttcccaaagcgctgggattacaggtgtgagccactatgccaggctcatattagatatttcctacaccaggcatgtgtgttataactggggaaaaaaaacacttctgtaaaaaagaaaagcctggtgaataatgatatgggccatatcgttatggttactctcagatccccggaaaccagcatccatcacttgtccaatgacggcagctcacttgtctgctgtctttcccagaggacccaactcatcctatggcctcccacgtgaaatactgaactccacaaaaaagggtaaatcagtaaggggaaataagcactgaacaaagactgaggcgctctggggagtgaaggggctgagctgaagttaaagccacgccttacggggcttgcagaacgtgcaccattcacagcctttgtagatttcactgccgatctcagacttcttcaacagcccaggtaaataatcagtttaggcaaacacacctcggtgagaaactggtccttcacagcatgggcacccaggtgtgtgctgtgtgcagtagagtgtcattctgtgtgtaaatacatgtctttacttgaaatctgcacctctcatccatgtgaccttcttgtaggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgctagttctctgtaccccgggaccgagacgatggggctcaggacctgtgccggtgaatccaaggactatgccctccatgtgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccaggtaagcatccagtccacgctaagcaccctgaacgcaggacaataccttctttttgcctctctgtgtgatagggtttggctattctaagcattatgtggaagtcaaggcttattggagaaatatcatagtatatgattcttttttttttttttctgaagacagggtcccactctgttgcccaggctggagggcagtggcactatcatagctcactgcagcctggaactcctgggctcaagcaatcctcctgcctcagcctcataagtagctggaaccacaggcacatgccaccacgcccggctaatttttacatttttttttttgtagagacagggtctccctccattgcccaggctgatcacaaattcctggccacaagagattctcttgtttgacctcccagtgcactgggattacaggcatgagccaccgtacctggcctaagattcttacatttcagccatatcaaaacaggttctaccaaagcaggaagcctcatgttctttttctttgtgcgtttcttatgtttttttttttctttttcttttcttcgtaattcttttttttttttttttttatactttaagttttagggtacatgtgcacaatgtgcaggttagttacatatgtatacatgtgccatgctggtgcgttgcacccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttgtttttgcgatagtttactgagaatgatggtttccagcttcatccatgtccctgcaaaggacatgaactcatccttttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagaatgatttatagtcctttgggtatatacccagtaatgggatggctgggtcaaatggtatttctagttctagatccctgaggtttcgccacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttgtttttttttttgtaaatttgtttgagttcattgtagattctggatattagccctttgtcagatgagtaggttgtgaaaattttctcccattttgtgggttgcctgttcactctgatggtagtttcttttgctgtgcagaagctctttagtttaattagatcccatttgtcaattttggcttttgttgccattgcttttggtgttttagacatgaagtccttgcccatgcctatgtcttatgttcgttttaaaaacaaactgaacaggtgtcatggggacactttcatggactcctcacttcaggaccctcttactgggtttctcacacccctttcatagtttatcttttcgccgcttttctgtaatcatatcagagactgatgattgttggtgactgcttttgttgctgtgattagaatcacagagcagaagaagcaccactaaccagtggaagcatctcagtgcagagcacagaagtatgactgcaatatacacgaaatagaactagaatgcctagttctgtaagtatatcacacactaggacacaggtatgtgtgagaaccccgcattatgaagatcagccattagaaaaccactgtgtaaaaggatccactcaagataagagcagctgccatttggagaaattgaaaaaggtatgaaatcagaaagtcagatcacagaagagaatatatgtttacttccaaatttaaattttaaaagtgtgatggctatattaaaagtgcaatttacttaactgtcctgcttaaagctttggggtaattgtctaggtggatcttaagtgtatttctcagttcaaacaagcaatagtttcccaggtgaattgagaagggatcagaacctaaggtcagggagattcattctgaaaaaaaagattcatatgtgggaaacacccctatttttttcccactgggacacaggggtgcacacctggtcatctctaagtggcagtaacacatatgaagcagacccttgtggtactgaaatgtattaacccaaagacctgtcaccacatactcgagcatccagactgaaatacttagagagatcagcttccaacagaattaaaaggtagatcccaaggatccattttgagcaccttttttcagcctttagttttaactggaaatgtagggactgtgagttactgtctcatattttgaaatgaaggtcttttgtttgaggaatttgcatttcatcgtagaaaccacgttcttggtttagttactttctaccaaaggaagttcttcctgtgttttgcaagtaggatgaagaacctaacagactccaatttaaaaagaatatcagagatatataattacactggtttaaaagaaatggggaatctaatttcagattgccacatgatgagagctgttgaagtcgttatcacggtatctgagttagtcacctagatcacatataatagattctcaaatagattttaaatcagttataatagtaattaagactttgttgagcatcccaagtaaagacaggatacttcatatttcgtatgagttaaaatcttaatattaaaaaaatgtatataacttgtcttaagacctagaaaaaagcattgttgacatatttaggcctgtaataaaataaagccacttctttgtaggttattttgaagatgcatgttacctagaagttttcataagccaagccttagcctcacagcactttactttcatgaaaaagatttaaaagaattaagaaattgtaaggacttctagagaggtgcatgccttattttctaagccattaaaggtatacaattctatgattcacaggcaaagaaacccaaagtagtttatatatttattaggaaaatacctgggacatatttacataaagagggatggaaaatgtgtgacaaatttgacatttaaaaaaattaagatttacattgtaatgacagcagtgattcaggttgtaaagattgatttacagtggattaaaattctgcttagatagtctttatctagaaccaggaaattcaactttcagaaagtcattttctgattcctatttagggagaagtaagatgaaccaaaaaaaatatgtggtaacccaaaacagtaacaaaagaaacctccttggtgacctaaataactgtatatgaaaataataatgtcatctgatatggaaacatgtaaccgaaaactttaaaatcaacaagtgaagacaaatagtacccatgaataatgtttaatgctgtggttttttgtggatttttttctgtcactaaaatggaatatttttctcactgctgcactctcttgtcatctagctctgccaaatttttggctattaaatctctgaatcaactcattcccatttaatcattttgttctgtgctcgctagcaagaggctgtcttattatttaaatacgaatacgatgacactcatgaatataccatcaaaagaccaccaatagtgtcctaaatattcaaatgtgagcaccatctccaatgctcagtttttgaatgtgctcacgtacattaacacctgtacacatctgtgtatatatacagaataatcattaattcttatacttcactatactgtactcattagcattataggcaaaataacagtctttaggacaatatttacctgaataatacatttattttacaattctttagtattcagtttatatgataaagaagattttttaaaaaatagttaattgattagttgatattacaggatttttaactcagaaatcctgttagatgcccaggaattcagttggacacattgctctgaagaaaactaagaatacacatagtaacgaaataggtgaagtagaaaacaataagatacttccagccccacctctctaactgttacaaacctgtaaacttgaaatttcagaaatggtattatttgctggagaggtagtgttactgattatgaaccattctttattaattccaccactgtgagttttagaataaaattaaaagggatttaggtcctatggattattcagatttttaaacacctgagcttgagcttctactactagaaattccgaatccaaagctcttgttgaatttgttactttatgcatctcacgtatctatataaagaaaatgtgctgtattttttacttttatgagtggagaaactcactgtcttcagtcctgctgttgcctttgctgagcatccggccatcactctctgttctcagggaactatgtgactggcaaagggaatgaaatgaaaggtagacctcattttctttctttcttttttctttttcttttttttttttttttttttttttttgagacagagtctcactctgactccaagctggagtgcagtggtgcaatcttggctcactgcaacctccacctcctgggttcaagcgattctcctgcctcagcctcccaagtagctgggactacaggcatgcgccaccacacccaactaatttttgtatttttagtagagacggagtttcaccatgttggccaggatggtcttgatcccttgacctcatgatacgcccacctcggcgtcctaaaatgctgggattacaggcgtgagccaccacgcccggctggtagacctcattttctagtggtgatccactctagaaaaccctcgtttattagttttgtttgtcattactgtactgcagcccctcaccactcttttctctttagcaaattgtgtccttagtagtgagaacatgatatggaggtttcatgcagagctgaggctgacattggacccctgggagagttgccattggtggatgatggtttgggcagggctccccatggatgccagagagccgccgatcggctcaggaaatagaccagggcaccctctggaatgcagcttctgtaacaacttgacacggtgcagcctcagccactaagaaaggaaggggcttgtgctgggcacttggagtttatttctgattgcatttgctcatctcctgatgagagattttagtctaaaaaccgtctccagagcctcaagctctcttggctcagtggtctgtttccatgcactgagagaggtgtctgcaggagagcatcgtgcttgaccttccacgctctcgtgtccactagcaggcaggttttctgacacaggctgcggaattcaggacagtgcatcatggagaaacatacatcttgggggccattctaaagaacagacatctgggtcctcctcacagcttattctattactggaatggaattggcttcacctttcagtccctgtacccccaaacacctgtgctccctgccatactctagaatcccaactgttaaaatagatgggtaagtcattccctcttttttttcatttcatcctgttcttattgtcaagtgacaattcttattctttttttttttttttttttttttttagaaaaggtctcactctgttgcccaggctggagtgcagcagtagcacaatctcactgcagccttgacttcctgggctcgagcgttcctcctgcctcagccttctgagtagttgggacttaacagatgcacgccactatgcctggctaatttttgaattttttggaagagatggggtttcacaatgttgcccaggctggtctggaactcctggtgttaagcgatccacccgtcttggcctcccaaagtgctgggactacacgtgtgagccaccgggcctggcagactattcctattcattggactaaatgtaaatatatctccccaaaccctagctactatgtacactagctaaaaactcaaaggtgtgtgagattttaaatgcaaaatttttccttgagcctgtgtccttgcagattttgtacctgtacctatctgcagaacggtcattagcagtttttccaaacaagcgacttttagcaaattaaccgttaattttaatgagattcaaaagttaatagccattcttaacgttttataattagaagctgttatataattagagctggacacccacatggagaaactaatttgactgtgctgcatttgacttcactttggtaacaggaagcactttttagtctgtagacccttgggagttgtagggagttaaagctgatcattatatactattatatacttagggatacaacccaagggcaacccctggcctttatgaaaacctggagtgagttattatttcctggtaatacaattctctgccagccagttgctgcatcaaaacagttctgatacacacacctaaagtcaccacttcctcattctggtccccaataaccctataagcctctccccttgtaggtgacctctgccctgtgaagggttggctcaccccaagattccataaaataagttgtctgtttgtttatgagaacaaggctttttaagtaccatatgtaatacatgcatataaatgcatgtatttagatcagatttctggaggagggattgtaagtttgatgactaaaggaggcaggggagaggggagagatggaggaggaagagaggtaagaaggagggggagagagtgcgagagaacaggatcatgtaggcaagagagcacgtgtacccggaacaatggttagaaactaacaaggtgaaatttaatgaagtcttgaatttagatggaaaaaaaatcagtgcacaagttcaagattgtggaaacctgatttaacagcagttcgtgggaaacagacctaagggttttagttgacagcaagttctttatatgactgccaaagtgattagtccaatcttgggggacattaatgaaagtgagttgccaatagcataggtaggcaatggtccccctgcgtcctgcagtggtcagattacatctggatatctctttctaatagggccactgacaaatgtgtccagagaagagtccaccttcccatctgccctgctttcttgacctttccaggttgttttgttgtgttttggtaacttctctctctcttaacccatgtatgcccgaggttgcaattttttgaatttttgcaatcagaccttggtgctgtccttgagcagtagaatataaataactcccacttgcttagcattccaataatggaacactaggcataaatgggctaatagaaactgggaccatttttggagtcacttccactttctgtggtgtttagactctcgcaccagtctgctctcattatcatatcgtgagtttcccagagacagagctggagcttggctcagcttggcaaacagagccctgatgttattagtttggcttctgggttgctgatgattgtactggaagggaaaagaggagaaacaggtcatgagccaaatgaggagtcccacagatgccacttcacaggcaccctatgtcataggaaggatattcaaatgtccagcacctaacgggtacaaaaagtagttagaaaaaatgaataagacctgctttgtgttagcacaacagggcgactatagtctaataatcgtgcattttaaaataactaaaagtataatcaattgtttgtgacacaaagaataaatacttaaggggatggataccccattctccatgacatgattattacgcattgcatgcctgtatcaaaacatctcagataccccataaatacgtacacttgctatgtacccacagaaattaaaaatttaaaaaaaaaagacaacaaatggcaagcaccctagatcatggctgtcatacccagaagaggattttagcaatttcgtaaggattttttccagacacggcactgtgaatttggtgttaagctcttctgtaagtctggtaaggatgattgcagcgatagcattactttagtagaagctttaagagatgagtagataccttgctctagtcattttcatatctccttcactgcaactggaatatccaacaatttcaagtgacctagaaaatcatttttgaatgaatgttctgctattttctgtgtttgcttaaagtgtcaccaaactatagcagtgctgtttgaaatagccaatctgcaaactgtttatcagcacacaactatgagacactcgcacccaaatgcaaattgtgtttggtttccttcattgagaaaatcaagctgtgaagaaaacgtcagctgaactacacagcaggcttagcgatgttgttaatttcccttctggtgacagccttttgtctaatcatgcagagggacaccaatcagtggaacgcactgtgagcagcacttgtttatacgacaaagctctttctgctttgtctgggattggggttcttgtatgtggtcttgagtcaggctgctcataaatatcattaaacagtaaatgggaatcgtgataagtgagcagaaaatcatcggccacttgtggagcgtcgtgaactgagtccacagccccgcgaatggctgattctagtctagtctcatgatgaaagctgtcaagtccccgattaccttattctaggagtgatggttccaatcaggagatgaggggatgccaatccagcctcgcaccttcctcagattccagcattttctgacaattgtgctttctgcacatacctcctccctccctcctttctgggctgcggttacagcattcaggccttcactgagattagctcaaagggagactggaagaaattggttatctcacatgtttatcctgcttctgcccccagaaaatgctacattttcagtactcaagaagtccttactctgtaacccaacgatgacatattttttaaatgaggtataatttacatcaaatacacagattttaaggatgcagcttggtgagtttgggtaaatgtataatcatcatcccagtcaggataggaaacatttccatcatcccttgtgcctctgtccaccagaattgattcttgaccgcatgtgcaaagactggtatagcctcacagtaagtatcctgtgttcaactcattatgttgtataaagcaaatctcccactgttaatttcttaaccaaaccttatttatcaaaaataattaagcgtaacatttaggaagacttcatgaaataatgtcacacaagattaaaagacatgaagagaaaataaaagaggaaaataaccaccataattcagatgtgatctctctttttgttcatgttttttaaaaaatctcacctgctattttactgtctctccaaaacaatgccctgtgggcccctgaagtaaattttgtactttgatggaatgaaatattttaaaatctcagttgagcatcgctttgccaacccctcagtattatgatcaggctgcgctgctccaaggtggaaagctcagtccacaaccttccactgcctgactcctttgatttgatattgttcattggagaaacaaaggaagaaggtagttaggttctgcagaattcataggtaatcgggtaactcttctgacggtggaaacggcactagagagagatccacatccagtcagggttgtggctgtgaccaggaagttcttggtgtcttccttgcttaaccttagagtccatgaacactggcatcccaacctcattcttacccattcaagccaaggaagcagccattttccagaatgtggaagcttgtcactctggaaggctggaaggaaggtgcatgctggggggtcctgctgcactgggtccaagccccatccttctgttaccagtcgtgtgatcgtgagcagttaatgtcctttttcccttgcacctcaccatctgcatctataaaatggagacgagaagacctcttagagttgctgtggagattatcattcatcagttaatcattccatgagcatctgagacctactgttcaccacacatagttccgagtgccgaggagatgaatgtgaacgaagtctctctctctccagaggctgtcacatcctagcgaagagagagggctgtagcagaaggggcaggtggtagggatgatgttagtgagaccacagatcggggagggccttagaaccaccgcaagggctttggggtttgccctacttgatatgttgagccctaggagggtttgaacaagaggaatgactcatctgccttacatttcaaagcattatgctggctgctaagcggaagatagactttagtggggccaggatgaaaacaggtagaataatgaggaggtcatcttggtaacgcacgtgagaggcggtggtggcttgaactagaatgatggcagcacaggtggtagaaagaggttatattttgaaggtacccaagagaacttgctgatgaggtaggggtggggtttgaaagaaacagaggagtaaaaagcgagtctcaattttttggccaaggcaactcgaagcagggatttggcatagggaagactccagtacaagttgggacagagggaagttaagagttcattttctgggcatgtaaatttaagacgtctattaaatatccaagttgaaatgtcaagagcaccctggggctgtgtatcgtgggggtgaggaggagaactcagctaagaagtctgatgggggagatgggagacagaagaggggagtgtcgaaagtgtagatgctgctgcacaactcagaagtggctgcattctgtgagatcattgctacacagcgcccaggacagcgtgttcactgttggtgtctgatttaggcgtctcctcatccctctctcattttcatttcagatggcagataacctcacccaaatacatgtcatagccaacctcagggatcctgaaacccttacttggagaaatgcttttctagatcactcctgctttaaatgtactaaagacaaagtcaggccctcctggtgaggctggactcaccctgctgaaaatcgcatgacttctgaattgggtctccataagtattatgtcttcaaagcataaaaagagaaattcataaactttcattgctgtgttgactgtgaagaaggaaaaagataagaaaagcatttaaaaggcttattatgtcctaggcatgatgccttcacatactttgtttgtttatttatttatttatttatttatttatttattagaggccgagtctcactctgtctcccaggctggagtgcagtggtgcaatcatagctcactgcagcctcaaactcctgggctcaaaggatcctactgcctcagcctcctgagtagctaggtctacagacacatgccaccatgcttcactaactttttaattttttaaatacagacagagtcttgctatgttgctcaggctggctcgaactcctggcctcaagggatcctcctgcctcagcctccaaaagggctgggattacaagaggcgtgagccaccacacctggcctctttgtttcttattacatacatttgtatttattttacagatgttcctcaacttagaatggggtcgcatcccaataaatccatcataagttgaaaatattgcaagtcagaaaaacaaaggaaacattaagtcaaaaattcacttaatacacccaacctaccttagatatgctcagaacactcacattagcttggatttggacaaaaccatctggccatgcagcacactatggagatgggtcgttcccctcatggttgtatggctggtggcgatctgggagcggcggctcactgcctctgcgagcatcgcaggggagcatcgcaccacacaccaccggcccaggagaagaacagaattcacaattccaagcacaggctctcctgaatgcctatcacttccacaacatcttaaagtcaataaatcttacattgaaccattttaagtcggagactgtctatatactcagactttgagtattcaccaccctggtggtagtcctttggtttttggctggtttcatatttcaggtgtaataagcaaatggagcccagtaagtcccctgtgtctgtgtgggatttccattttataaatgctgagccaacattcttacacaagcccttgatggagtttgacggtgatattgatcaaattttattcttgtcagttaaggtcatgttcgaaaagttgtattgcacttcttttacaaagccctctgttatacagaaagcattcagcctaaacataaccctgtgaaggcggcagattcgttataggaacttgatgtcatttccaacagcaggcgtctgctggcccctcttgccctctgcacactggactgagttgcactgccttcgttcctggctgcaggcgatgcgccaaactcttcccatcaaataaaagttgatgaattggaccctttatatttggaaatgaaatgactttacatacatcttaactttttatttgctgtgggcaaaattgatgtgatgcagaggatggggaggtggggtgatagttttaggagtagcaaggctgaaggatcttactggagaaacagatcagtccaagcctagaccgagatagaggtcagtggttacagcaagacgtacaatagcggtgccaggtacctgcctgtcccctccaaccaaaactcaaaccaaaatgattttagaaaattaagttgattataacttttattttcttttagaaatttctttttgagctgcaatgtgtttccagcctggtgttgaaaaattcttgcagataggctcataaagttttgagctggtaaacattgtaactagcctgtagaatttcctttttttctttctacattgtaagaggagacagggcagtaatctgagtgttcctcctttgacttgctttatgttgttaaaacaaggttgtccttacccatgatgtttctctaaaataccttcagcctggtataattactcgttcatattctgcttggcatcatactcagtcgtgtgttgaggaatgaatgtgtggactatatattacctagcctacctgcggtttaaggtttttaatggctatgttgatttatgattcattttcgtcgttccttagctcattacttgcacttactaggagctcaataaatatcagcagaatggacctgaattagtacttgtaactcttgtgttggtcacattattcagtgataattttaaaaggaaaatgtgtaatagcaactaaaaatgtgatcccattgacttattttattttatttttatttattttaattatcttctttatttgaaatgtgttgttttacatagatgctatttttatattaggctatttaccaacgtgccactgcaaaacttatggaaattaaattaccttttacttttagtcagctgcttacaagagaattgcctggtatttgtgggcagagtgtgactataatagactccgttcttttttttttttttttttttgtgacagagtcgtgctgttatcgcccgggctggagtgcagtggcatgatctcggctcactgcaacctccacctcccaggttccagcaactctcctgcctcagcttcccgagtagctggaattactggtgcccactaccacacccggctaattttttgtatttttagtagagatggggtttcaccatgttggccaggctggtcttggactcctaacctcaggtgatccacccaccccggcctcccaaagtgctgggattacaggcgtgagccactgcacccggccaacagactcctttctaataatttaaaattacttgggaaaacacatgatttgatggccttagatacatttatttttacctcttgattttagtagtgagccacatgtcctggaaactccatgaagtgaatatgaactctatagcaaaatgtgcttatacattttcaaaagacagaattattctttttttccctataatattcctgtttgtttatttttttaagttttaatttaggttcaggggtacatgtgcagatttgttatgtaggtaaattgtcacaaggctttggtgtattaaatattttgtcacccaggtaataagcacagcagcccacaggttgtgtttccatccccgccctcctgcctctctcctccctcaagtgggccctcatgtctgctgctccctctttgtgaccatgtgtactccatgtttaactcccacttataagtgaggattattcttaataaaaatcagcctttaggttttaagttatggtaaagtctgtgtatatgttgacgttttaatagagattatctggttttgttttttgtacacaatagtacagggaaacccaaacatgagtggtttctccagaaagattccgaaggggacacaccttcacttatcaactggccttccaggtacccgcacgccggccctctggggcttgtgtgcatgagtgttgcttcctcctgcctgaccacacatcagctaacacccactctcctcttgccttctttaataccagtgcacttgaaaatcacgtggaagttactttctaatcatttgcttttcccctccacatgccctaatccatgctaatagtatctctccttccccctctttttcaatctttgtcaatctttcttgattgacaaaccttttacttgaccttttgcttttcccttctcaccaactcacataggactggccagtgaggggcagtagtgagcacccagccaggccctgggctcctttccatagctggactcgctagccggcgtcccatctgctcagcttcccactgctcccagcccttccagcctccttgctttcatatctcctcatctctaaaccagtagttaattttcaacagttaaatttagggcatgtggttttaaaagcaaacaaaaccccctatcatttcatttttaagactgggggcagggagaggcggaaggagtcagaatgagtaagtcatggaaggacaaagctccacacacagagtttctgacagtcactttgttcttggctgaggacaacattcagattgtctctgatcaggagcacgcattccacaggagaactggaaccgcgcttcagtctccttttgattaacaaacgttttaagtatgaaaacctccaacactggctcatctctgggaaaaataacaactaagaatgttttctttccctgagttgttcatagttaccacctctatgtgcgtctgtgtggattgtcctttaatgacacatatatagatacactgcctcgtacgttaaaaaaaatatataggagtttttatcaaatttagcagggtgcacttgtcattaaataaactattcttttccatacagtgcacatcataaataattacttttgccaattaagcttaagtaaacagtctaaattcctctccccgcaagaaatcccttttcccactccaaaagccctctttgctttttaaagctgagccctaatcagttttccattctcaagtagttggaattgtgtctcctttcccactacatggtacttcaaaaaccaaaaataagaactagataacactattaaacatttactctttgctaagcactaagccacgtgctttgcaaatatcacattacattatgtcactattatttccatttaaaaggtaaagcaactgaggcttactaagggcaggtgagttgcccaacactacacagctcaacctgactgagccaggatctgagcagaggtctcttccaaccccacagccagagctcttggtttctttgttttgcagtaatggaaaaaggtctgtagcttttgaaaaggatgtcagttttgctctcagatatttgaataactttagaaacaactggagcaatctctctttatttttattttatttttgttttttagggacagagcctctctctgttgcctatgctggagtgtagctgtacaatcatagctcactgcagcctcaaactcctggattcaagtgggcctcctgcctcagcctcctaagtagctgggactacaggcacacgccactgcacctagatattgttttttacttttgtagagacaagatctcactatgttgcccaaactggtctcaaactcctggcctcaaatgatcctcctgcccaggcctcccaaaaggttgtgatcacaggcatgagccccagggcccggcctctcttttgggattcatttttaactaagagcataacagcaggacagggggatggtggtgggaaatgttcacttcattagttctgtcagcaactatcttttctctaacattcttttggtgctagaattattcataatgatgcccagactggccacatgccttctgaatgaatgaatatactctgcattgcatgaaaaagcttgtgaatgtctagttgagtgctttaaaagagaggtgattgttgtatcttgaactaaataaaaagcataaataatcgtgagtgctcttacattttcagacgacaatgaaattacagcgtttggtcaataggtgtctgtatgccaggaaccttcccccacagtccgtgttctgggcgtgtacatgaggaaagcttactgattcaagggaccaggctcattatgccctaatgcatgctggtggtggatattaacgcatttttctgtggcttctgggtatttatttagtcagaagggacccattctcccccaggatagcatctgacccctgccagcttttacaggggtagagttagttttgcacctcctgggcatacatatgcaaattggaaactcaactcaggatcatctgacaagtagttgacattagacaccaaaatgctttttcacaagttattctctctcaggtcagtttccattcactggtaatctgtgatctacgcatgctttcctcctgtgaggccgttactgcactttgcaacttaaatcctttttctttcttaaagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctagtgacgccagaaaccccagaaaatgcatctgagtgtagctgggtagcatcagccacccagaatgtccccaaacctcccagcttgacggttctagaaggtgacggaagggatagcccagttctccatgtctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaagtctctgtcgcccagctccgaagtgcgttcctggcatctgccaacgcctgcaggagacctgaactgtaggtgatgcttcacacgccctccagctgtgtcacttgcacgtccctggcagaatgattcactcctcgacctgtgttgtgttctgcattgaatcatattagcttagctcacaagtgcgtgcagggcgactatgcggaaaatggctcaaaaactaccactctgcttctgcctactaatggggaactagtggattgggtgtctggaatgtctccttccttacgtgcatggtagaggcatgaagaggggtttggtggtgtctgtcccttgactcacggagatgcataatcctttgccatcttctctttctctgtcttcgtttgccttccttatactctctgccctttgattctcaaagcaaatcacgggtggagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtaggcatgcgtatgcgcagtttcctcatccaggaacgtggcaatgacacaggagttttaccacactgacggtcttgacgctatttatataggatgttggcgattccataattgttccatctaacctataagcgttatttatttggcttatttaaaagtctttttaaagaatattagcctttacagcggtattatgatacatacacaattttacattgcattcagatgataagaagtaagaaacattatttttctttatttaatggttttaatgttttttaccccttgttaaattagactccagattgcatattcaccagattttacagtgaaaataactgaggaattttatattcattttataaatgtccatctacttgttgtatttgagttttatactgaagtgtcatatactattgcatagaaatggtaagatttgtctggaaaattgtcatcagtggtgtttaacaagttgttcttgtgcctggtctctctccacggggtgtgtacttggctgggattgtgtgcacacacgctccacagtgttgcttcacaactgtatgtgtgttttcacaactagaattgctaccaggaggttatttcttaaaagaatttaattgcatttttatttttactttcagtatgatgttttatttcgatcttctgctcccacctgctaatgtattattgttatttgctaatgtctttcctaggtgcacttcacattcagaaacgccaactgtcgatggcaagtacctgtttcccttttttttcttctttattatctcatctagactggatttaataataaggtttttggctttttgagagagtaagatgatggagcataacagtgtctccctttgctgcaggttttcgttctgtggatatgataaaatctagttgaaattttcagacaagctttcccttctttttgagagcagttagagaatcatacagtgaccaatgtaaaaacaactaattcaaaccaaaggagcaggttcttcttgttgttgctgctgctactatttaaaactaaaagaaattccccccataaaatatattcatgaaatctcgatcagacaaacgttagagtagaaatccctggacagagtttgctttggtttggctgggttgaattgcaagggaaattagtaccttttcactgagcagaaagaatgggctccctgcaaggggaaactaccaccaattattattttagtgcacctattgttgtattcaaagatttccaggtcagccctgaaagactttttggagaccgaacttaaccttctctaatgatgtccagtttttaatttgtggctttttgcagatgaagaaaaggtggatgaacgagccaagctgagcgtcgccgccaagaggttgcttttcagggtaagctgtgctgacgtgcttgaatagagatccctactgggtgcagtaatcccagctatttgagaggccaaggcaggagaatcacttgaggccaggagtttgagaccagcctgggcaacacagtgagacccccatctcaaaaaaaataaaaattgtaagccttagggagggggaatcttgtggacccagcctacttcatgcacctctgggcatgctaaggccctcctgcctctggcccacctgttgttctcttcctaatctttggctggttgtggccacctcatggacacagcatgagtgtacacttctgacaacaatacgaggtgctcattagtgacccctcctgtaggtcctgtaggagaacaaagtgaagaatttttactacccccatttcctttccttgaatttctttgttatttttaatttttttttagagatagggtctcactctctcactcagggttgagtgcagcaatgtgatcatagctcactgcagcctcaacttcccaggctcaagtgatgttcccacctcagcctcccaagtagctgggactacaggcctgtgccagcatgcctggctaatttatgcattttttgtagagatgagggggtctcactttgttgcccaggctggtcttgaactcttggcctccagcaatcttccctccttagcctcccaaagtgctgggattacaggcgtgagccaccgtgcccagctctttccttgaatttataagggttccacaatacttctaatcttaggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccacgtaagtgcccacaggacttctcagccttgtctatagtgtctttttttaaaaaaatacatttaaagagtgttcaatgaaaatgaggcattggggaggtgatttagctagaagccacagagaagttagtactaagggattttgtttactgtggtctctctaaactttgtaatgggatgtgtatcttctagaaaaacttgaaaggagtttttgttctattttgtttctgtctctgcatattgatattttaaaaatctctttgacaacggaaaatagaaacatgaaacttggtggattgctgtgatgaaaccccagcttccacggtcacccgctcctggccggtgatgctcagcccgtgtgccattcatttcccctttcctcctgtgctattttcaagcaaacactagaggtcttaccatttcatccataaatatcccagtacgcccctctaaaagataaggtttgttttgttcttaattgccagaaatctcttttctttttttcttttttttttttttttttttttttttttgagagagagtcttgctctgtcacccagaacggagtgcagtggcatgatctcggctcactgcaacctccgcctcctgggttcaagcgattctcctgcctccacctcccgagtagttgggattacaggcatgtgccaccacactcagctaatttttgtatttttagtagagacggggtttcaccatgttggccaggctggtctcaaactcctgacctcaggtgatccatgcctcagcctcccaaagtgctgggattaattgccagaaatttctaaaaattaaattgcagtttgataactttccaaacaataggaagtttgttttgaataatatgtttcaatatattcagaattaatttcccagagtagttcattcagagatcattgcttcaatcaagtgaaaaattttcttatttttgcggggggcattgtttgtttttttgaggcagtgtctcactctgttactcaggctggaatgcagtgcgccatcttggctcattacagcctcaacctcctgggctcaattgaccctccaacctcagcctcccaagtagttgggactgtaggcccaaccaccacacctggctaatttttgtattttttgtggtgatggggttttgccatgttgcccagtctgatcttaaactcctgggctcaagcgatcctcccacctcagcctcccaaagtgctggagctacaggcgtgagccactgtacccagcctagttttgttgttgttgatgttgttaattggttttgtgcttaccttggacacacagacacccttcctggaaaaaaaaatagttcatcccattaggttattgacatcccaaaaggcctctatgtcagtgccccgttctgtagacctgctgttagatcagctgcctacagttcctccccgagttgttcctcagtttcttggtgcatttgtagctaagtatatccttgcactcattaggaactctttgcaaatcagtttgttttttaaaaaaagaaatatttgaatggctggtgtaaaataacaggcagatacccatgggagcaaaacagtaaatataagaaaaattaatcccattttaaggctcaataaatctaccttgatgtgcctatagattgtataagaacactgatacttttaaaaagtagattgaggccgggtgcagtggctcacacctgtaatcccagcacttagggaggcagaggtgggtggatcacctgaagtcaggagttcaagaccagcctggccaacatggtgaaaccccgtccctactaaaaaatacaaaaatattggccaggcatggtggcgcacgcctgtaatcccagctactcgggaggctgaggcaggagaaatgcttaaacccaggaggtggaggctgcagtgagccgagatcgcgccactgcattccagcctgggcgacagagtgagactctgtcaaaaaaaaaaaaaaaaaaaaaggctgggcccagtggcttacacctgtaatcccagcactttgggaggctgaggcaggtggatcacgaggtcaagagatcaagaccatcctggccaacatggtgaaacctcatctctaataaaaatacaaaaattaactgggcgtggtggtgcgcgcctgtaatcccagctactcaggaggctgaggcaggagaatcacttgaccccgggaggcggagtttgcagtgagccaagatcatgccactgcactccagcctggtgacagagacagactccatctccaaaaaagaaaaagaaagaaaaaaattagattggaaacaatattctaaaacacagacataatctactgattttttgatagctaatatttgcttttttgaattattattttttttacaccaagacatgtattctcaagacagagtaaatcctcccagctctgaacacctattcttaccccatttgctttgggtagccactatctcttatttcctgagtttgtatttgcttttgaagttctttcgtgattttttctccccaaaaataattagcaaaatattctgttaaaatttttgatttaacgtttctgaatttaaaactatgctgtccttaatgcttcttttcttctctctccttatgaatgtttcctctttggcaattgcttttaaagtgaacctatccccgcttcgtgttctgggggcacccaccctgtaatggcgagacttcctagccccactgtagctaggagcgctgtgcagcctgccaggtactggacagatacagatgcatgcggcacccggtgcaaaggtgccgaacagcagatgcatcctaaagtcttgaatgtctgtcgtttgtttgacaaacaagtcaatgccgtgagttgttccagaatgcgtggcattttgttttgtcatagcacaaggtgctgataaccacatgctggcgtgcgtgggaaaacattttgtctctctgcatatgttatgtgttagaactaggatcacactaactcacgtatccagttgctttgtttgtttttcataataatggtcatccctcaaaaattttgttcttcatctaaatactgttatagcacttaataaagattaatagaaaaatgggacattggccaggcgcggtggctcatgcctgtaatcccagcactttgagaggccaaggcaggtggatcacgaggtcaggagattgagaccgtcctggccaacatggtgaaaccctgtctctactaaaaatacaaaaattagctgggcatggtggcatgtgccagtaatcctagctacttgggagactgaggcaggagaatcgcttgaacctgggaggcagaggttgcagtgagtcaagatcgtgccactgcactcccgcctggtgacagagcaagactctgtctcaaaaaaaaaaaaaaaaaagaaagagaaaaaaagaaagaaaaaaaaagaaaaatgagacattaacctgaatgttgaaatgctgataagacccagtctttttcaaacacctgtagacacaaatacagactgaaaacaatcctccctctttctaatttatagagtcaatgccattatattttgggactgggaaaataacaatttgtagtgtctaaacgtagatgttttactgtcgtgtttcagattgtggtgctttaaaattatgtcctcacatcaggtcatatcccttcattttactgttatatgagccaaaccgcaaaagctaaaaataatggcagtgccgggataaagctggtacacccacagcagggccctcccggagaagtgggtttccctgccctcctggttactgcacgaggtccacggaggactctgaggctcaggtggcttttttgtcactggcctcattatacacctggaatatggaagctggctactctttggcctgggatagcctgtgcattggggattcactagaatcaaggcagaatatctcctttactagatctgacaattggatcggtcagggacagaagatatagtgcattacaaacccctagagattcatattgaccgtgaagacttcaggctttccttctcttctagctggaagttggagggagctatttatttatttactgatttatgtattcattcatttatttttgagacagagtcttgctctgtcgcccaggcttcatcactgcacactgcagcctctacctcacaggctcaagcgatcctcccacctcagcctcctgagtagctgggatcacaggtgcacaccaccaagcctggctaatttttatattttttgtagagatggggtttcacgatgttgcccaggctagtctccaactcctaaattcaagtgatcctcttgccttggccttccatagatatgagccaccagacctggccagttggagggatttataatcacctgaaattttctttactcctctggttactggaaattgcagatttaagtaccttttagaaaactggtaggaacctatgagagtaaatgctaagctgaagcagtgactctttaaaaattaagccatttgtctttagcaagtaaaaatcaagaccttctgttatgttgttgacagaggactatatcgtttcctaattatttaaaatgaaagaccaccttctgaaccatatctttagataaggtctaaatacaccgtaggtaatactttgtgactccctttcattctacttattacgatactaacaatgccgcctctctgtctaagataaggtatagccaagctgacttcaatgtcttaaacaggaaattcgttttgtagaaataattcggagctcaaagtctgctctttgtagaagtgatgatgctaagtgtcctgtgccgactctgcttgttgagtagctgaacagctgcctgcctctgtcctagacgtgcttagggaaaaagaagccctttgcaaaatgatgtgacacttggcagaaagttaacgtagaaacttagcggtgtgcttttgtttgttggtatatgtgttgctgacattttatttttttcagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgggtgtgctatagtccgattgcagtttgtgtgtgtgtgttcttaaattatagcactgcagtattcctctgaggtcaatgatgtaattaaggtgctctaccaggaaactgctacctgtaggtgatttggtaatagctttcttcctaaaaatgagaattctaccaagtatgttgctctttttttgttttcataccttgcttgctgaaatatctagaatgagtccattttggagagaaaaaaatagtatgcccaactgtgtttcacccagaggattttgtttaatgagacgtattatataactatgtccaggaatggttttccactaagagaaacagtgaaactgcatcaaatcgagtatttcagcttctgtcaattcataaaccaggatttatatagatgatatttttcaagcagctttttaatttttaactgtgtccttccaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagaggtaagtgaccagtgcccctaaagctttagaaagccactgggttttagtttctgcttgatttgtcctgtgtctatgatggcttttaacaaagttctataggcagtttacagctagtattggttaaaagttcagcgggaatcctattcttccctggatctgactagaggatacatcaagttttcagcaataaaactactggaagagctttcacacatcttcatggagtttctgttgactttggtcactcacacaatggccttctgagctgcttagttctggtggccccttttagaaattgatgaccccaaaggtccaggctgggtaagcacaaggaattcaggaaagacttgaccccagtctctgaatcgctagagtgcttcttcctgcatgcctgttttgcaggctagcaagctacactgcgtgggcccttcatcctctttctacgtttgtatgaaacagtacagtgtaagttataataggggtttgcgtttgtgagtatagcacatttgaatgttaaggtattattttggagaatagaaccattctggagtaaatagttaaagctgacttcctgtgtctcgcacacaggagagaaaccaattgccacgaagcattttgctgtgtgggtaaccctccaggaagtttggttttctcacagagtgtagcgtgctgcagatttgcataaatcccagtggattgggtcacccgccgtgtgcccacggattgaaccctgagagctgcactgttgagggcgaatcgctggaagaatgtttgcctgaggagttcagtgctgatgttgctcttttccttcccagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaaggtaatgagattcggtgagcgaaaagtaattctctcggggaggagcttacagcttgcttttagaaaacaatctcggtgatgggcaaagagatgaaatcatacattcagcttctaacaggactgtgctgttgtcctggagtaattctaggaagctgaggtgtttgagagtgaactgcctttgctcatgagcctggtttggtaatgagcctggtttggacagggctggttccagactcagatgagaaaacaaacagaaacagacttctgttttatttatttgtttccactgtcccaatatcttttataatattaaattcttggactatctaatgacaggagctgaaatcttggctcttccccttttagatacacagggttcatactgaatgcacaaaccacttgtgactttgtgtaaaatatgtgtagagggagtgaagataaatttacatagagggcatatatctttggacttagaatccaagttttgtttcttttacagattgtaaaatggatgacttttctgaactgcatttagaaattgtatgtcaggtaatagcttgaaagattgcatttcagcatcaaataacacagtagcctaatttctttcaaaagaatgacgtagggtgcagaggaatatatttaaattagacagatacagagaactggaagtaaattaccttggggatgtgttttccttgttaacccttaaccacagatgaattaagcagcaaaagatgcaatagtgggaataaattcagagtttgatagcagagtagggtgactaaataaaaacgtattgtactgaggtgatggacattctaaatagaggcttgatcactatgcattttatatgtgtaacaaaatttctcatgcaccacataaatttgtacaaaaaaaggagaaagtattcagtaggaaaaaaacatgatggaatagttgataggaaaactgggtgaagaaaaatcttgtcaactccatattaggagaaccatttccatcgcctgttcccacagttctgccaacctccacccttcctcagcacctcccaccacacggaagtctgcaggcttcactgaccactcttatttttctagatacatttcaaactgcctaagactatactaaaccacaatgaaaagtcttctttctttcttttccttctttccttttttttttttttttctttttgagactaagtcttgctttgtcacccaggctggagtgcaatgggatgatcttggcttactgcaacctctgcctcccgggttcaagcgattctcctgcctcagcctcccaagtggctgggactacagacgcacaccaccacacccagctaattttttgtatttttagtagagttggggcttcaccgtgttagctaggatgatctcgatctcctgacctcctgatccgcctgcctcggcctcccaaagtgctgggattacaggcgtgagccaccgtgcctggccccttctttctttttttttttttttagaggaatggtcttcctctgttgcccagactagagtgcaatggtgctgtcacagcttcactgcagcctcgaactcctggacacaagtgatcctcctgcctcggcctccccagtagctgggactgcagacacgtaccaccatgcctggctaattttttcaaaaagattttttgtagagttgggaggtctcaccatgttgcccaggctggtctcgaactcctggcctcaaacagtcctcccacctcagccttccaaagtgcggggattacagacatgcaccaccacacctggcccttctttctagttttaagccaagcttcttgaacattatttgtaaaataatagatgctatctttttcaactgacaaattaatcacattgttaaatctgacttactttctcctttacttacttaaaattcatgataagttagacctggcaggctgaggggcatagggaaggggcagaggggacagtgcaatgaggagagggatgtcttcaatcggggaagcagttgggcctattgaggcttgaagttctcttccacgaaaatggggctcaaagagagtttcatcccagaaacccaaatattgacaactggttaggtgaggaagaagagagatcatttaaggaaattaacaataaatatcacttatacacaagttctgatgttttacacatgagaaaatatccctggggtattccccagtgggaaatactaatattatgcccccttctttcaaaggcttttaaaggagccttcccatctttgggaatattctgtccatctggacttaggacttttgatgaagaagtcctgtgtctatccactaagcaataattcctgatttacttacctgttttttggtaaattttagttgacctgtatttttctgaaagctttaatcctactgtaaaattctcatttttaaaagtgagatactggaaagacgtagcttcttagcttgggctttgtggacatgtaaggcgttcaaggatggctgtaaagtttctgtgaacagcccggaagtgtattcagaattgaatgggtgagcacacacacctgctggctaacagaagccataacttatcatggtctccaagagatccctgagcccagtctgttcagaatcatgatagaaaggaatgcttgattgatattcagctattcagtttgttaaaatacatttatgaaagaacaagggacactttatttagcagctatgcttgtaataaattacactaatgcaaaatatattgccagtgatcttttcccccttaccttcacagtacttttatttgtactttgctgaaagtgactaaattacatatatttacaattcatccatgatagcttttccatgagactttaatccctcccttttgtgaaaatgaaataatgaagcttaaactatttaaaataagaatgttattcctccatttatttgggctttacttttccttcttgagaaagaaatatataaaatcataggacttccaaactttattctaaccgcctctgactgcctcattttaccaaaggagggattcggctccggtagcctccagggccacgtagtgaatagagctgacccaggggccacgtctccaactctcccctggtccatggtgagaccgcggtgcgctcagattagtgttagagcagccaaccccgtgtgctctaaccaggagaatacggtgagaggacagaaatcccagctagacagcagtgttagaaagacacaccttctttcttcatgaattttctcagttcacatgctcttaacagggcttatatttcaaattacacatccaagttcacatttcagagtctcagaaatagagtctggaatttgcagatttccttcatcgttttttataaatgcctgtccccactaaggagggcaggtctgtcttcttcagccttgttgtgtcagtctctcccctgtccagggcctgactatattaagttctcagtgctcagtgctacccagcgtcacagactgccttccacattttgtacatgatctctcatttaatttttgtctgtttgtttgttttttgagatggagtctcgctctgtcacccaggctggagtgcagaggcacgatcgcggctcactacaacctccgcctcccaggttcaagtgattctcctgcctcaccctcctgagtagctgggatcacaggagcccaccaccataaccagctaatttttgcatttttagtagaggcggggcttcaccatgttggctacgctggtgtcgaatgcctgacctcaggtgatctgcctgcctcagcctcccaaagtgttgggattacaggcgtgagccactgcgcccggctttcatttaatattgaagacagcctccagaagaaagcaatattatccccatttgtagacaaaaagcatagaaactaagaaattataggaaaacctccatacactccttttttagaatatgtttgatgctcaaggaaacatattaaaaagttatttttatatttatttatttatttgtttattttctgagacaagagtctcactctgtagcccacgctggagtgcagtgacacgatcttggctcactgaagcctccccctcctgggttcaagcgattctcctgcctcagcctcccaagtagctggaattacaagcacttactaccatgcctggctaatttttgtatttttagtagagacaaggtttcaccatattggccaggctggtgtcaaactcctgacctccagtgatccacccgtctaggcctcccaacgtgctgggattgcagacgtgatcaccacacccagccttaaaaaaattttttttcatcttttctgacattgtgaatgtcaaatttgaaccataaccagcaaaaaacttaggatgcaatcgacttttcccaccggattagtaaaattgctattttctgactgtccaaatgatgtgtgtttaaattatccctgtttgggaacttctttgagaaacattgcgaattaaataattcttatgttatttagggataaaacctttgctattgcttaaagagtatgttaggcctttagaaatcttatttccacaatgtcagaaacagtggcatctgagctttcttatttagggaaaaagactattgaaaagaaaaaaagagccatcctttcactttggcaaattggtggcatgtaaggacttagtggaactccctgaactgttgcagaatccacctcacgcctctatggtgttctgccctagagggaccggctggaggctcctgtgtttcccgcctgccggcccccgccccaaccatccacccttcggtatcccacccagccagaggctgtctccctgtctccacaaactccaggttcttaccctgtagctgggagatttcagccactagagggccccagatttatgtaggaataagaatagagcggcagttcccctttactccctccttttctttttctttttctttttttcttttatttttctagacagggtcttggcactgttgtccaggctggagtgcagtggtgcgatcatagctcactgcagcctccacctcctgggactcaaatgatcctcccacttcagcctcccaagtagctgggactacaggcacacaccaccatgctcagctggctttttattttttatttttatttttttgtagagacggggtcttgctctgcggcccaggctggtctcccacctcctggcctcaagcgatcctcccacctcagccttccaaagtgctgggattacaggtgtgagccaccacgcctggccctccttttccaaagtgtgatttgtctctcatttaaaagacactttagttcattcacttctccaacttgtgaaccagccaaaaccaagatctaatataagtacttaagtgtgctgttcatccctatcagagatctatggggtgcctgtaattctctaaaatgaagggaaaattctgaaaaagagagagaaaacacatcttatttaatattaggggcacatggttgtcatgtctcctgtttgacccagccctgactgctctgagcctgatgtccttgttctcaacaagcagggttctcaggccagcattccctgctggaacagtgtgggctatggaagaggaggcaccgtttccccgggtgtcctggcaggcacctgtcacggtggccctgggccaggcgttgggtgagcgggccagtgtcgtgcctctctctgggttcacacagcccaggcctagccactgcccaggctcccagcatcacagtcctgcaaacagcactttggcttggcagttgttagaagcgctgacagttgtttgaattgcaccggcaggaatttatgtcctgcgtaggcccagacgtcggctcctcgaccctctcagagcctggtggtctgcggtgagccggagggctgtgagctcacaggaggaagggacacatttgggaagatctccctccctcctcagcgtggtggacaccaatgaggaaatctaaagggacaggaagaacacactcaagttttagtgcgtgttattttcaagttattcgtcatgtgctccgtaggctggagccgagggctggctccaagtgccaggtgggctccacggaagcacagtttcttccagattattctggttactctgtagtcttcggaagtccccaatggtaaccctgccagcacatgtagaagcaaaatttcagggttttggaatggaggaattctttggaggccatcccatggtgggaaaaaccttataagaaagccagaatcctatgcctttcctaaaacggtgtggcaaaaatgtgtccggtcagctaatgttctaccgaagtgaaacaagctacacacaggcaggcgagggctgcagtcacgtctctctgcccactaacatccagtgtgacctcagtcaatggaattcttgacccggatgtacccacgttccttgtccgtcagaatgggaataacaattcccagtgtcttaggggtcgccgtgcagatcagcagagtataagatggacgaggaggtgatctcagatgccacagcttgtgtttttctaagtcagttttagatgccacaaagcaaccaccagggaaatcgtccgatgacataggtgctggtgtccttgccccagacttttgggagcttctttttgagaaggtcttcaaagaccagagctcatgacttttaatgaactcaactcaggaagatgaatttgatcttttaaaaattcatcatttgaatccaatctgattaacaaggtggatgttcaggaggagtagctgccagcctgggtggaaggtgaagtgagagaagctggttctgaggccagtttacagggagaatatcagtgagatgagtgcttggttccacaagatcatgaactggaaggacttctcatttgggtattaaagtgctggcatgcttactttttgaaagtctcatttattgatgctttgaaagctcaaatacagcatgcaaatatgaatttcttttaatgatttcattttgtgagattattttattaggataaaactgactcattcaaaataattggagaaaagatgaatcatagtcattatatagtatgaaatggtgcggattagagctcttgaaggaatttcgacttcgtgtccaagcccatgaactagctcttgtagcatgcagggtgttgttaaacattcgagaattacaggagttaggactaaatgagaccttgacccaaagggatctgcatgagattgacaaggcagccttaccccagttctagagattgagcacttgagatcttatctgctgccacttagcagaaagaggaaaacagaaatgaaggggggagaaggaagagattgaggaaggggacaggtccagagttcgaagctcctgcctcctttgggggattcctttcttcacggcttacttcccgttatttgactgagtgaatagacaaatacaaggtgtgattatgtacacatacgtagatgtcgccggattcttgtttaagtactacaaaatttgttttcttattagcataacaaaacttttatcatagaatatatctcatcccatctccaaaacaaatatttaatgggaatcgggaagcttggaagaaggacccttagagatcatctgaccagttcctgatgtgacagatataggagggagaaccgagatacccaaagggagtagccaaattgggaccaaagctgatgttctgcttaaaaatacactgttgtctaggcgcgctgtctcatgcctgtaatcccagcactttgggaggctgaggcaggggatcgcttgaggccaggagttcaaaactgccctgggcaacatagcaagcacctgtctctaccaaataaaaattttaaaaattagcctagtgtagtggtgcacaagtgtagtcctagctactctggaggctgacatggaagaattgcttgagcccgggagttcaaaaccagcctgagcagcatagcaagacctcgtctctacaaaataaaaattttaaaaattaaccaggcgcagtgatgcacacctgtcatcctagctactctggaggccgaggcaggattgtcgcttgagcccaggaattcgaggctgcagtgaaccgtgattgtgccgctgcactccagacctggtgacaaaggaagaccttgtctctaaaacaaatttataacaataaaaaatatttatggatttaatatttatggataaaaatatttatggatttaatatttatggatttaatatttatggataaaaatatttataccatttgtggattatgcattagtgatatcaataagacctggcccatcaggtccagcacagagggaaaaggatctaattatttggcttttccctactctttaaattgtttgagcatcggctcaaatgagtttagtgatcaccaccttttttttttttttttaccttttatctttcccatgtttgtttgtccagcgtaaatacctaagatttcttcattcatgcaatacagttagctgaaatagcctcaagtttgtgaaaaataacctttcaggattccagtattcaagcactgcctatcaagtcacatcatcattgagctaaagtaggttagttaacaatatcagttaattagattctttttttgtgtatatccttcccctgaggaaagttgaagtgataattttaaaaaatgggtttatagaaaatagtttctgtctaaagaagatggataagaatgatcaaattcatttgtaggaaaagaatagggcttagaacacctgaggagaaacagtcataaacatcaaattttacctctaattgaaagggatgatattaagagactgtaagtgcttcatggctttatgtttttgtttgtttgtttgttttttgagacagagtctcactgtgtcacccaggctggagtgcagtggcacaatctcggctcactgcaacctctgcctcccaggttcaagcgattcttgtgcctcagcctcccgctggctaatttttgtatttttagtagagatggggtttcaccgtattggccaggctggtctcgaactcctgacctcgtgatccacctgcctcagcttcccaaagtgctaggattacaggcggaagccaccgtgcctggccagctttatgtttttaagcccatgtctgcatcattttctgtaacacagctttagtcctttaatgttatttcacaagtgaccagaaggcgtcgctaaaagacatttttctctggggacggttctcttgctttcagcccaaggccaaggaacagacatccttggctggaatgatggtgcatcttttatctagcaagtcagatttcagctctgtgtttcaatcaactgtaaaatcttcgggccatcttagaaaagggactttattatttttccagacatgctgtcttccgaataaatgaaattcaaaatgttaaaacgaggcggctgtggtcatatcttggcccaagccgcctctcttacctagattatggttccatcacaaggaagagtttggtgctgaactctttgtggcgggcatgttttcctcctagattggcactgttgaagaaaagcggggaggaagattggagaaacagactcagcaggaggcaggagggcggcaaggcgccggccagcagcctgcacacccaggaagcagggcggtccctcatcaagaaggtaacattccccatgttaggaaaagccttccgactaacatcactcttggaagtgcatcaaaaagacaagcgtgtgccacctaattcctactctgtgaagcatttgtgcatttttgcccttagggtacacactgagagtctgtcacagagcagctaaaattgggcagaaggctgtgcctggagatgttttaaaactgggatcagcaacacacacacactatgtcagcaagcaagtgcctgaattttaaagtgtggactttttcttcagtttaaaaaccttcttaaatgaagtctggctttcatgtgttattaaagcctttataatgaaaaaaattgaattcaccactaatatctttaagttccatgtaaaatacagacttgtgtttcccatgcagagattttaaacctaagtataaaaaataaggacataattgtggtttatgagtatttagttcatcatttaagcgtgtttcatgagtagctatgccttttattgagaatgtacagtaatgtataagttgaaacaaaattaggtaatgcatggtgatcaatactagcaagcatttcatatgcgaaagtattgatgaattgttaaatcacagatgtgatgatgaccagcttttgaccaggtagtgcacacttttgaaactgatggtgacttacttgctggctggccctacaattgcaaatgcaccttctggctggaggcgaaatgatgcaccggtgacacactccctggtcactttctaggatcagaagtcttcaagtagaaaagaaaaagaatgctttcaacccgatgatccccaggccccttctagctctaaaataagttaagcatctgtggaagggagagatgatgagtgtgactttcatgcattaagaaacgtacataaaaatgagatgtgcacatagaagtgtgagtcaggagttctgacactatttcctctgatacttctgtgtcttcttaggtttcactggaatggcaatttgaattctcttctttgagacatacatggtgttaaagatgatttaactaaagacatttaagccttggccatttgtaaaattctcaaatataactagatatttagaaagtatatgcatgtgcatatttttcacacaccgtgtgaaattcagatttcaaaaatgtgatcctgaagtgaaaatccatctgtcaaattatgtatccctgctacccgcaaactttatttaaaagaatcttgaaatcattgcttcaaaaatgactttaacacattcctcattagcaaacctgccaactactatgtcctggcaccaagcagcgcctggccccttgtccatcattttggaaggtgcagagactccccggcccatcaggaactgggagtcccagagagccagtggaaatttaaatgaagccaaaaagcacgaagcaaaagaggttcctggtgaatagtgaaatgggtgcactgcccccttagaagaatggaggatcaccttaggtgtggaagccagaaggctttgagtggaggatgagatccgaaccacctgaacgctggctaaggtttttagaaggcaagagaggccagttgactgcagttgcccttggggttgataatccagtgacctgaagccccgggacttgcaagcaggctagggctggaatgggaaatgctgcctctgggcgcgtggaggctgctgtttctgcagacggtgaactctcccactcttctcagtggcctgcttccctttggctggagacaataagctctttgaagctaaaataagcggatctattttaggcctttgtagcccacactgggcaatctcaggttctgttgaggtcaggtgtttctcagacagcctctgacgacccctcggttcgttccttcccgagggctggcactgttttcagtcacccgccggctgtgctcagatgtggtgggtgaggcgccttaaacctggtctgtcttgagggattcccccagtagctgaggaggcttgacatgcccactgcttgcggggtgtctgaatgctgccttggagaaggacagacagtcatgacacgtggggcctgaacaggggcgcttgctgcacggagtagctctagccttgctgacggagaggtacccaggagagcaggtgccggaaccttccatctttagcaccaaaggcagaaaggagccggcgttatggtcagctcatcacgcccttcacggttcctacgttccttttgtgtgctgagaggctgctgccgtgagtgtgcagtctgtggaaatgtagaagaggcaggaaagagaggggactctagaagttccttccattgctcctgtgaaaacacgtgcaacatagaagtcagcaccatcctgtaaaaatagaatgtgtgccacacaggtcattttgaaatttccttggagtcacattaaaaaagtacgataaaggatgtcttgaaaaatctgtaactgttttgtttctgtcaatggattggtctcaaaagaaaacatatttgaggggctccagccagcatctcattttaggtcttttattatgttaagatttactttggagccaagctcaatggccgtgcctgtagtcccaacactgggaggccaagacaagaggattacttgagcccaggagttttagaccagcttgggcaacgtggtaaaaccccatgtttacaaaaattaactgggtgtggtagcgcacgactgtgatcccagctacttgggaggctgatgcaggaggatcgcttgagctcgggaagttgaggctgcaatgagcagtatttgtgccactgcactccagctcgggtgacaaagcaagaccctgtctcaaacaaaaacaaaaacaattttgggcctgtgaatagatattaagctggagttttcattccttttttttttgagacaaagtttcattctcgttgcccaggctggagtgcaatggcacaatctcggctcaccgcaacctccgcctcctgggttcaagtgattctcctgcctcagcctcccgagtagctgcgattacaggcatgtgccaccatgcccagctaattttttgtatttttagtagagacggggtttctccacgtaggtcaggctggtctcaaactcccaacctcaggtgatccacctgcctcggcctcccaaagtgctggaattacaggcatgagccaccatgcccagcctggagttttcatttctatactaaaagatcaagcacatctcagggaataggaaacttaccagcagttccttctttccccattttacacaccctccccccaaaatgaggattgatgatcaagagcttaagagcactaattgtttacctagctagttctgtcatttcctgtgaaaaactgtttgggtattctctctctctctctctctctctctctctctctctctctctctctctctccctccccctccttctccctttctctctccccctctttctctttctttctcttccttgctgcccttattatctttcacctgttcttggtatagtctaggccaggctaacctgacttaaacatgtgtgagtctcgtagcatatatacttggtctaaagacggtaaagctgtctgttttgtggatttggtctggtctgcacggtgtggtttatgtgcacttgagcatggcttgtgtacactttcctccagagtaactcattccaccagagagaaatcaaacgaagcaaagtctcaaagaagtggtttggcagcagtctctgttacaactaactttcagttatgtatttattttcaccaaatagttattttcaattccatccctatttcggtttattcgacgttaaggcacacacggtggctcccacgtcttttgtgaagatagtcatccagcgaatcagacattttccaagaagtgaaaaccctttatagacttggccattaaaaccctgtgtctgtttctgagttccagagggaactggatatcccactgtgcttctgcagctgtgaggtcagtgtatccagctcagatctatgacagccccagaacaagtgcccgaaatttcaagaaaggtgaatctggcacatttatatgctcagtgtctgctgccattgaaattccagatcatagtgcaggagaatgaagtcactttaaagtgcgaggatgggagggagagaaaggctgagggaatgctctctaaactccagatgatcattctgcggtcacggaatgagttggcctgaggttcacatcaccctattgtgtgagcacgtgcatgctgctgtttgaacccaggcatgaaatacttgaaggtgattgcgatgccctgaccaggctcttctcttccaatactctgccatgttccctgtttgttttaacctgtaggaagaaggaggagttgcggatgatagtgccatttctaatctgctttgggtaagcctgactctaacacaggtgtcctctcgatggtggccagaattacacttcgcgtgggtaatcctgatcctgggtggttccttcgtgcaccctccctggtgcttttcttatctccagaccagacacagcctttgtccggagtggagagctgagcccgtgcccttaaactattttttaatcatgtaatgaagatactttaaagaagatgatattttctgttaaatgttaaaactgtcaatgaaagtcatggttcctctctctgtaactgacaatcttctataaattaactcatttaattactgcacaaagctgactcaggtatatttaccgcgcttgtgtggatttactttagcattagcattcaagggaggactctcttgaaaagagaactgaaattgcaatgagtaaattaacattctgttagaaaaatcattgttttgtctctccctcccccatgtccctgcccggccccgctctgataaatcttctcttttcaccttaaaccctcttgctttgctctgtaggaacctgtatatgcttctacttattctcctgctattcctgctgcccataaatacctgtcttttgtgtcgattaatcaggtgaggaaaagccactcatcttaagcctcactgcaatttctgagcaataggaaaagaacttctgttttaattttgggaaataacttatttggtgcatttcactttgaaagagaggtgtgtgtgtgtgtgtgtgtgtgtggcagtacaattgtgtgtgtgtccatgagagtgtgtatctatgagtgtgtatctgtgagaatgtgagtgtgtgtgtctataagagtctgtgtgtgtgtctttaagtgtgtacgtatgtgtgtgtttaattggttcttcatatatttaggatcagtcacacacacactgatccttggctcagattttcaggtggactggatggcattaattcacctcgtagtcatgaaactggtttaagaggagagtgtcccctttcagcctctgagcttcgatcctgagtcaggagcccaggagatgcagccatgttcttcgctccagctcagtgaggatgttgtcctactcagttcatagaggaggaggatatggtggaggcagtttggggtgtggagggacagggaggaagactcagcgaggggaggcccctccagtgaccctattaaagaaccaggaggagctggttccaatggccctattaaaactagagaccatgggccccctgcctcttccctccatcctcactgtagcctctctgaaccccaccccagagagcagaccccagcctgggctgagccactgtgtgggtgaataacatgaaaaataggaatggctggtttcttttatttcaccgtggaatgtccttggtgtcaaaacaactctgcaaagtggcaccatccacttttccatgaatgccaggctcccatctcctccctgccgggctttgccccatcacttccctcctagggcctctgtcccttccctcctagggcctctgtcccttccctgtaggccctctgtcccctccctcatagggcctctgtcctttccctctagggcctctgtcccctccctctagggcctctgtcccctccttcgtagagtctctatcccctccctcgtagggcctctgtcccctccctcatagggcctctgtcccctccctccagggcctctgtcccctccctctagggcctctgtcccctccctctagggccttgtctccccagcaggactggggctttcttagctctcaggtggcctctgacagtgccgcgatgggcctgctccagcagcaccagcagttattgaatgagtggctcagggtttcacatgcgaagctgacagggaaggtgtctggggtcctcccgtagtcatctcgcctcttcacagatggaaactccccacttcttctccctggggcggcctttccctcactctcctggttccttcccccgaagctggaaatgctggttgtaagagcccaggccccacgtacccagccagtgtccaccccaagaaaggggctgaaatgtggagcaaacttcccattccatcacgaacgggggaaatgagcttgtgtttctttgaaataagccaatattaaactttaaaggaaaagatatattactgaagtctttaagtgtatacagtcggcccttcatctcttccagttccgcatccaaggattcaaccaactagggatacttgggaataaaatcaataaaaaagaacaatacaacagttaaaaaattaaaaaccaatacagcagaacaactatttacataacattaccttgtattaggtattataagtcatcacgaaatgatttaaagtacacagcggggatgtgcacaggctgtgtgcaaatcctaccccattttacatcagggacttgagcatctgtggattttggtatctctaggaggtccttgaaccagtcccccatagacgctgagggacaactagatatatttttcagaagaatttatttttttggagcagttgtaggttcacagcagaaagtacagagttcctgcatcatccctgccctcccacacacagccaccccaattatcaacatccccctccagagtggcacatttgctaccattgatgaacctacgttgacgcgtcattatccccaaagttaatagattacgttaaaatttacttttggtgtggtccattctttcggttttgacaaatacttaatgacatatgtccaccgttacactatcatacagaatcgtttccctgccctgaagatcccctgtgctctgcctgctcatcactctcaccgcccagtccttggcaaccggtcattttttactgtcacatggttttgccttttccagaatgtcattgaattggaatcacacagtatgtagccttttcagattggcttctttcatttagtaatatgcatttacgattcctctgtgtctttttaaaattttatttatttttaaattattatgattattattattatttttgagatggagtttcactctgttacccaggctggagtgcagtggtgcaatcttagctcaccgcaacctccacctcccgggttcaagcgattctcctgcctcagcctcctgagtagctgcgattgcaggcgcccgccaccacaccccaggtaattgttttgtatttttagtagagatggggtttcgccatgttggccaggctggtctcaaactcctaacctcaggtgatccgcccacctcagcctctcagagtgttgggattacaggcgtgagcctccactgtgtctttttatggcttgaaagcttttttctttgtatcgtcgaataatatttcattatctgaacgtgccacagtttatttgtctattaatctactggaggacagcttggttgcttccaagtcttggcaattatgaataaagtgctagaagcatccatgtgcaggcttttatttggatgtaagttttcaactcatttgagtatcaaggagcatgattgctgtatcatacggtaagagtatgtttagttctgtgagaaacctccaaactgtcttccaaaatgactgtaccattttgcatttccatcagcactgaatgagagttcctgtcgctccatatccttgccagcatttggtgttgtcagtgtttgcatttttgccatcctaattgatgtgtaataatgtcaccttgttttaatttgcaagtctctaatgatgagatttgcagatatgatgttgagcatatttccatgtgcttattttctgtcttatatcttctttggtgaggtatctattcagatgtttttcccatctgttaatctggttgttcattttcatattgttgagttttaacagttctttgtatatttggggtagtagtcctttatcagatatgtcttttgcaaatattttctcccattctgtagattgtcttctcattcttttaacagtgtcttttacagaagtctttaatttcagtgaagttcagcttatcagttatttcttctgtggatattgcctttggtgttatatctaaaaactaatcaccaaatccaagataatctaaatttcttcctatgtaatattctaggagttttatagttttaatttttacagttaggcttttgtgatccatttttagttaattttggggaatggtggaaaatttgtatctagtttttttttacatatgagtgtccacttattccagcatcgtttgttgaaaaatactatcttttcttcattctaatgtttttgctcctttctcaaagatccgttgactaaatttatatgaatctattattgagctctctattccattgatctatttgactgttctttcatcaataccacacaatcttgattgccgaggctttatagtaagtcttgaagttgactggtgttggtcctccaacttttttcttccccttcagtgttgtgttggctattctgggtcttttgcctctccatgtaaactttaagatcagtttgtcaatatctacaaaatctcttgctgggactttggaactgcatcgaatgtacagctcaagttgggaaaacctgccatcttaacaaaattgagtcttcttatccatgaacatggaatatatctccatatattgttaagtttaaaggaaattaacatttgccaaaggcatttctgtttcatcacttcaaaattaaaatttcaaaaaattatatacttttacctctgaacaatgtttcccagctaaatataaatagtttatatactgagtatgtagcactagctcatctgtgttttcagaggtcaagtcactccttttctttcttccagcaatactggtgtcttaatatttaataatacaaaggttcagagaagaaaaaaagcacacaggctctgtctaaatggactgtttgtctctgtgtcaggcttcaacctgaattctttctcacatgcctcagggctgtaccagaaaaagattttactttattcccttcctttcatcttaggagctggtagatggtgacaggactggaaaacacttactttgaggtctgagccttaacctgtgatcttttcttcatcttttattcagggtacttgagggtgtatgcagtgacgagggactgaaatttctcttaaggaaggggcaaagctaaatttctttcatagtgtgtagaatttgaaatgatcttagcatttttgaaaactgaaaagtacaactttgttcctttcaccttatttctattacttaatatgtgcttttataatttcttcctttacagtttaactacatgtgaataagataaaaaaaattttaaaagccaggtcacaatattttatttcgataaagctctctggttgtggaagagtttgacccttaaatccgccctaatccttataatacatcttagttctatgctctgtgttggatcacatccctgcgtgagaaacattgagtgagatttgctatgatttttcagtcagtgtatacagagagaaagaaacccatcagcaacatcaggcaacctaaaagtattcgtgctgatttgtcctttgcacagtttcaagctgtgacctaccaatatctgaccatccctaagacaagaacctcctttctacctatttcactgccttctacacacacacacccacccacccacacacacacacacatgtgcatacacatacacaaatactcaatttctcttccaccctctttttctgcctttccccaccacattcgtgggatctgtctttgaaagaatgaaggacagatggggtaggattctgtttagattcttcctcaactctctcttactattccagccaatcccaaacatgtgtcagctaaacctggaaaaatgacacaatacttattactatatatataacatccttctctaaacaaggaaagaaaaatttagaaggaaaaaaacaagacaataatgaagttttaagcttaaaaaaatcaaatgaacaaatatatatatcttctttgttctcacattttgagttctaaattgtgataaatatttattagattatttagagaataaacaaactgtatatgctttacacccttctagagccacgtaaagttgaattgcagcaattagggggtcctaagctaaccctactaagtagcaaagttaagtcaaaatttctagaaaacaaaaacatttatgtttaatattactattcagaagggagtaaaaattatttcttcttgccctaggtctggcaaacgaatgggagctttaaattctaaaatggttgtatcatcccaaagtttgtatccattgtgtgcataaagggctctgagggaatcccagtgctttgaaaaacgaaattttggatttgaagataccatttttctgagtcattatccacacccactaccccaccctggactgttgagatgcctgagagaattcaccacagagttgactaagtgaatagtgaatcaccacagtgatggctggacctttggagacgccaactttcttggcacttgatgtttcttggaaatatttgaagccaagcgccatcttggtttgattaaaattcactcctgaaacttcgttttcaaagaaaacgtattctctttgttgaattttgatgaggtctttcgggcaagtgaacctcatcgtttatttaaaaaggatacgtgattcagagagttacttggaattaggggcttctcgccgatcacgaggggaaatgttcaggtttttaggaaaaaattttagtaactttgaattttgataaaatgttaaacttacagaaaaatttccattataggcagagcactttcatacgctttaccagaaccactcattgttgacattggcccccctccttcactctcgctcccttcctccctccactcctcaccccactttcttgccttctcttcccccatctcatttttcccaccccaaccatgtgccagtagtttggaaacattgtgctcctctacctttcaatatttgactttatttcctaaagtcaaagatatttcctcgcataaccacaatatggtggccaagaggaggaagttaatgttgatacaatatttatctgatccacgtccatcttaaaattgtcagtttcctccaataatgccctttgtagcccccaccccatctaggattcaagccaggatcatgcatcgcgtttggttgtcatatctctttaggaaaaggtttttaacctaatttaagttggcagggacctcgaaatcacttctggctatgaaggctttatagaagaatcctgtgaaagacagattcatcacttagatgatggagaagtccacgttcatagcttaaaccaaatcttcccagtgcagacctggttttgtgctgctggaaaggaagggaaggcgcctttcctctgtcaactcccatcattccaggggttaagaaaatgaactgtccccatctccactctcttcctgtccctcctgaatcaggaagttctctctcgtgggtcagtgaagggaagtggtttgccatagtgaggaggaaaggcatcggggaagagaatctctaggatggtcttgactcggggctctccgagtccttccctgtgtcagcgcgaggccttaggatcacattgatccatggagacttcttagccaaggaaaatgccttaggaaggcagaaaaggtgggggacctgctagaataagttgagtagtgctcagaagtaatttgaaagcagatgcgctagcagcaatctggggaacctcctagaagaaggtgtggagtgctcagatgtagtttgaaagcggatgcgctagcagcagcagccttcctcgggttcaagagacagtggaaagtgagagggcaaacccaggaggccatcaccggcctccagagccccttccagaaaccagcaggtgacagccagggacgtgccttctgctctggagggggcacctttgcactcttccttccttggcattagctccacacctcctgtgcttctcccccgctccccacccagcccagtgcctcgccataaacaggggtcttgcggtgcagggagggatggcttgaagacagaggaaaagcaaactctgccggccagcgtttgaggacctcctgccctggtatcgcccgcgaccaccacctacactcttctccccaatacacatcactcagtggcatgagccctgtcctctgcttccatcgctgctcctgtccctccctcctcagccccatctccccatcccaggcctgtcctgagcccctcctcctttcctgatgccctttgagtcccctgtagcttcttccccttcccctcctgccacatccccaaccgcaagcctaatgagcatcatcaatggcttggaaatggaagaagcagatctctccagaaatattccaattagaaactgctgagagcattttcagtagaaatgttaccgtgcatgtaggttttgtctacagcatagttcaccctcaacatcagatgtctcacagtttaaagccacttctgtgggctctcctggttgtctacctgcccgcagaacatcagtggctgcaggaaaaagcaagcagagtgccagaaaaccttctcctgccccttattcctaaccagccttccctgtctctaactgggcaagttccttgtgtgctcacatggataaagttttctagatcaatcatgttctttgtgagtatatagggataaaaatctcccagttaactgagtttaactagatgggttaagacagagaaactttaaaaccctgtagagtccagggcatgaaaacaatctatttttaattgtttgtgcttacaaaggattgttctggtgctccagtgccccaaaccagtaagtcacaggacagaggcattcatctaaagttacagcatcgccaatggtgatctccacccaacctggacgtaaggaagccaagcccatttcagatagaacatttttgaacatctttggacaatatacttactcctctttgtcaacctgcttttttcactcatgaaatgctgcaggctgaggtccacaccgctgtcatttctctctcctgttttctcttctgtacatttatgaacagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtcagtgtgtgtgtgtccatgtgtgtggtgtgtgcacaatgcacacacgtgagcacacttacccatggagggcatggtggtacgtgatagctcaatttaaaagaagaaaccatggtctttttaagttttttctaagagacagggtcttgctcttttgcctaggctggggtgcagtggctcagtcatggctcactgcagcctcgaactcatgggctgaagcaatcttcccaccacagcctctctagtagctgggattataggtgtgcaaaaccatgcttggctttttaaaaatttttatgtagaaatggggtgtcgctgtgttgcccaggctggtctcaaactcttgggcttaagtaatcctcccacctcagcctcctaagtagctgggactacaggcttgagacaccatgcccagccttcttttaaaattttttaaacttactgacattctataaatgttttttgtgtaggttctgtgagatatttctactgaatatcttttcttcataaatagtatcttctttaaactttatatgattcttggaagtatttgaaggtcataaaacagtgatgcataattccatttgtcactatttcaaaacttacccatttggaattgagtgcaagtgtaggtttcaaaagcagttcaaatctgctaacaaattttggtcttttcccataattacatttatttatttagacggagtttcactcttgttgcccaggctggagtgcaatggtgtgatctcggctcactgcatcctccacctcccgggttcaagcaattctctcgcctcagccccccaagtagctgggattacaggccgccaccaccatgcctggctaatttttcatctttttaatacagacggagtttcaccatgtgggccaggtggtctcaaactgctgacctcaggtgatccacccgcttcgacctcccaaagtgctgggattacaggcgtgaaccactgtgcccagcccccataattacttttttctttttttttttttttttttttttttttttggtggaggggacagaatctcgctctgtctcccaggctggagtgcagtggcacaatctcaggtcactgcaacctctgcctcccaggttcaagcaattttcctgcctcagactcccgagtagctgggatcacaggcgcgcgccaccatgcccagctaatttttgtatttttagtagagacggggttttgccatgtttgccaggctggtctcgaactcctgacctcaggtgattcacctgccttggactcccaaagtgctgggattacaggcatgagccaccccgccagcccataattacttttaaattgtttccatttccttctgacctggcaaccatgtaccctaagtcagcctttcacaataaagaagtttatcccctcttccttttaggttaattcctaggtccttctccatcaaacctgatttctctgactgaccaaagccaaatccggatatgctttaatagatgtctaaaatatgtcctcagttcctaggcagtgggatgtccctgctgcaatcttctgctgctgagctcttggaactgatttgatgcctatattcaaaaatttatgaaactgacttacatatcacttggttagtaaagttactggagagctttgaggcttcataagagtgtttggggctttatttcatatcctgcaggaaatgattaaaatttgggttccctttgtcacctatatgcacataccatcactttctaagctattatttaaaagcagatttcccatcatagtggtatacgttttcacattcacttgttcttaacatcttgtcatcaaatatagaggcttagcttttctttttctcagaacctttaatccacacttttatgaagagtacctaactcattataggtatataatgaatgtttgtagaaggaagggaaggagcgagacgtgggaaatccctgaatggtgattaactcaaatcttagtggggaatcctttctaacaaatctattcttaccttatcttggaatggtgaaaatataatttactctcacagaatgaggtaccatttgccaattttctgcatcagatcacagaactggatactcatgtttaaactcctttaacgtgagccccaacccttctttaacagaagcacgtcgttaggtgcagggtgactaagtagaactggaactgagaacttgaaccagacctcaggttttccagcttctagcccaggcttttatcttgatgactttccgctttggtttcttttctttcttccaccttaaaaaccctaatttatttgtaagtgggttcttactaccaaatgccactgcccttgtccacattgacatctgtgaaaatgttcccgaagagagtaggtgactggttgttgtacctagaattcattgaaaagagctatgggggagatctttgttttgttttaacattttgtaatttgcatctccctgccatgagccattcattccctaaggatccttagctaggtggggagcacgtttgcatagtgccactgcctgaaccgccagcagggggagccatggcagcggggtttgcccggcaccggccaggacacggatggatttctccggttgctttggaaaccagccttcagagtcagtcctgttcattagctgcggagttaacggcctctgtgctaatgaactcctctgatgtctcttctcttaagcatccttctagtgagtaaagatttccctccccaccctgtgataccagattttatttatcatctttcaagaaagtttactttctcatggatggaaaccctttgcagttctggcaattgaaacaaattttaaaacttttattgacaccatcaatcaaatatatgtatataatgagacgtacttgtagaatattactaaaacttgagttttaaaccatttaatggttttttttattaaattttttaatgctataatacttctcccattcacaggaggaaggggcagaatcatttattcccttggttttccttgtgatagtgatttgcataacctctcgatgttgttcgtccagggatgcattgtcatctaagtggcaatgtcatctaaggatttcacatttattacaaatgagtacagagaacattcacatctcattttgtttttttgtaaatgcactaatcagttttctttccaatgccttccacttagattagggaagcgatactcatccttctgtttactaagttttcttcttccagctggatactttctccatgcaggaattcctccctttccctttcatgtgtctctcaccacttgcccttttaaagattccccactctgcttctcggtaaatatactaggaaaagcatttcctgtttctgcccacacgggagatggacaggacttccaacacgcacagtcggtccagacctgccctggtctgtaatttcttctgaaaggttggccctccttgggttactgtctgtgtcatgtccccagggccactgtccctccctcccctcagcctggaggagagctccactgcggggggccacttgctggcaagtgtgacacagctcattctgcagatggcaccaatgcactctcagctgcccctgccatctccgaagggcctcagaactcacagctgcatttgcccaagttaacgtgtcatggacatgttttcccacgtctccaccgttcattttggaatatcggcttgtcagccactacagtccttggaaataataaaatccagtctacgtttgcagttggttgtcccacagtcgtggtacgtgtgaaatgtgtgtgtgtgtgcctgcatgtgtgtaaattcttatatgttgtgccgtctaccctgggatttctggagatccaccagggtcccggagatttccagaagtgaccctgagatgctcagtagctcgtctgtgtgttccacaggtttggcgtcacctactgccataaccccagtagcctcacccatttgcggtaaaacaagaggcaccacacccgtttccaaacccctggaaggtaagtcgccaaggccccggccacgccaagcagtttctgatcagaagaggccttagtgatgctgtctcactgacggtttctgcttgcctagatatcgaagccagaccagatatgcagttagaatcggacctgaagttggacaggctggaaacctttctaagaaggctgaataacaaaggtacctactggaagccagaaggctttgctctcagaatctctaaatcctaattctgattgcttttcttcctcagccaaaaaaaagaagttttggtcaagactgattagagaaacaagccctgattcacttgataacgtactaaattggggactcccaataatacatttttttcttgaatctaagcccttgggatgccatccaattggaattgtgaactgagtgattttgcttataactctgaaagcagattattatgtgtcggcaaaatcaacgtgaccttgggcctggtgaactttaaattgtatgttatcaatttccaataaggtaaaagctaatattatttcatataatcacaaatgatttctaaaagaaaattatggcaaatgaatattgaagtaaatgtttcaatataaaagtcaatgcggtataccaaataaaagagcaatatgcaaaaacagccttttatctcttgattaaaatgcccaatcctggaaacttatcaaatactaggcgctgggagtccctactattgacagtgaccactaaaaggttgaaaataatacaaccaccactgaacagaaatataaaagtgtaatataataactgaactggctaggcagggaatgccagtcagcaacgcatttattacacacatggagcagtgatctagcccgtgggtcagcaaacgatggccattgccaaatccagctgcccacttgctttttttttttcttgtttgttttttagagacagggtcttgctctgtcacccaggctaaagtgcagtggtgccatcatagctcactgtagccttgaactggactcaagcaatcctcccacctcagcctcccaagtaggcgggactatgggcgtgcaccaccaagcctggctaattttttttctgtttttgtagagatggggacccactatgttgctcaggctgaagtcctgggctcaagcgatcccccagcctcagcctcccaaagtgctgggattataagcgtaagccaccatgcccagccctgtttttgtaaataaagttttattgaaacatatccatgcccatttgtgaactattgtcaatagcttttgcattaagacagcagaactgagttgtcgcaacacaggccccatgtcacccctccccatgcaaagcctaaaatgtttactggctggccctttttggaaaaagtttgccaacccttcacgtagaatgaggctgaggctggttcacctaccctcaacagaagcaagggcaggttcagaagcgttcagtgggcgcgtgtgtgcagtatggtcagcctccctctctcccattttactgcagatttgttcaggtgggaagtccttacgtcagagattaagtaagggcctgggaagcaaccacaggaccctgtatatcacaaccgtgtttcttccactcctggaacttaggaggcaatagaatttttaaactattgtgaagcataattggagtccttgtttttataaaactcttatgtcttttgcttgtttgttgatagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaagtgagttatttgggtctccgtctttcctccactgagaagggcttccttcgcctgcagagggcacatccatgaggcttttcccccagtgtggcctccttctccttctaactccatcacggcggcgttagtattctagagccagggcaaggtgttgcaggagccaggggcacggagcctcgcagcagataaaacatgcagacggcagaccagatgtgcatgcaggcagaccgcgtgggccacagatgcttgtcctgtgccataaagagggcgtcactggatttttcacataatgtaaatattgttttgcagtttttaggtttacatcacttagcagagagttcaacgcctgtctttcatttgacatattgaattcttgctcataattttgcaaaatatttggatgagatgggctcaaactaatacagctaactagaaaatcagtaaggcatgttacttagcttccaatcatttataaaatcaatagatctgcgggctttctcattgatgtctaagggtttctcttcccaggggaacatgactaaaccaactaggaaaagtgattatggtattaggagtccgtcaatttcaagtgccaagaaaaagatcccaactcaaactgatttcagcaaaaagaaaagtgcggagggctttgtcggctcactggctgaacagtgcggaggggtttgccggctcagccactgaacagtgcggaggggtttactggctcacgcgctgaacagtgcagatgtggcctcgggttctagaggcccctcagaacacagtctgtcttggctgttttcctttgggctggcctcactctccgtcaggcagcggcctggcggcagatggacaccccagctctggagtcacaaggctgcctccctggccagcccagcacgggtagcttttcttcccagtagtccaagcagaagttccaggtttgattttcttggcttcaacttgagccccctgtccatccctaaaccagtcactgtggccaatgggatagaagatgctgactgggtaaaggcggggctctgggtctcctttagagccacgatgggggtgcagtgaggtggtttccccaaaggaaaatccagatgctattaccagaagcagagggagacacgctagacaggctccacccacggcaatccaccacatccatctgctcttaactgcaaaattgtcagtgacatataccattttctacaagctgctcctgataaattctttgcatattccagtttgctcaatttgtttcagtttgcatgttttaatttcctaccttaaaaaatgagccctttgccattttctacttcaaaatagtattttgggtatttgcatacatagcggtttaaccatttctcaatcttccgcccacacaatgtcactgtttaagtagttgtatatcataatttaaacatattgatagacacatatgacaccatggtacgtaaagacgccttttgggcacagaggcccgcgcagctggaggtggagagtggcagcaggagtctgttgggagatcgcttctctcggtctgctcaccttccctagtctggttttccaccccaaagaattgtgagaatgtggggtggtcacagatggttgcgggcctattttatttcaatatagtcttccaaaaagtggttatttttcagaggaggcagtgcgttaagtggaagctagtcatggagggtcagtaaggggaccgaaagctattgcatagggagaaagtttaggccgagcgaagaggattacgtcaaggagcccgtgcaaattcccgaagggcttgccggaaacagacaagtagacatgggtgtatgattccaaagcgagaattaggacgtgtgcatgggcgtggtaggggggagggaagagctccctaaaccctagagctgtctagcagagccgtgagctgcccggaagtactccacaccctcccaggaggagaccaaggggcatgagtgagtgggggcatccgggtgtggctgagatttgaactcagtgggcttgcatccctcttccatctccaagattctacgactccatgtcaggggagtggcggtgggaggaagagttgcaagatttgtaacaaaatcaggaaatactttgtggagtccaagacccccaggtcatccaggggtggtggtgtcacagactgggaccgcggctctgcttccatccgcagattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagagtgagtatttgaacccccaccctgcttctgtgtttgggaatggcttcttccgatgctctactcattgcttggttttctgccttgtgaaggccaataatggtgctcagaagaccctcatgaagtaaaaaggagtaagtttgcacatacatgtgcacgcacctagactttaaagatttttcatagaaattctcaaagtgtgtatcacctgttcagttagttaattcagattatactggggtttggttttttttttttttttttaaagactgggggtttcatcatattgcccaggctcatctcaaactctctggcctcaaacaatcctcccaccttgatctcccaaagtgctgggattacaggcacaagccaccgcacccggttacaaattaccctgttttgttgagtttttttctggaagttagaagagatggatatttctgagtatggtaattcagccattttcagctctgtagatcctgaacacacaatcattcttcatttaatcttattagtcgtttgatctcttatagtaaaagagttatttgatctcttatagtaaaacacttcaaatcactggagtatctaatcctagatttttatattattaattaacacaaacgccagtgcttttcagatcgttcttggtaggaccctgagcttctcggagttgggatgtgggctggagggagcagggggagctggcaggggcgatgaatggaggcgaggagatgggctccagactctcagtctcactgtaggctgagccacactgctctcatctgcccagtaatgtggggttccatcattctgaaacagtgattttcttggtttgaggtgatagcatgcataatcttgatttttgggataatcttgctataattttcattttcccataacactcatagacctatttcctaatgtttttcttagaaatatagtatttagatgaagtggttgagtctttttgttataactggtttactatgaaagtatatttcagactgggcatggtggctcatgcctgtaatcccagcacttcaggaggcagaggcaggaggatcacttgagcccaggagtctgagaccagcctgggaaacatagcaagacttcatctctacaaaaaatgaaaaaattagccaggtgtggtggcactcacctggggtcccagctactcaggaggctgaggtgggaggatcactaaaccccgggaggtcaaggctgcagtgagccatgactgcaccactgcactccaggctgggcgacagagccacaccctttctcaacaacaacaacaaaaaaagtgtatttaaaaagcacaacaccataatgaattgacaagtggtattatatgtcttcaaacctaatcccagtgaaataaatttctgaatttctctctagcatatacatttttaaaacaataagttggagaaataaatgttggcacagattttacatatgtttcctctgcctccacttttgggggctcaggggttggattagtgatgactgaccggtctatagatgtttgctgttttgcagtgaaaacccatcttataactacagtcttaactctaagagcagaagatctcaagatatcatctggctgatcactttgccttcagataaagattagaacctaatcatcccttacagagtgtctacttttttgttttctttatgtataaaggcttttggtgaaagcggtctaacagtcatctggcatctatacatttggacatgtaaaagttgttaggatttagaacagctttcagtggaattgcaacaagtgcatccagctcctggttttgtactaaagtagctggtccacgtcatcactcagttcttgtccctctgcacagcatggagtgacacttgtcaacaagcagtttatattttcaatgctgtacttaattcttaacacagtggttaagcattgaattgcacatttaatcaaacttgagtatgttttccctctcgggattaacttgaaaagacaaaggtgttgagtcagttatgaataatttctgactgtaaatattgtcactgtaactgaacctcctgcgttgtgtttccttattcaacgtgcccagtgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggtatttcagagcagcctggcacggtgactcagggcccgtggtttctgtctggtcccatacggagtcctgactctgtaattcattgcctgtgccgggaaaggaacgcacactttttgagaacttattgtgtgttccttgctatgcaacctcctgtctctcaagcttccccaaatcccatgacataggaagtattctgcccaccagggcttccagaggcaggaacgtgtctggagtcccagcagctactgggtggcagagctggatttgaacccaggtccccccactccagaatcccagcttttactcctggcgccccgtgccccacgaagcggtcacacatccatgcagttaccagaggtgccctacatcatcagaggggctctctgctctctgcccagttctccccgagtcagtacagaactggggaggaagacacagcttggagaaggaatcaagggaagttcgacgcagatgaagcccacctgcattccgctctagtgcccttcctgtccgtagcaagggagattccaaagatgaaccagggcgtctctgggccatgaggaggagactcggctgcctcctggtggccactgtatagatgaatccttgagatgagaatgaaggaaatatcctctccctccaggagggtttcccacatgtttctgtgtaaccactatcctattgtgtgtatttaaaaagactagtgacaagctcaaataaccaatctctgtcctgagtcctaacccagagactacatgatctgtttaattgtggaaagctcaaaatcaacaaatatttaggaaaaggtgttgaaagccacagaaggtggcgcctccatccttcctgttgagaggcccctagggttcatagtggaaactccccaggggaagagccgacccttcctgaaggcgtggcttcccttgcctgggccacagatgtaattgggtgcaggaggtggccaggggagagaaaggccccgggagaagagtgaaggagggaaaaggagcctgtgtgctcatctccctggaagggggagccttcattaacccacgcacatgacactgataatggtcctgagaagtgggtgacatttgggaaagcacaaaccaggaaagcagccgctagtgccatcatcatgccctttctaaatccccctgctgccaccctgggccatgggcactcttattagcagacaagactctttagaagtgaaagcgtccgcagcagggatgcttccgatatggggtgcgtcctatccccgttctgtctggaaagacggtgactgtctgcctcgtgttcaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggttggtacctgaaaaataaaaatgctttagctaacatctcctttacgcaccggaggagtgttcttcctgacgtcagtcacaaagcttctcaaaagccaggtgttgcattcaagtgagaagggataggtaggatttcttttcctgaatgtctctcaaacaagctttcattacatgtttaaatgggatactttaggactatgacctacaccccagtgtttaggtcctgggttccttcctactcctgtgtaaaaaaggaagcggccccactttaaagtcctttatcccaggtagctctgaagttctgccatagacctgttgaatgagactgtcatggggtaaagcccaaagaatagtgttttttaaaagcatcacatgtgacctattgaagatggagaactattgctctaaagaattgatactccctggtctttcagttacattttcttgaggtcattgaaaatacccagtaaccagcatccacccacacccgtggtcacaaggctttccttgcaggcacactgtttctcctctctggttttgacatgtgccactctgtctagccaagggcttttctacccaggcaattgtgttcctctcttttttaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatgtaagacttcattgtacttcagagattgacgagacttgaatctcctttcttctcccttagctcattcttctattttacattgtaaataaaattttacaatgtgaaattcattcacattttacattgcagctactttgcaatgtaaaatgtgatgctctcctgttcttcttatccccaagctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtacagtccgtgggctctgcccttcagtgagaaaccacattgaaagcactcagcacaggctgcccaatagattagagagtaagttcccaataaaggttagccagtgtcggtatccattgtagaacatttacagctttttaaaggatatttgtgatttcaaaccattactggtatcttaaatgctaatatggaatccagaatatcatttagagttggcatggatcattgaaggcttttatatcttaggcaaaatacaaatattacttagccctatcttttgcattttgcataaacattataataaaatatttttaaatccttaagtttaaggaacactagatgcatgcatatataatttatggatttcccaattaatgtgctgtttttgtcctgtcacagcagtaaatatttattaattacatacatttccagtatcattaagcatgctaagtgttgagaaagtggaagacacgcaggcccttaagtttaattgggtggaagagtattagaaggaatgtaatctggagcaaggttgactgtgtgacatgtatgggcatttacatgagggaaaagtcacagaaaaagaaaccttcaggaataattttacatagaaagtgaaattgagcctagtttagagttaagcaaaatttgaattgctggaagtgaagggagaactcattctaggagaaagaataaaatgaaccatgaacataagaaatagcattacattcatgtattcattcagcaaacacttagtaatcaacccctcctgtatgtatcaccatgatctgatccctgcccttaaggatcttggaattgtgtactggagagaagacaccactggaccatgagtgcctgcggtatatgaagtggcctctgtgtatatattaagtgaatgaatgagcacatgagagggggaggaataggggagagaggcaggaagtcgacaggaagatgtacctaaagaactcttgtgaatcgcaagttgtaagcaggttgagagttcagaggagggaacattatcctggccacttaggacactgggaggaggaatcgtgcccgcagggcagaggctggctcggtggggcagtgccagctgagatctcctggcctttttgtgtctgtgttggtcgccccgttaggatttctgtcttcctccgtttgactcactgtcaacaagagaccctgttgcacctgattcaactgttgcatgttcttgaagttaacaaattcttttgtgccatttctcccaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccaggtactcctgccgccgcccggggacagctcttcaagcgagctgattcccttcgatccctctgttctcaccacagtcctctactctcgctctttatagggttcagttttcataaacgattatatgcagtggactgtgaatattcacaaaaggaacagttctttaacttttatctaactattgcagaaatatggatgtcgtagtcttctggaagaggtttgttatagttgatttcttgaagtgagcaagaaatgctgcaagttcctccctgcggcattacaagtgctgctgtggcagatgaacagcaattgtttaaacaaattacatgcggatctgaaaggcttccccgggtctggaattcagccattgatctgaaagtgcaaaagcaacatgcctccctctaatttcataccttcccagcatcgccctcgaatttcaggatttatttggcagcagatgatgtttatgtctttatatcttttgggaagggaagagggggaggagatggtgttaaaataatgattgcaattgtaatattccctgcatgtactagactctttaaagtcattttggcaattcaatagaatatgtgcaaagtcagaaattatgatgttggaaaaaataattcctacgtgcaaaggattgttgttttttcaactatcagaccaaaaaaaaactagtgctttttaactatgggtgccgttataatagattagaaaccagtgaaccaccaaacagcatagaatattgggcatctcccaatacattttaatgttttccattgaattggtctatgaatttcaactttcctgcctagtttcctgcttaaaatccaattattgattttcttattaattaatcattatagaaaccattaaaaattatggcagtgtgataagttttaaagtccttgttaagcaaatgcactaatgtttaacctcagtatggtaacaaccattattttaaggactggaactacagctcagaagattttatttggtatagcaaaggaaaaaagaacaagctaaagcataaaatctatgtgatagccaactgtatttaatagtggcataatcacagatctgaaagtggatgactgagctcctaacccactggttttcaacatctctgagacagaatcacctgaggggccttttaaaaaatgcatttgctcagcccagccccagagatgtgttttcgtttcatgtgagttagagcttatgtgtcaatatgtcttaaaagctcctagggattttaagatgcagccaggattacatacccagaccttcttagcaaatgaggctgaaaccactgagcccagttccagctgtaagtcagggaagggggtagagaaacccctggctcctggcccaggtttgtccccctcaccctgcaatctgccacatcgcttgctcacaacgcttcaaaacataaatgccagattccaaagcagaaaccaagagccctttcaatcatcatcttagcaagcctgcagagtaggactgacataacaaacagtcattcagatattttctgataaagaccacagcctttcaagaccgccgtgcattttccataggtgcttatgtttggttcctaaagtcccataagagcatgaggtagaagtgtctgtgctctatgatttatccggcagctttctttgaatcaggcagcctttctgatgtgcctcagctgtgacatcagcagctgtggtcttgaccaagcaggaagtgactgaggcagtagcacagcagggcacgagcagcaaggggggttgctctaaggggtggctgcattccgggccggattcacaaccgaagatggatctggagggatgagagatcgtgcatgttattccagggctacgccctctgcagcacgtgtatcttctcagctctgcctttatctaaaatacctgtgttcttggggacagtgtaaattttgaaatcctaaggccacacaagacctccgggtggagctatgccgttttctttcctatctctctgtgctctcctgtctgctgccctggccagtggcctagaaataagtgcacaaaaaggcacttcaagatctatgaaagtgtgttcattttagtgacgggagaatctccatactctggagagctttgttgtaacatgacataaaatagtagagaattgaggagggagctacctcttccctatgtctattaattaattggacgggaaacttggtaagcatctgcaggtgactgggcggctaaagtagacaaggttttcctgcggctcctgccttttccaaaatccccacccagcgtgccaccccagggtatcccaaagacaagaatttgctagaatgtggcccacacctgtagtcccagcactttgggagactgagaaggaaggatcacttaaggccaggagttcaagaccagcctgagcaacatagcgagacccctgtctcatatttaaaaaaatacaaaaattagctacgcatggtggcacacacctgcagttccagctatctgcaaggctgaggcaggaggatcactgcagcccaggagttcaaggctgcagggagctatgattgtgcaactgcacttcagcctaggcaacagaacaagaccttatctctaaaaaaaaaaaaaaaaaaaaaaaagaaaagaaaagaacttgctagaatgtaagaaaagtctagtcctgacatggttcatgtcacattcaggcacatcaaaaactccatggacacaaagctttgcaagacttcagactaaaataacaaaatgtcattatttggtaaaatgcaggaaaataaaccatttactttatatgtactcacgtactttgaggttttttccagcagccgcatgtgttttagattcctttgtttaagcttggcttcatcttggttcttttcctgtctgttctcccaacccccctcccaccctacagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggtattccggcgaccaagcctcaaaactcggggcttggttcgggtcccaataaaagtggccttcatgtaaaatgatcaaatcaggatagttcgtatggctgtcaccccagatgtatcatttctttgtggtgagaacattcaaatcttctcctctagctattttgaaatatgcaatacagtattggaaaacagtcaccccactgtgcaggagaaaaccagagctcattcctcctctctgtcactttgtaccggttggccaacatctccctatcttccctgtcccgtctccttcccacacccccttccccataaaacagatgcatgtatcaacacatcgaatcatacccataataatgtgtcaactaaaatacttttttaattaaaaaaaaaaccatggacacacagacacacaaacaaacacacacacacacacacacacacacacacacacccttaaagctaggaagccttcccaggattcactagtagaacagcagacaggcctccaattctaatctgactctgggaagtgaagagtctgatttgtgcctgttctcaggcacccatgtgctgttgtggcgatgggtgttcagacctcccagagtctttctggaaatgcagcctttccctgactgcagttaaacatcctgagacagagtgtggaagctgtatttttatgctgtcccatgaacagctgaagcagcattgagcatgacaaggaatagctgcagaaacaggcaactgaactgatgtctttgtgttcccctgtaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcaggttagtgagcgcttgtggttttttccagctgaaagaggctggcccggcagccctgcgggagccagcttctccaatgaaccctgtcatgccctctgctgcgtccgtgcagtggggcactgcagtcatgcgcctttgagagccacctagtaaactacagagatgaaaagaagtaaggccgaattcctaacaacctagcattgccgaggccgctggtgttcacctgtagaaattgaacttgcacatcaaggcttctcagctccctctctccctcccctgcccctgtccccagagcttttctgggaaagagatgattggcctctaaatgatatttcccatgtggctgtgtgctgcttcaattaaagtcgttaagtacagcatatcttcgtgatttaaagctggaaccaaatggtgctgtaacattatagtaaatacacgcacagaagattgatttgaaaagtgaaagaggctgtttctcccgagactgagagcacgggtggtgctttgtgggtctggtgtagtaaatgcagagtctaaactctcctcggttcctgatggtgacggaccccattgcaaaacactcacctggatgcttggtgctggggaaagggggagtccggtgaactctggagaaatcatccctttcattgccaaggaggagccttttccacagcgctgctcaccccttcccatttaggagagcatgcaggtcacaggtttgtgatttcaactcagaagagagtatttttgcctctttacagcccccttgctgtgcaggtgcacctgcccccggggccacaggaagcacaggcagctgtttgctgatcagaaaactgcaggctcagaaccaggatttctttcctgatttatacaagatgcatctattcatcagctgacaacatttcctgagcacctactctacggaagacactttgtagggaccaagtaaatatttcagaccctgtctcagtgacataaagcaggtgcaggaacagccagcaggtgggcctcgctgagcacacggccagtggggctgtgtgctgtgcagagccgggctgtggcccagaggtccccctgccccctcagggcacgatgctgggggctttactctgcctgtagctgagggcctactgggctccctgagacatttctgttgtggtgctaatttttcagataaggaccaagacagtaagatcaaggaacctgcctgaagccacacagctagcagggagtggagctggacactcaagtccagacctgcctcttttcaaacccaactgtgctattaaaccgctctgcgggcagagagtcagagtggggctccagcacaggatgtgggcagctgtgagtctggctacaaggaggggctgaagatcccagtcaccagaccttggagcaggtcagcattgaaccagcagcaaggcgacttgaggttgggccgctgaacacaccaaacttcaggggcttcttaaacagcaggaaggggatcttccagggcccaggcagctccagcctctccttccagggagtagtgggatgtcagacaaggacccccaatgggagggacatttctttctctctttttgttcttttttttttttttttttttttttttgagacagggtttcactctgtcttccaagctggagtgcaatggcagaatctcggctcactgcagccttgacctcccaggctcaagccatcctcgtgcctcagcctcccaagtagctgggactacaggcatatgccaccattatcaagctaattttttctttttttttttaagagatgaggtctcactatgttgcccaggctggtctcaaactcctgggctcaaaccatcctcccacttcagcctcccaaagggagcagcattcctcatctacttaatttcttatgagcaagcaattggaactgctcctttcctttttcataaggagctgtgtcccttgagggaaggccacaggtgctgggaccctacagcctgggattcagaatctcaggccctcacttaccagctgtgtgggctgggtaaagttactctgtctgagccttggttttctcacctggaaaatagggattatagtactcagctcacaggactttataatcaggtatatatgacgtttagcaggtgcctggcctgtgttcacattgtaggtgcaggaaatactcatcactgacattgtcagcaggaacagcgtaattactgtttttaacttgaagacaagataatgtggatctccccaaaacaataacaataacaattaataacaaagagtcactgtcgtggacttacgcttttgcttttgtgcagaggtggcatgtacagtgttaatctctgatgctggttgccaaagacaataataatagggaattgagtgtgtttcggggcaggcagatctcttaacctttggagtaatggaactgggaactttaaagaacaaactaaaggcacttgtagtgcccgttcctaaaatgcaaaaagggaaatcgtgttttataaaaccagacatagtttaatttagccattttcttactttagctgttagttatgagaaaaaaaagtaattgtgagtgaatgaatgagtaaaactgttaaagtgaattaattaaaaataaagcgaagagttcagactttcatggactattgacttggaggcccttaggaaatatgatttgagccgggtgattcctttctatatttcttcccaatgaacacaatggacatctcacagccagctccaacaacatcttttccagcagacttacaacttagaaaaagcccagctttagagaattaagttaaagcagggagcattcagattccagaccatccctccagcaggggggaagcacagcccgatggcacttgcagtcactccgtaaccaacgcggaagctctggccccttggtgacactagtccggctcccctatcacttgtgcgcacaagggccacacctgcaaacaggactgagtcagagctcagggtgcacttctgggagagggtcagcaaaagcagcagctgcacaggtggtacagcctccgcttggccaatgctggccggcctgctagggtcaatgtcctggcccagtgcctgcagggtagggttgctcactccccagcagggtcgcgacagctgctcaaggtgcccagggatctgagccaggctcctccagggcctgatagatgtctagttcctataaataggtggctctggtgcaagaatgcttgaccatgaacagtctttatatttgtgttttctgttattcctaaatagaactactagtaccaaacattcttgaaagtgccttggtggcgtaacatgtccacactttaaattaggtaactaatcaaggttgtaaagagaatagctggctgggcacggtggctcatgcctgtaatcccagcacttcaggaggccaaggcaggcaaatcacgaggtcaggagttcgagactatcctggccaacatggtgaaaccccctgtctctactaaaatacaaaaagttagctgggcatagtggcgggcacctataatcccagctactcgggaggctgaggcaggagaatcgcttgaacccgggaggcggaggtggcactgagccaagatcatgtcactgcactccagcccgggcaacagggtgagaccctgtctcaaaaaaaagaatagcccagaagttcttactactaaaaatttaatctttatattgccaaaattaaaaatgaatacacatacgaaaaattaagtttcatgtaggactaaatttgggtatgtgcagaaaaactgtaaagaaaactagtgaaatgtttgcttcataaaatatctttaaagaaataaaattctagactcacacttgtaaccccagagttttgggaagctgaggtgggaaaatcacttaaggccacatgtttcagactaacctgggcaacatagtgagagaccttgtttatacaaaaaaataaaaaatgagcccagcatggtggcatgcacctgtaatcccagcactttgggaggccaaggcaggaggatcacttgagcccaggtgcagtgagctatggtcataccactgcactccaacctgggcaacagagcaagaccctgtctctaaaataaaagtaatttaaaaaagagacacaattctattttgtgtatatacactcaagtctgtttgcaatgttaggatgtgatgttggttatttaagtgtgaatatgtatttacacaatgtatttgagtgctaacagatttcaagatctttataaactgttatgatctatttgaaacatatctttcctcaataatctatttagtgcaacaaatgttcactatttgaagaatgggattgctattcaaaggcaaagttttgttgctaagttagcagaaatttcaattaagtggcttccaaattaattgtgggatttataatctagtcattgatggttcctattttattttgccctctcaaaaacacccaaacttaaccagttgagatccacagtggatggtacaaaagactgtgcttagtcaaaatactgtaagaaattattagaatcatttacgaaacctatgttacagatactttaccaaacaaagggctaaaaatcaaataaatatgaccccctaccttttaagaacttaaatgagttttattcttcccttcaaacctcaatacagttgcaatgttggaaatgggattggagctgggaaaactgcagtgatataaaaccagagactccagttattctcattccttttaaacctgtgtgggtgttcccaccaactgctgcagcctcccgtgttgaccctcactccctgggacacctgggcctttgggtcaagtgcttggtctactggcctcactcagcctagaagcttctgcttccagattagcatcattcaggtctacactccccacctcctcagaaaggccctccctcagcaggtgtcccacgagccctgaccctgcctggcgtcaccttcttgtctcttgtcctcatagcacttatcactatctgaaattgtcttgctcgtctctttgtttattagaacaaaagcacccagcatcgagttcatcattgtcttgttcaccattgtagcccagaatcctgaagtccccgctcattgaatatttgttgaatgcatgaacgaatgaagggaatctagagtgagacatattcttacaggtagagatttggatgtctgtagtaacatctaaaatgcccatttggcctataattccagcacttttggaggctgaggtgggaggatcacttgaggccaggagttagagactaggctgggtaacatagtgagaccctatctctacaaaattttaaaaataaaaattagccagacatggtgacgcatgcctgtagtcccagctatttgggaggctgaggcaggaggatcatttgagcccaggaggctaaggctgcagtaagccatgattgcaccattgcactccagcctgggtgacagagggagaccctgtaacctccctgtgactgctctccacaccaagcagtctcatctgcctcctgtgctgctcatgtttaccgagtgcctgtgcagttccagccatggggaccatcagcacttaatcctggcagcagccctggtgacagacatgaaatccagattagtttatgctcaagtgatatgtcagcaacctatctcctcctttctgacagaacttgaaaacttcaaagttgtattttttactagaatagttttaacagcctgcattttttcctttgtgcttaaagctggccctgctattgtttttaacattttttctctaccagctattcttttgccaaagagtggtgtaatatggaaaatgagtttgtgtctgtgtgagcccttagtcctgctctggcggtcaccaaatactttatttatttatttatttatttatttatttatttatttatttatttatttgtaagagagtctcactctgtcacccaggctggagtgcagtgacacaatcatggctaactgcggtctcaaactcctgggctcaagtgatcctcctgcctcagtctcccaagtagctgggactacaggtgtgcaacaccacaccaggctaatttctttaaattattttagaggtggggtcttgctatgttgcccaggctggtcttgaaatcctgacctcaaacagtcctcccagagtgttgggattacaggcatgagccattcacctggcctcaccaaatattttgaagaaattactctgttgcacacttggagtgatctgccaccccctccagatgacagatctttttctcagggcaccaagagggcccctcagatcccttttctccctgtgggaagttctgggtcaggagctggaaggaaggtggtttttctcttctcctgggcgtgaccagccttccctccaggtgccaacggtttctcccctgccctaggtccgaggctctttgccactggtccttgcaggcccggggaaagtgagccagacatttgcttctcctcgggtgtctcagctgctgacctgtccctctgccattctgtgtttgcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtgagtcctggggagctctgcaccccggggactgagaggagcatcctctcctgggagccgatggcactcggcctggtccctcccaacatgattctgataatggaagaccacgtcacccaaagcacttcagtcctggtctggcttctgcaggtctcaggctgtgcctcccatttctttcctcctcccactttttgtaagatgatcctggagaaaatgttgtatctgcaaataggaaatccacatgacaagtgcagatggccaatgggtggctttgaaaggtttccacctaaccaatcaaggcactgtaagtaaaacaaagagatgccatcatccacttctcacagtggtagtgattttttaaagaatggatccagggccagctggcaaggcctcggtaggatgaggatgctatgttttgggtgagaagtgtaacttgaacagccatcctgaaattttgtcacgagaaccttaaaactttgatcacttgttccatgtacacgaatctacatgaaggaagtatcaggtgaatgtaaggattgggaacgcccatcacctgtattcgtggcagcctgagtggttttctggaacaggtcagattgggtcactcccttactgtctgccacacacactgcagtctaagcggcttcccagggctccagcaccttcgtgatgggccctgggcacctctccaagctccccctgctcctcccctccacccaggccactccagcctctccctgttccacggccacctccttccactcacctcctgccctgtgacccattccactgtctggaaacttcccctgcctactccatactgcctctacgtatgtacccctgtgtacagcctcttatgaggcaggtttctgttgaaatgttacccgcaccactgccccccgcacccattctatccagagccttctcattctcccatccttctcagtccctgcactttatccctttattttcacagcacttcccaccacctaaagctacatgatcccccaggagcatgacagagaccctgagaccctggccttacaaccccatggccttatcatcccagggcctgcatcgtgcctgggagggactgctgcccagatccaaggccacctaaagctactggcctcacaaccccatggccttataaccccagggcctgcatcatgcttggcagggactgctgcccagatccaaggcttgcaaacctgtctctttaacattcagatgagctctgcctgagtctcctctgctctgtagagtaccagcaattaagagttaacttgctgagtagcagcaattaagaattaactctgggattctttgaaaacaggacaatgccatgtgcaaatctctttattctcctggatgaatgattaacgatagcaggagggaagacagcagagacattcttgccagaaatagatccacactcacccagccttccacagttccaagaaccaatcacatttcctaaaacaatattttctactatggactatattttagaaatggtactggcaagagttgcattttaatttattcctaatagccatttcaactacccctttatttttttgtaaaggccatgaatgaatatgcttttatcatgccttcaaaatcatcctcagagttttgagtcttaatctctctcatttgagcattttacctgttaccaatccagtggatggaaaatcattttatttttatttgtatcatttttttgagacaggggtctcactctgtcacccaggctggagtgcagtggcactatcaccactcactgcagccttgacctcccaggctcaatcagtcctccttcctcagcctcctgggtagctgggacttcaggcatgcaccactacaggcatgagccatggtccagctctggaaaatcattttagatatgaaatactgccacaaaatggcaattggttatgcaaaatgggcacagagattgataactcacagtgagaaatgctttctctcagtgctccctgactaccagctccaggaaacatttcctctttaaggaaaggtgtcctagagggaggtgactcaaacctaacattattcgtggtgcagataacacctgaaggaagagccttctctaacaggccaggaagaggctgagtggactgctggggtggccacaaaccatatattttccctagaattattaccaagtcagtgatgagtcattctcattgctgagagctatcttgttaagaatgtatttatatcagtcttgtgacatcaataaccacagaataccattaaaatatcaggagttatgttttaaaagaatattccttgacagaacaacattaagtaaagaaaatgaggctgtacatcaatataaagcaaggctcctattttgtttaggaaaagaagaccctccctgagtaacaccctgagaggaggctgcacacggcagcgttcgcagagcttctctttaggtggtagtgttagcaatggcttttgtttgtacgtcttggtatttttcagattttctgcaagaggcatgtattgtttttaggactttgaaagccccgcgccccttacctatttacctctgtttaaatcggaaggtccaggttctccagggaaaggagcccccctgtttcctgcagtgtttccagggggggatggtggtgcactcggggaggcgggaagaggaagaagaaaatgtgcaaagtaagtcacttttactgctggaattcgactttgcctttccctctcttggaaagaatttttataagctgggggctgaaagtgagtctgtcttcatctagctgtggctcgacctctgaaagcctcctgatgtttgcctgataactcagctctatgggtgctcatgacccgcctctccctggagaatttactcggggattcacctttgcacgcaggaggctggaaggtggtctcccctcctctgtctgctgtttttaggaagaaagaaaaatcagtggctcttctatgataaattatgaaattttgtgttgaccagcaccccaccccccaaaaaaatcttagctctagagccttttaaaatatgcctgttatagaacttgttgtataaatcttgggaaaatggcttttctacattgtggacttcagatcacctgcttctaactatgtaagaacccactttttaggctggcaggaaggcctgatgcctcagtgctccacagggctccctgtgcagtgcctcagcccctccagtcccctaagtccctggccctggacggaggtggctgccttggacgacacagcggacactaggaagggccgcgtttgctgccactcgctcacgtgctaactcctccgcgccgccggtgccccctgcaggtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacagtgagtgttgtgtctgcggcgagtccccccacacaccgggcttcccagagggacggggcaggctcaggggtaccaagactcccagcagatcccagggtgctgaaagtgactgcagcaaaggatggctgggaacgtggtcaggggcctctgacattccgagcagagaggacacacatctcagtccagacctccgacttgggggccgctctgaggatttatctggctgggtgagaggctggtgaggagccagggagtgactcttggaagcactctgggttctttcttcatagttgccgttcagcttttggatgagaagcctgggggcctttgatatttaaagggagcacatttcaaatttgtggagttttcgtttgccagaacagcagagtgttaaaaagctaaagaagagtgtgggaaaccgccatctgtgtcagacgataagatatcccccattctggagagcagcccccgatggagagggatcggactctccgggcacttcccgggtacagcacttccgggttgggttttgttcccctcccaggcaggcacctgccgttggccacttgcaaagactcagcacactgtgagatagcactgagtggggaccttggggaagaggggaaccggaagggcagtgaaggccacagcccagggaggacgctgtggtggccggcccccccggtaaggtggtctgcctctgtggctctgcacttcctagcagcccaggcaaaataagcattgcaagctgccagagaagcccagtgtcgcccaggcattcaggaggcaactgagacctgtgaggacctcagtgaggaaaagtgaagagcttcctagggtcacatgtccccagagtttgatttggtgaaccccattctctgggttctggaacagagcagtggccagggcccctgtgtccactctgaaaacacactacccagagagggcagagaggagaacggggcaggtgacctctctacagggaggcagatgtgaaacaagatgtttcatctcaaaacaccacctgtgggctagggcacggggaggggtgagaaatcacatgccctgaggtggcccaaggcatttgaggcccatcagagggtttacttggaccactgaggaaaagaaaaacaatgaagagctcattcacatattcactcaacaaacatttattgagtacctgattggcgccaagcaatctggaattacaggacttatcctataaatctcggaaaaaatggtttttctgcatcatgaactttgggcaacctgcttctaactccaaaggactggagttaggaactggggacttggtggtgaataagcccaagtctctgtcctcatgaagttcatgttctagcaggagagaaagacaagaaatagtcaatatgtattgttctgtataaaaatgtgtgtaattttcatgacacattagatgtgattaaacatccctccctaggagcaagtcaacttcccctcctccaccacacacacttagagactgcagagcatttttccattcatgagtaagaattgcttttccttagaaagtagaagagacggtgaactgatctccagatttagttttgaataatttatggctgtaccccatatatatatgtacatgtatatatatatgtatatatatatacacctactattagtatatacccacaaattttaaatttaaaaaaagcagacaataacaagtattggcaaggatgtgaaaattggaacccttacacattacttggaaaacagtctagcaatttctcaaaagatttaacaatacagttaccatatgactagcaactctactagatatctacccaagagaaatgaaaacacttgtacatgaaggttcatagccatattagtcatagtggccaaaagatggaaataacccaaatatctaccaacatattaatggatgaaaaaaattagtggaatattattctgccataaaaaagaattcagtattgatacatgctacaacatggatgcaccttaaaaacattacactaagtttaaaaactcagtcacaaaggaacatatattatataattccatctgtatgaaatgtccaaaacaggcaagtccataaatacaggagtagattagtggattctgaggactaaggatgggggaaatgcggagtgactgctaacgggtacagggcttcttcttccgggagatgaaaatgttctgaaattagtgatgacagttgcacaactctgtgaataaactgaaatctgtacacataaaaagagtgaattttatgacatgtgaattatatctcaataaagctattataaagctgttatcataatagtaataataattttgggtcaccagcactctccagacttataaagaactcttggagtttctcccttgcagatgtcccctggaagcaggactgcatagtagcagcaaagtcacaatacacgagtgtgatgaaggctccgagccactcggattctgggatgccttaggaaggagagacaggaaagcctacgattgcatgcttcaaggtaatgtggcatccacagtctgcgatctggtttttttgtttgtttttggaaacaagagtcttgctctgttatccaggctggagtatagtggtatgatcacagctcactgcagcttcaacctcctgggctcaagtgatcagcctgcctcagcctctcaaagtgcaggcttgagccactgtgccccattcatgttttatcttaattcttcagtgtgtcttaaatctagtgtgatgagtattatgtccagctgattgaacagtttttttcttcccaggggtgagtttaacttggacaccaggacttcaaattctcactggcaaatcagctcccaaggcctcccggggaccaagccaccttccagggtcttagggactcagggcaccattttctttctttcctcatagctgccacctgagaaatagcagtcctctgggtgttggagtgcgatctggggaaggaagccggcctcttatcccctttccagagcccttcagtcattaacctatttggaaatacaaagatcgtgtctgtatagaacaggcactcccattcaccagagtgaggttaggtgtgtatatgtgtactttcccagctgttctaaaaatacagatgaacattagaaggaaagcgaacttttgttaagcagttccagtaagccagacaccagccagcaccttacatatagtaactccgttagtacaacccaacactctgccatttttacagatgaggaaactgaggcatacagaagttaatcaacttgcccaaggctgggcagcaatggagtatcctcataactgctccataatactctgcccctcaatgtttataaacttttatatagctttttaaacataatgcctagaaaacgtttgaaattatggagaagttaaaaaaagaaatgaagtcacttataaccacatttctcagaacagaattcacatttctctatgctatatataatatctattttaaaaaataatatgtggatctactgttttgtaaccttttttcctttataatgaataatttcccaagttattaaaatttagatttctaatggctgtgagatattctgttatactgtgaatatatgccactctctacctgacagtctctgacagctggggagttgagttgtttcttatttctgatttttctcccttatacaataatgcagtttgaatactttttaaaataatcctatacattcattcctaattgagaggaattcctagatgtggaaccgctgtgcttgtcataaaatctgatagcatgtatcagctcgggccaagtttcattctcacctgcaatacacagaagcgttcatttctcagcacaatcataaattcagcatattattttttcctctttgccaaattgatgaaaggagacagatagctaagcattgttttgttttacttagaagtacatatagatgtatatttatatacatgtataatgtatataaaatacaatatatgtatatttatgttatataacatatatgcatatttatgttacatatgtgtatgtgatatacacatacatatatctgtgtatagatatgcatatatacacagtatctatatatattttttagccattttaatttctactttggtgagtgttctatttgtgtcttttgcacattttattgatatttattttttccttatgtatgtcccttcatgtattaaggatattaactagttgctgtattacaaatatttcccatttgttacttggtttttcttttctttttaattttgcattgtttttcatttttatataattaatgcattattttcccttttgattggttcttttactattgcacttgaaaaggctttctccaccttgaagctcagataaatcctacctgtgtttccacagtgctttgaattatttcatattttacattcattcttcatctggaatttactttgatgcacatgatatcttcagctttgttctcttttctttcaaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccaggtaaggcctgcagggggcagctatgctgagcagtagaaggcacatcttccagaaagccttttgattttacgttggtatttattaagcagcttctgtttgccaagtacattcccagagcacccagaacatgtgcttacactcttttcatcctcacccctacaccaaaaggaaggagagtgaaatcagccacactttatagcataaggaacgagactcaagtcacttaacccacccaaagacgtcagctaagaacaggttgagcaccacagcggcaggcctggcgtctccgctcttttcccagccttcctctcagtcttgttgctgcatggtcacccgtcgactgccattgctccagccattatgtttgcattcaagatagaaagagaaagaaaggggaaggaaaaaagcccacctaatagccactctctctctttaatcagataaagcacgtgttttcccagaagcccccagcagacttctgcttacatcccattggccggagcctgtcacatggccagccccagctgcaagggagcctggggaagcaaatggcagaggagaaggatgttggggtattggctaagttagccagggaacagggtctgccataccaagtctccacagcagagccaagactccagcccaggtcttctgatcccaaggtcagggctctgtgccctcattctggttgggaaagtaacaagagactgggcttgacaacccctcccacccaccctccaatgaagccaaggtcagctgcctctcagtttgtgtttgttgcttctcacattacaagagcctggagctgcagccagggacctcatcttgcaccgggatctcagggcagcactgaaagtttgcccagtgcacatgtcatgcttggaaaatcagccaccagtaagagagggtgtgcccacgcccttcatcctggggctcagggcgggttatcaacctccactgggcttttaaagtgtggttttcacagaatcctgaaatgcatgtcaggaaaggacttacagtgagccgactagcaagagtgagaggcattttgccacctggagtaagagtcagactgacaatttgaggaggagaaaaaggtaggaggaaaaggcagtagaacagttttgatttttatttccttttattttattttttagagacagggtcttactctgtcatccaggctggagtgcagtggcgcagtcatggctcactgcagcctctaactcttgggctcaagcgatcctctctccttagcttcctgagtagtggagactacatgcatgcagcaccatgcctcgctaattttttttttctttttgtagagatagggtctcatcatgtggcccaggctggtcttcaacctccgggctcaagcagtccttcctcctcagcctcccaaagcactgggattacaggcatgagccaccactcccggtggcagttttgctttttaaggcccatttctctgtaagagagccatgagctcacctcactgctaagcaatcgcgtgcagggcaggaacgccactgacctgtctgcagtgagatgtgcgctccagtgttgattgtgctctttggagatatgcggtgctaacagccccttgagtggcacatgcattatcccttccactcttagcacagccctgccagtatccagaagggccagggccttgagctggggcaaagggaggaggacctggaggacgaggaatgaaaaagaccaactccttgacaccacttctctctgcctacaggcttctccccgttgaactgtcaaagggctggggtatcctgggtttctctgtttgcccctttgcccctggtttgatggccaagggggtttccccctgtgacactgcagtcaagagggacaacatccactaggttgggggaggagtgagctagaagtgtccgtgaaggagctcctgatggtctggccctgtccctgccctcacagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggtgaggctccctctaacatgcctgcagcacggaacagatggggaagcccctcaggcatgcgcagccaggagacccccttccccttctgtgcatgtcagccagcatccatccataaagcctggcaggtggtgatgaaaccaattttttcccctttaactttttgagatgtattaagttttagattagcgcattctcagctgccagcatgaagaagaactagtttttctctctgatattatgaggctaacttgttaccctcaaggataaaggctgtattgtggaatgccccaggcagattaaaaccccgctgtactcggggttgatcatgctgagagacaagttggcctctgccctgtacattatctgcaagcactaccacgctgttggagaatggaggtctcccccaaacagtgaacggccattgccaacctttttattattcattattatttttagtattatatccaaagagaaatacccatagtaagttcatggttctttactatacacatgaaatttctagtcttttatataaaatgaaaatgccagtaattaatcttatttaatttttatggtttcattgacacaactagtttaatgtcactgagtatgtgcaatggattctcttcctgaaaaactctttagcaataaataacatatgaaaccttccactcaatgttatagtgaatgtggatgtataagatgctgtcgttcgccgtcagtcattatgggagttaatcctgtgctaggaaatgagacggatgactctacaggtgaattcaggaggaagaaaatgctccacccagaagctgcagacagagcctctctctcccttccaggaatacacagcgttttgttaggttcaagaagtatagactcaggttgattataggtcactatggtagtcacaggcatgaaactaacaaacatcttatataaacattatccatgtgttgttatgaactactggtaacttgcattttaagcatgaagtcatgagttctggcaaagaagaaaagatttcaagggaaatcagagaaagacagggtctccctggggtctactgacattgcaatctgtgtaactacaggaaaaaatctcaagaaaccagcccccaagtcttaccttatccacgctggtctggagcccctgacattcaccaatatgtttcccagctgggagcacagagaggacatcgctgagatcacagagatggtgagcacgctttcctgccctatgaaggtggctcctgcgccttttggattgtgggttaactttactttggggagagcatccaattgcactttcagagtgggaaaatatttttccttttgcaacatcttaacaaacctacatagaatttgcttaggaagaagagaagtctaatggaaaatcaattaactattttagtaattttctacacgatacccaaattttaaaaacttaaaagcaaaggtgagttgaatcatgttgaggactatatatgtacataaaagctgcgaactcttcattctgtttgctaagaacctgttgcttggcattgcttgtctctcagtgtccatgtgacgcacaaccaaaccctcatgtttcagatgttaaccttgtgtagaggagacacaaacgaaatctgatgaattagtatgttcagaaaactgaatgaatggaggtgctgcgactcccttatgataagggatcactcaacatctcattaatattgtcttttatgagaccacctggtatttctgcatgaggcatttatcataacttctatccaccaaaatatattataatctagaatgttttcttttccaaccacacaggaaagaattttattatagctatgttgaatttcttatatatgagctattaacattgctaggaatagcaaatccaaggatttgttttgatttggtgagagataggttttttaccattttgatttttttttaccatgtgagagctgctttgcttggggaaacgacccaagtgtattttataggaaattcgagtaattttaaacaaacagaatctacttctgcttagcaatggagagggcctgttgggtagtacagacatcactgctcaccctaacctgtctccctggagccaaatggacttgatgtacacagggaaggggctgacttcagcttggtgtctgccgcagccggaacgagatgtttctgttcactgcaactgtggtttcgtgaaaccagaaggctctagggattacgagctctatggctgctgcatgcagtctaagttcaggagttaccaaattgccaggggttcagtccagggcttattgctcactacacagaagaaagccaatcactgagacaagcatagccaaggaagaaagtttatttgggtgctacagccaaggggaacaggacataagtctcaaatctgtgtctctggcctactaaaattagggatttttatagcagggaagaaatgtaaccatgtgtgggaaacaggaattagggaggggtgaggaagaggagctggtcaacaggaagcggggggttggttaggcatcatggtgggtaaggggtctggtaagcttcaggttttgtttttgttttttgagacagggtcttgctctgttgcccaggctggagtgcagtggtgtaatcacagctcactgcagcctccagctccaggctcagacaatcctcccacatcagcctcccaggtagctgggactacaagcacacaccataatgcctggctaatttgttttgtattttcaatgaggttttgccatgtctctcagtctggtcttgaactcctgagctcaagccatctgcccacctcagcctctcaaagtgctgggattacaagcatgagccactgctggctttttgatactattggagatgcctgatggttggtttcctgagaaaggaactcagataagacaaatataactttctcgaatttcaagactaggagagttaatttcgacgtttattccaaagaaatcataaacatcagttctgtggcacagttgagccactttcagaaggatataactcaccatcctccctgtgtattcactatagatcttgggggttagcagcggggccatttactgttgtgcaggcctgtgggattccagccggagaagagtcaggcttcccacaccagcaagttatacaaataattaacattcagcaagtgcccactctgcactaggcacatctccaagcactttacactgattttctcatttatcacaacagtccatcaagatatcttattattattcccattttactggtgtgggagcagagacacaaaaacacgaagtcacttggccaaagtgactttcagtgagtggaggagtcagtactcagacgcaggcaagatcatccaaaattcgcctcttctttttttagagaaaggatcttgctttgtcacccaggctgcagtgtggtgactcaatcatggctcacacaaaccttgaacccctgggctcaaacgaccctaccacctcagccaccccaagtaggtaggactacaggtgcacacttccatgcctagcctatttttgtattctttatagagacagggtctcatcatattgcccaagctggtctccaactcctggattcaaggactcttcccacctcagcctcctacagtgttgagattacaggcacaagtcactgcacccagcccaaaacctgcctcttgaccaccagtctgttccatgtatttctaatatgagcaacagctcttagtcatgcattcccaccatccacccacccaaaaggagagcagccaatctggggtcccaagtttaatggaggaagagaatttacccagaatagtttgttcatattcacacagtggttttaaaaacaaaaaaattgattctgctccagaatattctaggtgcattttctgaccttctttttctattgcagattaagaaatggggccaggggagggaaggggggtgtgatttcttttcaggttattttttaatatttatttttaaacaaattccattatttggaggcttctggtgtttagacttcaaatctactaatcttagtccataattcactcatgggacagtccctaaacatttttccagagacagttctgagacagggtttgtttaaaactctgtgacaaggtgagaaaagatctataagtcagagaaacaagactccatcatctctacaaaaaaattttttaaattattaggtgcgcgtggtggcacatgccaatagtgccagctactcaggaggcttgaggtgggaggactgcttgagtccaggagtttaaggctgcagagagctatgattgagccactgccctccagcctgggttacagtgagacactgtctctaaaaaataacaaaatttggggtcaagtgtggtggttcacacctgtaatcccagcaggaggatcgcttgaggccagaagtttgagaccagcctaagcagtatagcaagacccagtctctacaaaaaaaaaaaaaaaaatggaaaaggaaaaataaattagccaggcctggtgatgcatactcatagtcccagttactcaggaggctgaggcaggaggatcacttgagcccaggagctggaggctgcagtgagctatgattgcaccactgcactccagcctgagtagcagagtgagaccttgtctcaaaaaataccattttttaatttaaaatttaaaaattttaaaaattaaaagtccagacaactgcagggctttgggcgatcccttttctttcagagccatttcctcctcagtgatatggaactatgcatcctcaggcagtatgcaggtggcacagggctgtgtgtctgtaagcacttaataaaacaagttcaaatgtaggacacgagctctcctctctgccccctcctcttctctaggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgaggtaagcggttcttccggtggggtggggatgggagtaaaacaacacacgcacgcccggctcctttcactgagccgcggggcgcttctcccaatgtttccagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgccttttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacagtacacatgtcattttgtgatataggactcccaaataaaagtatcagaataaacacaacaattaactggt

SEQ ID NO: 36199 - DNA, 278454 bp, Homo sapiens; identical to SEQ ID NO: 36198

SEQ ID NO: 36200 - DNA, 26459 bp, Homo sapiens
tggcgaggttagggcccgcgttgcgacgtggtgcagcgcatattttcacaagtgggtctcccttgtccgggactatggccaccgactcgtgggccctggcggtggacgagcaggaagcggctgtcaagtcggtcagtagctcagctcctggcgaggaggacgtagcaggggcccaagcgaaacctcccaaaagcacagggagctccccgggttggggaggcccctgggcaacgcgctcctgcagtttgctagggcagtcacttgcccttgatttgctcttagagctaaagagaccaatgtcgagctttttatctccatctgggctggttaaggacttcatcctttggtaaatccgccccactatgcatgctgtcattcctctattgacctcctcggtgacgattataaggaaagccaagtttagattctgattctctttttcattacgcgactgttcttcgcatgtttctgtactactctgtatttaacatttcttagatccatgcttaacgtggttggtagtttgtagctctttgcagaataacagattgacttttggatttaatacctcaatctactgcagatgttggaaggaggcactacaaattgtttcattgatgtgtaaagtaacggtttcatgtacttgttctttcagtaatgaatattcattcaactggaatgtaattacagcatacactgtggctttctgttcttatatctaagacctaaactttaggtttgtttagtgataatggactgtctttttttttgttgtagttgtttctcttttgaggcagagttttgctcttgttgcccaggctggagtgcaatggcgccatctcggctcaccgcaacctccgcctcccgggttcaagcgattctcctgcctcagtctcccgagtagctgggattacaggcatgcgccaccacgcccggctaattttgtattttttgtagagacggggtttctccatgttggtcaggctggtctcgaactcccgacctcaagtgatccgcccacctcggcctcccaaagtgctgggattacagccgtgagtcaccgcgcccagccggtatggggatttttgagagggctattgacagaattagacaaggctggcaaggatttattgaactacagagaacagaatatgttagaagtgatggctaatagaaatatcagtgtagaagttattctgatagccccgagatagagggcctatgttgggcagtggaagtgaaaattaagggatgggtataagatatgaaggtagaatgggtaggacttgctaacataataaaggagagaagggagataaagccaaaggtttctgttttcaacctggatcctattggtactactaacgtcccaataacaggaataggaaagtgggaggaagggcagatttgatagaatggtgaaggcagccgggcatgatggcacccacctgtgatcccagcactttgggaggccgaggcgggcagatcactcgaggtcaagagtttgataccagcctggccaacatagtgaaaccctgtctctactaaaaatacaaaagttagccaggcgtggtagtcgtcccctgttaataccagctactcaggaggctgaggcatgagaattgcttgaacctgggaggtggaggttgcagtgagccaaaattacgccactgcactccagcctgggctactgagtgagactctgtctcaaaaaaaaaaaaaaaaaaaaaaagaggtgaaggctgggcacagtggctcacacctgtaatcctagcactttgggaaactgagacaggcagatcagttgaacccaggagttcaagaccagtgtgggcaacatggcgaaaccccatttctacaaaaatacaaaaaaaattagctgggcggggtggtggtacactcctgtagtcccagttactcaggatgctgaggtgggaggatcacctgagcctagggaggttgaggctgcagtgagctgtgatcacaccactgcactccagcatgggtgacggtgagaccctgtttcaaaaaaagaaaaaagggaatggtgagttcaggtttggctgttctgaatttaaaataaggaaacatcttggtaagtacctgttgtgggagtccccaagagatgccaggtttgacgatttgttaggagaactcacaggctcagtatgtagttgtactcacaactatgatttattatagtgaaaagatacaaagcaaaattagtggaggaaaaaggctcatgggctaagtccagaggaaaccaggcaaacttccaagttatctcccaatggagtccacagagtgtgcttcattcttccggtagcaaattgtaacagcacatatgaagtggtgtcagggaagcttgttagagactctacttgaggcttttattggggggctgtcatatagtcaccctgtgcctagcatgtaccagaattccagacttccagaaggaatgcaggtggttagcataaattacatgcaactgtttttaaaaagagttgaggcagactgaccccctcttatcagttctaggaatgatgggaaccttcccaaagtccaagttcgcaggtgacagccaagggccagccttgcaaataggctttcctaaggagagcggtcaggcctgctgtgttctcttctgcccggtagccatcagacatttggaaatacagcactggagttcaggagaaggagcaggtcagaggtataaaactggcagtttccacaaagaaattacaaagcattatcaagggcatggtccttgcactctggagtttaaaatctagcgtttagcatcagatcttctctgaaagagttactgagaattggtttcaaaccttgtgaaatctgtgatcctaacctagctgtgacatgaatatcacaaatataggcctaaacatacttggtatctggttctaagcatccagcttatcagaaggctggtataaataaaggcttcctaatagttggagaagaccttttttttcaccatgtagacttgtgtaccttcacttaataaatgattcatggtcttaggttatcatgtggttctgctctctagtgtagagataaccaatgaaagtgacagaaggctgggtgcagtgactcacacctgtaatcccagtgctttgggaggccaaggtgggaggattgcttgagcccaggagttcgagtttgagttcaagtaggcatggtggtccacacctgtgttcccagctactagggaggctgaggtgggaggatcgctagaacccaggaggttgaggccgcagtgagccatgatcgtgctgctgtactccagcctaggtgacagagtgagaccttgtctcagaaaataaataaatagaaagaacttgagttgggagatgagcagaggttgaggttttctgaaactttccccccaaccattatatttagtccacccctccccttgttttaaggctgttgaagatatttgaaatgatggtttcacacagactttcagcaactctactttgagggaacaaaccgactccctgaatactggtgctgaaagtttcacactagacttttactagaaagtttttcttttcttagggaccttccttttattgggtcctttgcttaactctgttttcttttatttctattcagatgaccaatttgcagatcaaggaagagaaagtcaaagcagataccaatggtgagtcactagtaactacaagctagaaaagagttccatgtgggccgctgctttgcactcatagctgcattgtacaaagagctgtcatttcgtgtaaacttcagctgtttacaagccagtgaattagattttgttactgaagggatatgtcgattttccacattttatcctttgacttcttaaaattaagagtctctctattggattgtactgctactgttcatttgataatattttggcaaattatttatttatttatttatttatttatttatttatttatttattttgagacggagtctcgctctgtcgcccaggctggagtgcagtggcacaatcttggctcactgcaagctctgcctcctgggttcataaccattctcctgcctcagcctcccgagtagctgggactacaggcgcttgccaccacgcgctagtttttttttttttgtatttttagtagagatagggtttcgccgtgttagccaggatggtcttgatctcctgtcctcgtgatccacccacctcagcctcccaaagtgctgggattacaggtgtgagccactgtgcccggcctaaattttttattttttatattagatttttaaaattttatttgagacagggtctcactctgtcgtgcaggctagagtggagtggcgtgatcttggctcactgcaacctctgccacccaggctcaagagatcctcccacctcagcctcccaggtagctgagactacaggcatccaccaccacacctggctaattttttatatttttagtagaggcggggctttgtcatattgcccaggctggtcttgacctcctgagctcaagcgatctgcctgcctcagcctcccacagtgctgggattacaggcatgagtcactgcacttggcctaattttattatttatttatttatttttatttttttttgagacagtctcactctgccacgcaggccggagtgcagtggtgtgatctcggcttactgcaagctccgcctcccaggttcacgccattcttgtgcctcagcctcccaagtagctgggactacaggcgcccgccaccatgcccagctaattttttttttgtatttttagtagagatagggtttcaccgtgttagccaggatggtctcgatgtcctgacctcgtgatccaccccgcttggcctcccaaagtgctgggattacaggtgtgagccaccacgcccggccaattttattttatttttttaaataaaatccagatcctgcatgaggtaaattttttaactttttgaaaagtgaatctgggttcaaaactcagaaagtataataaagtacaaggattagggcccaccctagtgacctcatcttaactacagctgtagcaaccctatttcaaaataaggtcacattctgaggtactggttaggacttgaatatatgagtttgaggtcagcgggccacacacaattcagctcataacaccatcctatcccataagtagccactgttcatggatttttaatattcttccaaagactttatgcaaagcaaatataagtgtagattctcatattctctctctcaaccaaaacgtggcgtgatatatacagtatacttactttttcactcaacagtatcccttggcaaactttccatatcaatacatgcagtttcatccatgtctttttttttttttttttttgaggcagagtctttctctgtcacccaggctggagtgcagtggtgcaatcttggctcactccaacctccgcctcccgggttcaagcgattctcctgcctcggcttcctgaatagctgggattacaggtgtccgccatcatgcccagctaatttttgtatttttagtggagacggggtttcaccatgttggccaggttggtcttgaactcctgacctgatgatctgcccgcctcggcctcccaaagtgctgggattacaggcgtgagccactgtgcctggcccttccttgtgttttataattatgtgatactgcattgtgtcgatctaccacgatttttttttttttttttttttgagatgaagtttcactcgttgcccaggctggagtgcaatgatgtgatctcggctcaccgcaacctccacctccggggttcaagcgattctcctgcttcagccttccaagtagctgggattataggcatgtgccaccacgcctggctaattttgtgtttttttagtagagatggggtttctccatcttggtcaggctggtctcgaactcctgacctcaggtgatccgcccacctcagcctcccaaagtgctgggattacaggcttgagccaccgcatctggctgatataccatgatttttaaagcaatcatagatgtttgggtggtcccattcttttgctattataaataatgcttcatgaaataaccatgaacttagctctttttacatgtatgcaagtgtctgtaggataaattccccaaaaatggatttgctaggtcaaaggtatatgcatttgcgattttttctttctttctttttttttttctttgagatggattctctgttgcccaggctggagtacagtgggggctcactgccacctctgcctgccaggttcaagcaattcttctgtctctgcatcccgagtagctgggattacaggtgcctgccttgcatgcccagctaattttttgtatttagtagagacagggtttcaccgtattacccagactgctcttgaacttctgagctcaggcaatccgctcgcttggcctcgcaaagtgctaggattacaggcacgagccaccacgcctggcctttttttaaaattttttttaagacgtgatcttgtaggttggacacagtggctcatgcctgtaatcccagcactttgggaggccgaggcgggcagatcatgaggtcagccctatcagattggcaaattctaaaagtttgactattaattctgtgatgagattgtagggaaacactctcattcttgctgatggaaatattaattggtggccgggcacagcggctcatgcttgtaattccagcactttgggaggctgaggcgggtggatcacctgaggtcgggagtttgagaccagcctggccaatatggtgaaaccctgtctctactaaaaatacaaaaattgcccgggcatggtggtgcatgcctgtagtcccagctactcgggaggctgaggcagaggaatcacttgaacctggggggcaaaggttgcagtgagccgagatcgtgccactgcacttcatcctgggcaacagagtgagactctgtctcaaaaaaaaaaaaaaaaaacacaggctcttgctctgtcacccaggctgcagtgcagtggctcaaactcctgggctcaagctgttctcctgcctcagcctcctgaatagctgggattataggctaattttttaaatttttagtagagactaggtcttgctatgttgcccaggctgacatttgcaatttttgtcagtattttcaaagtcttttccttaggtattataccaattaatatttctggggtttttttttttctttttttgagacggagctttgctcttgttgcccaggctggagtgcaatggcgtaatctcagctcactgcaacctccgcctcccaggttcaagcgattctcctgcctcagccttcccgaatagctgggattacaggcatgcgccaccacacccagctaattttgtattttttagtagagacaggttttctccatgttggtcaggctggtctcaaactcccgacctcaggtgatccacccgcctcagcctcccaaagtgctggaattacaggcatgagccgctgtgcccagccaccaattaatatttccatcagcaagaatgagagtgtttccctacaatctcatcacagaattaatagtcaaacttttagaatttgccaatctgataggtaaaaaatggtagactatgtttgctaataaggctgtattttaaagtagggctagtaagaggtaacatattctgatctgtctgaaattagtcaaaatttctagaaatttaaaatttttcaccaggtatagtagttcatgccagtaatcctagtgctttgggaggccaaggcaggaggattacttgaggccaggaatttgagaacaggctgggcaacatggcaagactccatctctacgaaaatatttttgttttaaattagctgggaatagtggtgcatgcctgtagtgctagctactcaggaggttaaggcaggaggatgtggtggcatgcacctgtagtcccagctaagtgggagcctggggtgggaggatcacttcagctcaggaggttgaggttgtagtgagctatgattgcaccactgcaccttagcctgggcaacagagggagaccctgtctcaaaaaaaaaaaaatttctagaaataaaaattcactaaacataaagaaatgccaactatttatattttgattacttaaaataacttttcaggctggacgctgtggctcacgcctgtaatcccagcactttgggaggccaaggtgggcggatcacttgatcgaggtcaggagttcaagaccatcctggccaacgtggtgaaaccccgtctctactaaaattacataaattagccaggcatggtggtgcgtgcctaatcccagctactcaggcggctgaggcgggagaattgcttgaacccaggaggtggaggttgcagtgagccaaggttgcgccattgcactccagccttgggctacaagaggaaaactccgtctgaaaaataaaaaaataaaataaatttcagtgtatttatttatattgtcccacatttttggtggttctcatatttgcctttctaattatgacaattgttttcttgtgtaggtattatcaaaaccagtaccactgccgagaaaacagatgaagaggagaaaggtaactacttttggatgcccttggcaagagacggtatgacccagggcttgccttcctggagccaggggcactccaagctacaagatccaggagatgagaggaatcagagaaggaatagtcagtgagaggaggagaacaaaacaagtccgaaagcggtagctcacacctgtaatcccagcactttgggaggccgaggtgggaggattcctttgggccaggagttcaagaccagcctgggcaacatactgagaccccatctctacaaaagatttcaaaatgagctgggtgtggtagcacacacctgtactcccagctacttgggaggctgaggtgggacgattgccagagcccaggaattctagactacagtgagctctgattgctccactgcactccagcctgggtgacagcaagaccccatctctaaaataaataaatagagacctatcagtgtgatggtttttctccagccgtgcttgactgcccaggtgctagtgtggagagggagaaagagtggcttcataagcctggggtttgccagatgagtatgaagatctactggtttcttcctgacagaggacagagctgcccagtccttactcaacaagctgatcagaagcaaccttgttgataacacaaaccaagtggaagtcctgcaacgggatccaaactcccctctgtactcggtgaagtcgtttgaagagcttcggctgtgagtattcgctcctttcaacagctcttcgttgccagtctctccccacataaaacttagcatctgagagattcttgtgagaattttacttttaaaaatttagtgtattttttccttttttttttcgagacagagtttcgctcctgttgcccagcctggagtgcaatggcgtgatctcagctcactgcagcctctgcctcccgggttcaagcgattctcctgcctcagcctcccaagtagctgggattacaggcgcccaccaccatgtcaagctaattttttgtatttttagtagagacggggtttcaccatgttggccaggctggtcttgaactcctgacctcaggtgatctgcctgcctcggcctctcaaggtgctgggattacaggcgtgagccaccgtgcctggctattttttttctttgaaaagaagtcacatgaataagtcacatgattcaaaagtcaaaaagtatgaaaaaatttgcagtattaatctcccacccttgtgtccttggctatcctgttctcttggtaggaattttttaatgcttcaaattgatttatcatagctaaaagtcttatttctcttatactcttagaactttcaataaaatattggctgacaggtgatttctggatgtcaggaacatttctgattaggtaagcccttaagtgagaacatgtgctatttgttttttttttacaaaaaaaaaaaaaaaaggccaggcacagtggctcacacctgtaatcccagcactttgggaggccaaggcaggcagatcacaaggtcaggagttcaagaccagcctgaccaacatggtgaaaccctgtctccactaaaaatacaaaactcaaaacttagccaggtgtgatatcacaggcctgtaatctcagctactcaggaggcggaggctgaggcaggagatcacttgaacctgtgaggcggaggttgcagtaagccaagttcgtgccactgcactccagcctgggcaacagagcgagactctctctcaaaaaaaaaaaaatatatatatatatatatgtatatttagactatagggtttacagtcttacagtttatctgctttttaaaaaatctgtcaaatctgtttttggtttgttttttttttttttttttttttttttttttttttttgagaccaagtcgtgctctgttgcacaggctagagtgcagtggcgtgatctcagctcaccacaacctccacctcccaggtccaagcgattctcctgccttagcctcccgagttagctgggactacaggcgtgtgccacaacacccagctaatttttgtatttttagaagagacagggtttcactatgttgggcaggctggtctcgaattcctgatctcatgatctgcccgcctcggcctcccaaagtgctgagattacaggcatgacccactgtgcccggccttacgttttaggtttacttcagtaaattaatagaggattaagtgtggatcattgtgttatatacatgccactgtgctggatgttacaaggaacacaagacctacttattattcttgctgcctgccaggatcacaatcatagaaagtagctgatgaataagaatatggtggaatcaatggattctttgccttagttcagcaaaatctatagtatggccactatggacaaattgaagccacattccttccagctattaccactgagaaagagacacttaaaacaagaaagctaactagttgttaagtaatcttgaagaacaattttttatttttattttttatttctattcatttatttatttacttttgagactgtctcactctgttgcccaggctggagcgcagtggcacaatcttggctcactgcaacctctacctcccgggttcaagcgattctcgttcctcagcctctcacgtagctgggattacaggcctgagccaccacacctggctaattttggtatttttagtagagacagcgtttcatcatgttggccaggctggtctcaaactcctggcctcaagcgatctgcccgcctcaacctcccaggctgctgggattacaggcatgagccactgcacccagccttatttttttatttttaaaaatagagatgtggtgtcactgtgttggccaggttgctcctgaactcctgtggtcaaagagtcctcctgcctcagcctccaaaattgctaggattacaggtgtgagccactgcacctggcccaataactttttttttttttttttaataggatgaggttttaccatgttgcccaggccagaccaaaaatgtatttttaaacagttatactttaggtcgggcacggtggctcacgcctataatcacagcactttgggaggtcaaggcaggtggattgtctgaggtcaggagttcgagaccagactggtcaaaatgatgaaaccccatctctactaaaaatacaaaaaaattagccggctgtaatggcacatggcttgtagtcccggctactcaggaggctgaggtaggagaattgcttgaacccaggaggcggaggttgcagtgagccgagatcatgccgttcgttgcactccagcctgggagataaaagcgaaactccttctcaaacggaaattatgcttttctatgtgttttctctgtcaaggactttattcaccaaatctgtcatctccacttttatttttaagctgtatcaggacagctagacatgtggtatgatttccttagagtgacagtttgctcctccaagtatcaactgcctttttaaatttcttccctttagaagacgtgagctctcagtttaaccactgatgaattgtcctctgtaaaagacaggttctctctgatttagttgttggtaggaaaaggaaacaaagaatgaaaccaagatcacctaatgtacttggtctgctttgtacctaaaatatttgagttaatctgcaaaatcaaagaaaactgagtcagtggaagctgttggatcatttgagtcccaattaaggtagtgactttgtttccttggcaaccaagtcagaagctgccgagtgtcacagcattttctcccaaatggaagatatgaaagattatgtttttaaatttctttgtgtctgagaaccaacatacgccagagaatttgccttttagagagcctgctaaactccaaggaaggcttagagaacagttgggttgccttttctttagaaacaatctggtatgatttttcttaaacatcttgtcaatttagaggtagcagagagctgattgtaaatgcaatgtaagagcaacttaaattgataattcttgtgtagctgtttacataagaagttggtgtccaggtgcggtggctcacgcctgtaatcccagcagtttgggaggctaaggtgagtggatctcttgagctcagaagttcatgaccagcctgggcaacatggtgaaaccttatctctacaaaaaataaaaaaaaattagccgggtgtggtggcatgtgcctgcagccccagctactcaagggtgggaggatctcttgaggcctgggaggtgtcggttgcagtgagcccagttcacacaactgcactccagcctgggcgacagagtgagaacgtctctcagaaagaagtagttagtgtttgtctgtttattttgattagacctaagtgaatctgagcatttgtaaagtttagtaggttaatcgaaccacctttatttactgtatatcagctactagaaactggcttcatcaattttctttttttatggccgggcgctacagctcacgcctgtaatcctagcactttgggaggccgaggcaggtggatcacctgagattaggagttcaagaccagcctggccaacatggcgaaaccctgtttctactaaaaatacaaaaattagccaggtgtggcagtatgcgcctgtaatcctagctcctcagaaggctgaggtaggagactcgcttgaacccaggaggcagaggttgcagtgagccaagatcacgctattgcactctagcttgagcaacagagcaagactccatctcaaaaaaaaaaattttttttttcttttttctttctttctttctttttttttttttttttaagagatgacctggccttgttgcccagcccagagtgcagcggggcaatcatggctcgctatagtctctaactcttagcctcaggcaatcctcctgcctcaatctcccaagtagctaggactacaggtgcatgccaccatgcccagctcatttttcttttttgttttgttttgttttgttttgttttagagacagggtctcactgtgttgcccaggccggtcttgaacgcctggactcctcaagcagtcgtcccacctaggcctcccaaagtgctgggattacaggcgtgagctaccacgcccagcccatcaatttccttacctattgattgtctggagtatttgcatagctggctttggaaggaacatggaacaaaaggacttctaaatcttagcagtatagtaaatagtgtttattttcatttattatttactttagagtcccactctgtcaccctggttggagtgcagtggctcagtcacagatcactgcagccttgacctcctgagctcaagtgagcctcccacctcagcctcttgagtaactgggactacaggtgtgtccagctattttttgtatttttttgtagagacgaggtatcaccatgttgcccaggctgttctcgaacttctggcctcaagcagttggcctgccttgacctcccaaagtgctgagattacaggcatgagtcactgtacctgacctgtttttagatatatcttttataatttatgtaatgctatgaattaataaccaccacccttgctgtgtccagggaacacttgtcttccaaggccagccagatttgcgggtctgctgaaagcattaatttctctaagaaaagaaaccattctgtattttatgaattatagaatagttgcagattaagattccttagggaagggcggtagcttggtttgatttggtttggtttttgacagtgtttttttaaggcataggaaaatacgtctgacagaggtaggaggcatcattcctttctatagaaaaagataagattctaggcctctaaaacaattctaacttctaggcatccatcctctgtcttcctggcttcctaggaaaccacagcttctccagggagtctatgccatgggcttcaatcgaccctccaagatacaagagaacgcattacccatgatgcttgctgaaccgtgagtatgcagatgaagcgcatctcacccagtgtgattagatcaatcttccccaaactgcgtttttgtgcctgagaacagaaggagctgtttggggccacgtgtttcctcaggaatacagcttaggcaagtgcagagagaatcggatggagttagctacagtttctgcctttcccacttaacaatagaaacttatagagaaaggtagtgctttattccatgctatcttaaaaactgggcttaaggccgggcatggtggctcactcctgtaatcctagcactttgggaggccgaggcgggcggatcacctgaggtcaggagattgagtccagcctggccaacatggcaaaaccctgtctctactaaaaatacaaaattagctgggcacggtggcccaaacctgtaatcctagcactttgggaggccaaggtgggcggattgcctgagctcagtaattcgagaccagcctgggcaacatggtgaaaccccgtcttactaaaatcaaaaaaaaaaaaatatccaggcctgttggcatgtgcctgtagtcccagctactcaggaggctaaggcaggagaattgcttgaacccgggaggcagaggttgcagtgagccgagatggtgccactgtactctagcctggtgacagcaagaccctgtctcaaaaaaaaaaaaaaactaaactaaaaatacaacaattagcctggcatggtggcacgtacctgtggtcatgtagctgaggcaggagaattgcttgaaccccagaggcagaggttgcagtgagccgagacatgccactgcactctagcctgggaaacatagactctgtctcaaaaaaaaaaaaaaaaaaaaaactgggtttaaaaaatattattttgatgtgaatggtgttgcaataaattcaaaaacaaacaaaatattatttggaaatttttgagacctacacaaaggtgtaaagaacaataccaagaacacctctgtagccctatcctgccaagaaaggaagcaggtccagttgatagttgaagcccctgaattcccctccttccacatccttctcccaccctgacaagactaagttccttttgagacagggtctcattctgtttccccatctagagtgcagtggtgcaattacagcccactgcagcctcgacctcctgggcttaattaatcctctcacctcagcctccggagtagctgggactataggcatgtgccaccatgcccagctgactttaaaaaaacttttttgtagtttgagaagctgaggcaggtggatcacttgaggtcaggagtttgagaccagcctggccaacatggtgaaaccccgtctctacaaaaaatacaaaaaaattagccgggcttggtggcgcacacctgtaatcccagctgctagggaggctgaggtgggaggatcgcttgaacccaggaaacagaggttgcaatgagccaagattacaccattgcactccagcctgggcgacagagtaagactctgtctcaaaaaaaaaaaaaaaatttgtagagacagggtatcactatgttgccagggctggtctcaaactcctggcctcaagtgattctccagcctcagcctcccaaagtgttgggattataggcatgtgttactgcacctggcatatttatcattttttcttttttgagatggagtctcctctgtcgcccaggctggagtgcagtggtgcaatcttggctcatttcaacctctgccttccaggttcaagtgattctcctgcctcagcctcctgagtagctaggattacaggcgcacaccaccacacctggctaatttttgtatttttttgtctgttcgtttgtttttgggatgaagtctcgctctgttgcccaggctggagtgcaatggcgcggtctcagctcaccgcaaccttcgcctcccgggttcaagtgattctcctggctcagcttcccgagtagctgggattacaggtgcctgccaccatgcctggctaatttttgtatttttagtagagatggggttttaccacgttggccaggctggtctcgaactgctgacctcgtgatctgcctggctcagcctcccaaagtgctgggattacaggcgtgagccaccgcacccagcctaatttttgtatttttaatggaggtggggtttcaccatgttggccaggctggtgtcgaactcctgacctcaagtgatctgcccaccttagtttatttatttatttatttatttatttttttgtgagatggagtctcgctctgtcgcccaggctggaatgcagtggcgcaacgtctgctcactgcaagctccgcctcccaggttcatgccattctcctgcctcaaccttcccagtagctgagactacaggtacccgccaccacgcccggctaattttttatatttttagtagagacggggtttcattgtgttagccagggtggtctcgatctcctgatcttgtgatccgcctgcctcggcctcccaaagtgctgggatgacaggcgtaagccatatttatcttttttaatgacaaccatgccacctattcccatgatgctgggtcccataaaatggaatgtaaaagttccctctaaaacatccacctgacttagcatcttgtccataaaactggggaaaggcacacacagaaggaaccaaattctgggaatgcatcatggctcagccaaaaatattgctggggtcttgtctgggcacagatcttactctgcacacttgatttccctgtgccccttggggtgcaaaactggggtcctttagctgtgctagaggctagaatgagaatttcttggtgtgagcccatttaaaataatcatttattttacaatttaagcagctttttaacagcgtataaaaaaatgtatgaaagtaatttgtgctcaatggagaaaacctgggtaatatagagaagcacgaagggggaaatatgcctttcattcagaaagaacattttgacatgttactgagtttcaccaatttaagtttcatttctgttcttccttgatccagcccacagaatctgattgcccagtctcagtctggcactggtaaaacagctgcctttgtcttagccatgctcagccgagtggagccatcagacagatacccccaggtgagggcttgcggggctgggtgtcctaggttgcctgccctggggagcgcagtgccatctggtgaggagtaacgagaggtctgaagcttctgacaccttaggctgtggctcaggcagagcaagttcctacaccaggccctgacctgggagaatgtgcttgaaagcagcagccttagaccatggcttgcaaaggcctctgccaagccagggctacctgctgcaggcttcagtctatggctgaaaggtgggcctggatgggaggacatgcttccctgtgctattcaagtgctaataacatcagcatactgggtgccttcaggtctgttaccaaatggctctcctaaactcatcctttatgatttttctgtcagtgtctgtgcctctccccaacatatgagctggcgcttcaaacaggaaaagtgattgagcagatgggcaaattttacccagaactgaagcttgcctatgccgttcgaggcaataaatgtgagtacggcaggcgacaactgaacagtgagcagggtagggggttgggcgtttgaattttgaagatgcgatgaccgtattcaactttctaattcagtctgaccctggagcctaactgtgttgctctatttgaatctatttgaatacctgctaatttgttaacagtctttttcagtcttaaaataagattttcggttgattaaaaaaaaaaatccacgcatggctcacagagttcttaatatctagagttcttcgctcagaaggtagagttttgaatttagcgtccagagttctgggacctgctaccaaagagggattaacaggactgaggatggaaggttggggtcagctccctttctttaaaagtaagcaaaaccaggtacagtggctcacacctgcaatcccagccctttgggaggccagggtgggaggactgcttgagcacatggttcgagaccagcctgggcaacatagtaagacaaaaaataaaaaaaaaaaaatagccaagcgtggaagtgccagcttgtagtcccagctacttgggaggctgaggcaggaggatcgcttgaacctgtgtggtcaaagctgcagtgagccatgactgtgtcaccgcactctagtctgggcaacagagtgagaccctgtctcaaaataaataaataaataaacataaaaagagttggatgatgttggattataggaggaagaagaagggaactgatgcttattgaaggattgctgtgtgggatttgatcctgaccacagtgcactgagataggtgtcattctgcccacttcacagcagaagagaccaagactgaggggaacactcatgtgtgttttgaaatctggaaataacttgttctcctagtcctagaaggatgggcagggctttgatttccagagctggctttgcctttgaaatacctatgaaaatcacctgggtctccacagtggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggtagggatctcgagggtgggggactcctcagactccccatctgcagtgtcttctcccttcacttcagacgcctcctctggcttctgcctgggtcttggctctcgtactctcagcagcatttgtttgacgggccatttccatgtcagcgctgatcacagtccctcccaacctgggttgagaaaggagacctagggactcttccccaacccttgtccccatcccaggcctgctgctcctcctccccaagatgctcctcccccatcagccttcctgggcatctagaccctcccagctggggaggctgtgcttccgttgcttcccagggccacctggggccatctacccgggccttcccttgcaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatgtgagtagcagcggcagtggcaggcctggcccctccctctcagccagctccccacagggctcaggaggactggatgcccctgagcgccatggaaagaagggaagtgctttttgaagatgtaagagacaggctctcctttagtgggggtaatggtagtatcccaagggatacatagcctaaagatagagcccctgaactttatgtcttatttgtggatgatgtattgttgcacaacccaagagaatcaactcatatttgtaagaaaaataaaaaattcaacaagatggccgggtacggtggctcatgcctgtaatcccagcattttgggaggccgagatgggtggatcacgaggtcaggagatcgagaccatcctgactaacacggtgaaaccccatctctactaaaagtacaaaaaattagcgcggcgtggtggcgggcgcttgtaatcccagctactcgggaggctgaggcaggagaatggtgtgaacccgggaggcagagcttgcagtgagccgagatcacaccacggcactccagcctggcaacagagagagactccgtctcaaaaaaaaaaaaagttcaacaagatagtcataacattcacacacatagttttccagtctcaaacaacaaatacttagaaaatggaagcatagatctcattgataatagaaaaaataaatatttaagatctctgaagaaaatgtcaaaatgattttagaataaaagagacaccggagcacggtggctcatgcctgtaatcccagcactttggcaggccgagacaggcggatcacctgaggtcgggagttggagaccagcctgaccaacatggagaaacctcgtctctactaaaaatacaaaattaactgggtgtggtggtgcatgcctgtaatcccagctactcgggaggctgaggcaacagaatcacttgaagctgggaggcggagattgcagtgagctgagatcgtgcccctgcactccagcctgggtgagagagcgagactccgtctcaaaaaaaaaaaaaaagaggccaggcttagtggctcacgcctgtaatcccaacacctttggaggccaaggtagaaggattgcttcagcccaggagtttgagaccagcctgggcaacgtcgggagaccccatttctaaaacacttaaaaaaaattagctggatgtggtggcacacacctgtagtctcagctactcggaagactgaggtgggaggatcccttgagcccaggagttagaggctgcagtcagctgtgatcacgccactgcacttagcatgggtcataaagcaacactctgtctcaaaacaaggaaacatacaatgcaatgatacagtgataacagtaatatatctctcaaatataatccacgttctcctatctccacttgtgccaaaagtattctttttttttttgagaccgagtctatctagctctgtcacccaggctggagtgcaatggtgtgatctaggctcactgcaacctccgcctcctgggttcaagcaattctcctgccccagcctccagagtagctgggattaccagcgcccgccatcatgcccagctaatttttgtatttttggtacagggggtttcaccatgttgcccaggcttgtcttgaactgctgaccacaggtgatccaactgccatggcctcccaaagtactgggattacaggcatgagccactgcgcctgacgccaaaaaatactctttttttttttttttagacggtctcactatcttgcccaggctggactcaaactcctgggctcaagcaattctcctacctcaacctcccaagtaggtgggactccaggcacatggcactgtgcccagctcatctttattgctttttgttttgttaaatccaagagccagtcaagttttgcttgttgcatttagttgtcatgtctcttaagactcctaaatctagaagaatttcctcacctttattttattgcctctcattacaatgacatcttgaagcatccagggtagtcttttctttttgagatgtagttttgcttttgttgcccaggctggagtgcagtggtgcaatctcggttcaccacaacctctgcctcccgggttctagcaattctcctgcctcagccttcccgggtagctgggattacaggcatgtgccaccacacctggctaattttgtatttttagtagagacagggtttctccatattagtcaggctagtctcaaacttctgacctcaggtgatccgcccgcctcggcctcccaaagtgctgggattacaggcgtgaaccaccgtgcccggccaatctggtttttttttttttttttttttttttgaaacggaatctcgcctcttgcccaggctggagtgcaatggcatgatcttggctcactgcagcctctgcctcccgggttcaagcgattctcctccctcggcttcctgagtagctgagattacatgcacatgccaccacgcccagctaatttttgtatttttagcagagacggggtttcaccatgttggtcaggcttgtgttgaactcctgacctcgcgatcggcccacctcggcctcccgaagtgctgggattacaggcatgagccaccgcgcctggcccccagggtagtcttttactcctaggctcaagtgatccttcacttgatctcccaaattgctgtggttataggcgtgagccaccgtatcttgccccaggttaaatatttttgtggtataaattttcttttttttttcttttcttctttttttttttttttggagacaaggtcttgctccgtcacccaggctggagtgcaatggtgcaatcttggctcaccagcctcgacctctcaggtttaagcgattctcctgcctcagctccctcaagtagctgggacttacaggcctacaccaccatgcctagctaaattttttgtagagacaggtttggccatgttccccaggctggtctcgaactcctgagttcaagcgatccacgtgcctcgtcctcccaaagtgctaggagtacaggtgtgagccaccatgcccagccaggtacaaatattttcgtaagattacaagccaggtgacattgttacttcctgttgcactatatcgggtttacaattttaagaaatttagcttttagctgctaagtttcaggtacagtcttccagatcaaaaatatcttcagctgagcgtggtgcctcacacctgtactcccagccctttgggaagccaaggcaggataatgacttgagcccaggactttttagatcaccctgagtgacagcaagactgtgtctcaaaaagaaaaaatatatactcaaatactttcatttctcaattgttttttttcttccagactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggtgagcagaggacgtgtcccacctggtctgccaggctcggggtcccaggcccaattagagccagaaatccttgtatacagggaagtcggatggtctcagggagatgggtggggttggtgacactattcctttctaggagagactgtttggatttccctgaggtggtaagaactcacacatgccaggtgcggtggctcatgcctgcaatcccaaggcaggaaaattgcttgaaccctggagacagaggttgcagtgagccgagaatgtgctatagcactccatcctgggtgacagagtgagactctgtctccaaaaaaaaaaaggaagagggcaggcccagtggctcacgcctgtaatcccagcactttgggaggccgaggtgggcgaatcacctgaggtcaggaattcgagaccagcctgaccaatatggtgaaaccccatctctactaaaaatacaaaaattagccgggcgtggtggcatgcgcctgtaatcccagctactcaggaggctgagacaggagaatcgcttgaacccgggaggtggaggttacggtgagtgagatcgcgccattgcactccagcctgggcaacaagagcgaaactccgtctcaaaaataaaaaaagaaagaaagaaaaggaactcccgcagaaaccagtagtcctgacttggtggaaggaaatgtacaggcatctgactggtagagaacggagcctactcttccaggggcgcccatctccagaacattgtgtctcccagaggattaccgactgatctcatgattttgttggcacttgccaaagttctcttcttttcctctgggttctgttgcctgcctatatgtgtgccctctcttgtacccagagttggcctgtcccaaattctttccctctatcccaaagttggtacgcattgacctacctatggatgacagtgatttctgtctcctgtccttagtcctctcagcctccaactctccttcctgcaggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttagtgagtcccggggagggtcctgtgcctggcgccctttgctaagtagggcggggtggtgaaaggggtaggatcttctgtagccccaagagaggctctgtccctagcacactcccctcctttctgaccatatggcagttctcagggagcacacctggagacttcaggacccagggactccaaggacagctcccctgtgactgggcttcggggcgtggggctctgactgttgctgtcagtgactaggggccctgctgccccctgcttaggcacccggagcctttgggcctgaatgaatgattgctgtggcctgaggtggggcacattcctgggcagggtagagacttgtgtatctttcccccagataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcagaagtagagagaaactacctacctcacttcaaattatgtttggacttgacaaaaataggtgcaaatgatggggggcaatagaagaaaaaatttgcattttggaaaattgggtcctttccccacttttttaaagccacattcccccatctttataataatctggtcacagtggtagtcgctggccccaggaccccctcctgattttggctaggcatcgtggaaccagctccagcccctgaagaaacgatagatgtgcaggttgtgcggaagaggctgagtggaaaatggtgtgagccccaccgctgtgcatcgaatgagggaagtggcagcagagaggccagagctgccccctctctgtctcttcaatggacccttcacaagtgtttctcctgcccttggggctgtcttccttctcctgaaatccagagactttcttgctcatcccttctccctttcacttctgttctctgctgcagaaagcagacttgcatatccctgatgagcagctcggctacttttgtaaacttcagatttggagagaaacacgaaagtctgaatcctgaccccttgagagagagtgatctggcgagggccgatgaaggggctgggcctggtcttgccttctcttctctcggttgctccctctgcctaggcccctggtactcagtcacggcagccaggagaccccaggtgagtttctgagcgcatacgtagttggttcttacccccaggtgtcacacggggccgagagctgagcaagaatttggaatggaagttatgaccaagggaattatgctgttcatttataatagtggacattatggagagctctgattcctacataatatgaataaggatggataggccgggcgtggtggctcatgcctataatcccagcacgttgggaggctgaggcgggcggatcggttgagctcaggcgttcgggaccagcctggccaacatgatgaaaccccgtctctaccaaaaatagaaaaaaatatagccgggcctggtggcgcacgcctgtagtcccagctactcgggaggctgaggtaggaggatcgcttgagcctgggtagaggctgctgtgagctgaaatggcgccactgcactccagcctgggtaacagagcgagaccccgactcaataaataaataaggatggataaattgtagcgtatgcaccattcattatgctaagacattttaaagtaattatgagaaacgctctactaatgatttgtttttatttgtatttttctgcttattagacaaatatatactcatttt

SEQ ID NO: 36201 - DNA, 26459 bp, Homo sapiens; identical to SEQ ID NO: 36200

SEQ ID NO: 36202 - DNA, 8591 bp, Homo sapiens
atcctcaccttccctcgccttcctgttcctggcggagccgggctccgctcgtcttctctgtcttagggctggtgctggccctgcccacgcctagggctccggcgcgtcacgggcctcagctgggattcccgcgcccctcggacggccacgagactcgggtaagtgcctcacagactttgtgcgctaccccggaaaatgaggggcgtggtggggggggtcccgccgccctccgtatacttaggaccctcctgccagctggccccggtcatgattaggggccttgggccccgtcagccccgcctgtcttcccgtctccagagtaatcgcagcatctctcctgagctccgagtgtgaatccctgggaaaagctgaatccagaggtggggtcacagagagccgcaggcccgaccgggatgagaagtcctaatcggcgttctaggggcgttctaaaagaaggaaggaaggggatttgaaaggattgctcccgcagggctgtggccttaaagaggtggtgactggcaggttggactgacctgccgtgggctctcccttcctccccaatttaccttcgagaaaccctcgttgaggagacacccaagggctgagtcctcctccactttgaccttttgctattccatcacaaagaaaaaatggatcccaaagttaagaaatggaccagcacttgtttagaatcaggactggtgccttggtgtttggcctcttacctctgccacatggcttgcttacaagttaatcggattaatcaaacgcttttatgagaaagttttgttgtgtcacctggcagcctcgggtgttccctaagagggatttctttcttagatgtattactactttttctagggattagccaagcctagcctctcagatcatattgctccaggttccctcaaatgactaataagaatgtgatgtgtttgtttttgtttgtttgtttttgagacggagtctcactctgttgtccaggctggggtgcaatggtgcgatctcgctcactgcaacctccacctcgattcttgtgcctcaggctcccgagcagctgggactacaggtgtgtaacactacacccggataatttttgtatttttagttggagacggagtttcaccatattggccaggctggtctcaaactcctgacctcaagtgatccgcccgcctcggcctcccaaagtgctgagattacaggcatgagccaccgcgcccaaccgaatgtgatatttttatgaccatgagaaaagaagggctgcattctttggtgggtccgcaaaattaaaaaaaaaaaaaaaaaaagaaaagaaaagaaagaaaaggacaatgttaatgagctgttttctttttatcattttcttaaacaggctgcttgggtagacgttgacttgaaaggtccattcttttgtcatcttgctggttcccttaacaagacaacaccttggctagcaagataatatcttggttagcaagacaataaacttgggcatgtgctcaacagcaacctgtctaatacattttcatttaaaatcccctctgtactactcagaaatataagcaagttattatggtgcccagaaagggggcaaaggttccagggtcctaggagatgacaaggatttatcctcttcatctttctccgatcccagttagcaggaatactttagcctggaaggtgagtgtgcccctaaccaacctttacagatgggtgactgtttgggagcttatggctcactccttctctttaaagcagatgcattctggcaagctgcagcagcaaacctacccttttagacaccctgcgttttctcatctttcctttctacccctgcatctcccagtctctctcacttaacctccgtggaaactcatgctgcgtctctaatactttggaagatgaagaacaaacgccctggagagtgactgacaccatgtgacctcttgcttctgtagcacactgcatcttgcctgtgaatctttttttttttttcttttttttttgagaccgggtcttgctctgtcacccaggctggagtgcagtggcacaatcttggctcactgcaacctccgcctcccaggctcaagtgattctcctgcctcagcttcccaagtagttgggactataggcatatgccaccacacccagctaatttttgtatttttagtagaaatgggtttcaccatgttggccaggctggtcttgaactcctgacctcaagtgatccacctgcctccacctcccaaagtgctgggattacaggcgtgagccaccacgcccagcatttgcctgtgcattttttattgtattttaattatatcctttattctctccttcctaagcttggtgttcttaactttcttccagatcttccctccaacccccaaacacgatctctccttaagtaagaggcagggagggagaggggaaccttctgatttcggggtgggattgaggctaaaacccaagttagaactacctcccagaaacccagttccgtatccatcgagtgatcaaaaagatgctgctaaaatgtgccttgtgtttgctagggatgaggtgaaaatgagtattgaatgaggtggcattttggtccatggatttgcttgctatgaaagagaaaaaacatggaaaaatatattttgagagctgggtgagacccccaaattaatctaatccaagatgtttccctagtcattacattcctttttttttgaaacagaatctcactctattgcccaggctggagtgcagtggcgcaatctcggctcactgcaacctctgcctcccgggttcaagcaattctcctgcctcagcatccttagtagctgggattacaggcacgcaccaccacccatggctaattttgtatttttagtagagatagggtttcaccatgttggccaggctggtctcgaacttctgaccaccttggcctcccaaagttctgggattacaggcgtgagccaccacgccctgcctgagtcactaaattcttacactgttccctcctatgttagtccgctagggctgccgaaacaaggtaccacaggctgagtgacttaaacaacaaaaattaattttctttgacttctggaggatagaagtccaagatcaagatgtcggcaggtttggtttcttctgaggcctctccttggcttgcagatggccacctcccactacatccttagatgtgttcctctatgttgtctgtatcctaatctcctcttcctataagtacaccagtaatattgaattagggcccacccataataccctattttgctttttatttcactattagttttttttttaaagctatttttgccagttaatttaaacatcatgatcttcttctaatgataaaaatgcaagtcttcatgctaacaaaaggattggaagaaggatgaagcagatgtttcttctcccctacagcaatctggttaaatgaggagttaaattgagagctttcatgagaatttcagtccagttctgtgcaatgaagacgagtgattcaaaactttcactaacttgctctgttgtttgtaatataatgttattggaagagttattttaacaaaggggaactgttatatttctaaaacttttaaaattgttgccatgtcttgggaaaataacttcagtatctgtcttgataatttcttgccctgatgataccattgaaagtcatttctctatgtttccaaaagttgtacaattactagtaagatttatctgccagttaataatttttcttttcttccacatgcatgaaggagtatttgtaatgacttttatattttatcattaacattatttttttgaactcttaaaatgcgtattttttttttacattaatagacttccttttttcagagcaatttttggtttacagaaaattgagcagaagatacagagttcccacatacttcctttcccccacctcagtttctcctaagttattaacaacttacactggtgtggtacatttgttacaaatgatgaactaatattgatagcttattattaactaaaatatatagtttacatcagggttcactcactgtatgaagttctgtgggttttgtcaagtgcataacatctaccattttataatatatgccattacagtagcatacaaaagagtttcatttacctaaaaatctcttctgcgccacctcaaataatttcttctgagttaaaaccactgtgtggtgagagctccttccttttccaacctccttgtcctttatggaaatggtaagagcttttacccatctctctggtcccttttcattatgtgtgtatctgtctcccacatttgtaaggtctctagagagtcagtgacctggtctcctaatcagcttcctaaaggtgagtttcaagaattaaatccgtatttatatactcagatacagcatccaggcagtggcctatttttcctgattttattttgtcacctgctgtattttggcctttgacatgtggagatcatggcccccctacttcggatggacttcaatggatctaactcgaagaagactgaacccaggaaaagagactgtgtgagcattctcacaccaggaaatgggctgagaaacaattttggagtgagatggaaggagaatggtatggagtatctattcttagggaaatgtgtgctaggccaaaatctcactttttggttaaacactctcattctctgataacataaaggcctctaaaaatatatgcagaatatttggggtaaccttattattcattgcccaagttaggtcacctttcaaagtaaaagggaacattatgaataattatactagggcaacaggtataaatcaagtcaccctaccattagaccaagtgattttcactggttccttcattgtaagagtaactccttttgtttcctaaaaattgttaaaatgattccttaatgttgcatttgaaataaagggaaaaagacaaaaattagcaataaattcatgtaatgtctaggcaaggatttcttcagaagagagcaggtcaggtgtagttagatcagtagaactgtatgtctcagtggcaccattaccttttttttttttttttttgaagcagagtctcactctgtcccccaggctggagtgcagtggcacaatctcggctcactgcaacctccgcctcccaggttcaagcaattctcaggtggatcacctgatgtcaggagttcgagactagcctggccaacacggtgaaaccctgtctctagtaaaaatacaaaaattggctgggtatggtggcgtgcgcctgtaatcccagctacccaggaggctgaggcaggagaattgcttgaacccgggaggcagaggttgcagtgagccgagatcgcaccactgcactccagcctgggtgacagaacgagactctgagactctatctcaaaaaaaaaaaaaaaaaaaaaaaaaaactggagcaatttggagacaagattaaaaaaataataataacattgtagaatggtggccactcacaaggttacagaatttcccagtaaatgttttcaagggtggggcagaaggtatgatagacaaaagctttaaaaaagtcacacagtgcccatgaatgccagccctaggcctaagtcctaattactcaaactcaaactattttccatttcctacctgtgtggctctcaatctgtgctctgggctacccacattttttagtacttttattaattcttgagcagacacatacaatttttctgtgtaagacataggtaatactccagccatgtgcttcccctacagtttaaagaagagaatgcaacctcccccatctctggactaacctccatgccttctccaactacatccctttcccaactcccaagagatgaccactgtccaatttttatttatccctttttttttaagttttactatatgtttgtggcctcaacatgtcatagttttacatgtgtaaatggatctatagtgtacatattcttctgcaacttgctatttttcttcggcattatattcttgagattcatcctcgtttttgaacctacctgtaatctatttgtttctgctgctgaatggtattcccttttatacatactaccaaaatatatgcatcccttctactattgaaggacatttgggtgatttacaggtttttgaaattacagtgttgctagaaacattcttgtggagatctcctgtccacacctccaagaatccctctaagtaaacacctagaagtaaaattgctttacacaataccactgtttgcagagtgctttacaaataaccactgtttccaaaagcaaatacactaattggcacacacacacagcagtacataagggttttgattgctccatatcagctgagcccttgatattgtcagacaacttggttttcctcagtttgatagatatgaaatgttatatcctatgcttttaatatgtacttcttatatatttttaggtgcttattcctcactcatgcttccaagaagtacctgttaacattttttgccatagttttaaaattttcattttgtcctttcctcatggatctataggaatgctttatgtattcaggattctaacattttgtccattatatattttacatatatctttgccaagctggtacttattgttttacttttattatgctatcttttttgatatacacgaattattaacaatatagtcaatttgatttttaacgtttacattcgtcagtctttccctttatggtttacgctttttgtgtcttgttaaagacatctttccaggaacagcgtgaggaggacagaagcacccaacaggactgctcaagccacctgcgaacactgctgctaccatgcccaagagaaaggcaaaaggagatgctaaaggtgataaagcaaaggtgaaggatgagccacagaggagatcagctcggttgtctgctaaaccagctcctccaaaaccagagcccaggcctaaaaaggcctctgcaaagaagggagagaagcttcccaaagggagaaaggggaaagcagatgctggaaaggatgggaacaaccctgcaaaaaaccgagatgcctctacactccagtcccagaaagcggaaggcactggggatgccaagtgaaatgtacatttttgagagctctgtacttatagtgactctactgtttgaaatactatttttttaaatcaagttttataaaagtgtagaattttggcttttttaagttatgttgttagcacacaggacacttccttgttgtcttttgtggaaagggcaagtaccactaatagggtgtatctcagaaactgaattgaaataagggaaaataggattttctgtcctggtttttgaagattgttcttgattcccttgattcccaggagagattctctgacattcacgtgtcagccactttggcacggaagccttacagtgtggggaaccaaaacttcgtgtctcccctttccccgatgccatcagcatagacttgacttccttaaaccgagagttttgatgtggccttggcaaccctaaaatcagctgtgttaggtaacaaaactcaggctttctgttgatgacatcgagatggtgtcacttaaaagagccaagattcctgttttcagtttgtggattcatcctgctggttttactttagtccctccatgtcaaagtgggcctgagaaaagctcatacatgcctcatgtgaagtgtccaccctctctgaaaatctttcttgttcaaaacagcaacgacatatcttgttaacttttacggtgacttttggaggaggggagtttggaaattgtaaaatgttatagattgttgcctatttcctgctgaaagtaaatgtttttaaaaagtatcatataaagctgaatacaaattggtttggggggagatcctttcctacccaaagtcataaatatattctttactgccttgtggaaattttatagttttgcctttcacatttgtctttagtctgtcctgaactgatttttgtgaaaattatgagttagaaattcaacttaacatttttcatattcgaagtggttgtctctgcactatttactgaaaagttcatcctttccccagtgatttgtaacactgcctctttcataaattaaatttttgtgtatgtgtgtgggtcttttgatggtttctattctgactgacatcaatttgtctaatcttgtagcagtacagtacagtcctgattattgcaactttaggaaaaggtctgataaaaaccaagatgcctccacattttgtcataattgtaaccaatttcacctctgtctccagtatcaccacaaaattgttcttccttggagtgtcttggctattcttagccaactgttcctccatattacttctagaattagaccaacaatttataaatcaaacaaacccaagagcattgaaattttgattggatttgtattgaatttatagattaatctggtaaaccatgtcatctttacaatgttgtcttccaatacatgaatatggtacagctcttcatttacttaggcctttgaaatatctttcaataaagtttataattttctccat

SEQ ID NO: 36203 - DNA, 90223 bp, Homo sapiens
ccaacgttctctcccggcctcccgggcccgccgcctactcccgcgtctccgagctcctcaaccgccgcggtctccctgggcgcgcggcccgccgcctgcttccggggcgggcggactgggcgcctggtgccggcggccgcagcgacagcgcccccgggaagcagaggaggaaggagagaagaggtggaggtggccgcaggctgagtcgcggccgggatgtccgggcagccgccgccgccgccgccgcagcagcagcaacagcagcagcagctgtcgccgccaccgccggcggccttggccccagtctccggagtcgtcctgccggcgcccccggccgtcagcgccggctcttctccggccggctcgcccggcggcggtgcgggcggcgaaggcttaggggccgcggcggccgccctgctcctccaccctccgccgccgccgcccccggccaccgcggccccgccgcccccgccgccgcccccgcctccccctgcctcagcggctgcccccgccagcgggccgcccgctcccccgggccttgcagcgggccccggcccggctggaggagccccgaccccagctctggtggcgggcagcagcgccgcggcccccttccctcacggggactcggccctgaacgagcaggagaaggagttgcagcggcggctgaagcgtctctacccggccgtggacgaacaagagacgccgctgcctcggtcctggagcccgaaggacaagttcagctacatcggcctctctcagaacaacctgcgggtgcactacaaaggtactgggcgtgtgtcctgcggtgggagtggggcactgacccgacgtggccggccgccgctgcgccgctctcgacccgcccccgacccccgccctcgcgggctctgccctcggaggccactcgccgcctgttgtgctgctccgggtgggcgcgggggtcgcggtgaagggtccgagggtgaggggcgagattcttggaaaaggaaggtgagtagaatgccccagggtagaaaggagctggtaatcctagaccaggagcaggacaccttgagggaatccgggatgacaggacagaactggctttctgatttccctgggagataaatcttggggcttgggtagaggaatccatggactcggagttgggttacattgttctccaggtggtgggtcaggcgttctcctcttacaaggggggaagagaggcacgattctgaggtatgatttctaattaagagagagcagggatacacagggggaggagtaatcaaaattaggccagagattgtctagggggacaaaaggacaaggggcccaagtttgccatcaatatattttagtaaaagcaaccgggagggtaagagaagggaaccccaggaacaccctttttcttaggggagcagaaacctacccctcccgattggaagtgccctatacaggtccttaggtgttgatatcacatgaagtcttgttgaaaacgaagatggaacaaaatgcagcttagtattttgaagaaaattggcttatgttttgcacttgcagttaaaaacaacaaccttaggcttgtgcttgcccctttcctccctcacctacctctcctaggttaaaacaaagctggaagcaaatcagttgtatataaaattatgaattgctatgggaactattgaaatgtagcccaatttaatagcatgtatcaagtttacttgtgtggaagaaaaaaaaatcaacctaacgtatcagtcttgtctggaaacaaatccagggttttaggccccaaacctaaagcagaagcttttacattcacggcagcctcactttgattggctgtaaaggggtctactcagatcctagtgacatgtatgtagaggagataaacaaccttgtggttaaattcttaacttatacgggactgaaatttgagaagaagcttgataagtaagttactatttaatcagaaaggcgaatggcaatagaaatctaccaaatgatttggctgcaaagaatcacgcacaaaaataggccttgttgaacattctttttattctcgccatacatccaaagaagtacttccaagtgttatcctccttaatctaaacgtctgaacgtttcattcacaatatcaaatctttgttttttctcaagttaggaccttttgttaatttccttgtgaagtatttctacttttatgttttaatttgtgtgaacggtgctatgttatgaggtgtttacttctgatctggctgccagaaagctattgttagatgtgacagaattttataattttaaatttatggttgacagtaaataatttgctcataaagtcagagccagtgtagatgaacaaagaattctagatttcctgagttctgcagttgtttgtggttgtagatattttacaagactgagcctcagtttcttcctctgagtggtgtgtaagttgagctggacgattggtaaggaaatttccagctctgaatttccgtgatgtctaagattcgtgattactgtttatttagtactgtaaggtgtcttgattagttttagtcttttacataaaattgatgattaggtcagagaaaaatacacgtttatatgaaattagttggagtttggaatatttctgacactgctgtctcagttgtttttattcttggcctctttattactttctgttgtgtaatactaaggttcactttctgggaacataactgttttataaacataaatcattatttctggaagaacagattttgttgttatccttttatttttcctctcttctatctttcctttgtctctctcttaccccttgtcagaaagtctttttccctttctactgcctcttcctcttgtcttgttactgtagactgtgtgtgtgtgtgtgtgtgtgtgtgtgagttttccgttgttactgttgattttctgcgtgttttgtgagaggaccacgccgattgtggtgggcaactgtgtcccagtagcagtagcagtagcaaaggagaagtatcatagagagtagataatactttaaaatcacagaataagaagagtgaatttttatttaacctatcattgtgctgcattggttttacctaagtatcatgagacacttttaacagtaaaaactactattcatatattcacgtattacagaatttcaaaagaatgattttaattattttccagagtgacgagaattttccttatctttgaaatagaagtattttgctttcttttgctccaaaggtattctggttttttgttgttgttctggtgtttttgtgtatgtgtgtgtgataggatttcaactttgttgccttgatggagtgcagtggtgcgatcatggctcactgcagtctagacctcctaggctcaagggatccccctgcctccatctcccaagtagctgggaccacaggctcctgtcactatgctgggctaagttgtaatttttttttttgtggagatggggtcttactgtgttgcctaggctagtgttgaatgtttgggctccagtgatcctcccaccttggcatcccaaagtactggaattacaagcctgagccactgtgtccagcctgtattctgtttttaagatgttcttctaaattgaaattactgcttttggaagcagtattgttcctgaaatgatttgaagagattaatgttagataatactagacatgcagataaggttgattggattgcagaggaacaacagggtatgtatagtatatgtgaaatttttttaaaggccttttgcttagcagtcacacaacaactattgaaaaacccagggatagcccctcttatttttgaaattgttgtcagtattgaataagtacaaatgtgacaagtttagacttagttataatgataacgggaaaataattttaataaatatgacaatggacttagtttaaatgtttcaacaacagattgcatttttatatttttctagttattaccactatttggatattttatagagtgctttatatatacacacactagtggatctggacaagatcctggaattttcattttaaattttagagagtggtagaacctggaggttagatcttcccagtcatgagtaaatcaggattgaaaattttcactaactccagatttagtgttcttttcacaatcccatagtattgcctctttaagttcatatgagacttaattatctcaagtagataaaatcctgtgatcacatttagaacttttaaagaatagttgagattgaaaatacttactctgggggaaaaaggtaactggaacacagtgcttcagaaaagtccagacaccttgattttactaatttagaacagtttagaagaaatccaaggtaagtcaaagttgggaattataggaagcaatgaaatagtcaatttcagtgggtgtggtggcttacgcctgtaatcccagcactttgggaggccaaagtagaaggatcgcttgagcccaagagttctagaccagcctgggcaacatagtgggaccccgtctctacccctaaaaattaaccgggctaagtggcacacacttgaaatcccagccacttaggaggctgagggaggaggattggttgagcccaggaggttgaggcttcagtgagctatgatggcctgggtgacagagtgagaccctatcttaaaaaaaaaataagtaaataaatagtgaattgcattttttttttttttttttgagacagagtcttgctctatcgtccaggctggagtgcggtggtacaatctctactcattgcagcctctcctgggttcatgcagttcttctgcctcagcctcctgagtagctgagtagctgggattacaggcgcttagcaccacgtccggctaattcttgtatttctagtagagacggggtttcaccatgttggccaggctggtcttgaactcctgacctcagatgatctgcccgcctcggcctcccaaaatgccgggattacaggcatgagccactgcgcctggcctgaattgtcctttttttttttttttaagatggagtctcgctctgctgttgtcaggctggagtacagtggcgccatcttggctcactgcaacctccgcctcccgggttcaagcaattcttctgcctcagcctcctgaatagctgagaatacaggcatgcgccaccacgcctggctaatttttgtatttttagtagaggggaggtttcaacatgttggccaggatggtctcgatctcttgacctcgtgatctgcccgcctcgccctcccaaagtgctgggattacaggcgtgagccacagtgcccagccagaatttcactttttaattgaaatgttatgaacaataaccaaataggttgaacttttttgttgttttttgagaccgagtcttgctctgttgcccaggctggagtgcagtggcgccatctcggctcactgcaagctccgcctcccgcgttcacgccattttcctgcctcagccttccaagtagctgggactacaggtgcccgccgcgacgcccggctaattttttgtatttttagtagagatagggtttcaccgtgttagccaaggtggtctcttatctgctgacctagtgatccactcgcctcggcctcccaaagtgctgggattacaggagtgataggttgaacttttgttatacttactctgtctttcccacctgtacccccagtcattagcgcttgaacacttcctaaatataattgcttatctaatttcttgcactttttaagtttgaacagatatttcagcatgcttgcttacaagtgcaaatgtctgttaagcattacgggggtgatataaaaatgtttcttttttttttttttttttgagacggagtcttgctctgtcgcccaggcccaggctgcagggcagtggcgcgatctccgctcactgcaagctccgcctcctgggttcagaccattctcctgcttcagcctccccagtagctgggactacatgcgcctgccaccacgcctggctaatttcttttgtatttttaatagagagggggtttcaccgagttagtcaggatggtcttgatctcctgaccttgtgatctgcgcgcctcgtcctcccaaagtgctgggattacaggcgtgagccaccgcgcccggcctaaaaatgttccttaaaatgaaggaattgaagaattacttgccaagattttgggaaattaggtttaaaaatgccagttggtaactgcaagaatcaagtaaatctaataatcatgcagaacagtagacaataataatgtatattctttttttttttttttttttttttttttttgagacagaatcttgctctgtcgcccaggccgaagtgcagtggtggcactttgtcagctcactgcaacctccatctcctggattcaagtgactttccagcctcagcctcccaagtagccgggattacaagcgcctgccaccacgcctggctaatttttgtatatttagtagcgatggggttttgccatgttggccaggctggtctggaactcctgacctcaagtgatccgcctgccttggcttctcaaagtgctgggattataggcgtgaaccactgcacccagcctaatgatatatattctgctagactagacaatttatatgtgtttttcactgttcatttcttcatttatttaatgagcttttagtgaatgtttactttgtgctaggttctggacactcagaggtggagaagatactgtcattgaattcagagagctcagaggacataaaatagagtagtaagggaaatattatagagagtactgtggaaaataggaggagcgtataacccaggctgacattggaaagaatgaaggaagtgtaggtatcagggatagcttcttggaggagtcgaggctagtggtcagtcttaaaagatgagtaggatataggagaaagggaggggctaggtgttgcaaatgaaggaaaagcaaaaacatagagaattactttatgtgtctggttttacaagcaattttgggttggcatttagagtatgtgacaaggagcatctgggaaaagatcaattaggaggcttttttttttttctcttttgaggcagggtctgactccattgtccaggctagaatgcagtggtgcgatctaggctcactgcaacctctgcctcctgggctcaagtgatcctcccacctcagcatcctgaatagctgcaactacaggcacgtgccaccattcccagctaattttttgtatttttttgtagagaagggggttttgccatgttgcccaggctggtctcgaattcctgagctcaagccatctgcctgccttagcctcccaaagtgctaggattacaggcaggagccactgtacctggcccagttaggagccctatggaatattttgttgagtttagatcttattctgtaggagatggagaatcatcaaaggattttaaatgggaagtgactggctcatatcttcatttttgtcagattacgcagctgattggaagatagattcaagaggttacaagagtgggaatagtaaattcatttagaagactattgcagtagaccatgttagaattgacctcagctgggtcagtggtaaggccagagaaaggcagatatatttgtgagatatttaaaagtaatactgagaggatatgaggaatgatagtgagagaaatcaaagaaaatgtttgggtttccaactctgttaggatgatgtttgggtctttagctgttaggctcttgcagtgaaccatgaataaaataatgattgtgaaggagactgtattacagtatagttggagataagtaaaaatgggaatctcagccctgtgatctgacttcatggaaaccagaagaagccaaagaaacaagccttacagaaagaacaggaacaggtcttttggagttaaggggactctaactggtcttaatagtcatgacttaattctattctattaaaatgactcagctccaatcactagtttctggttgttttatttctttttccctactgactggcttatcctttccttcctatgtcaaattcctgagagacttaacagattggcctggctaattgctatgattcttagttgggcagagcttttcaatacagactatgttgtgaattggtggccttcaagtcaggtgctaacctgtgttgaatcagctgtaggaatggtggtaattataaaatacaaaataccctgctggtacaaggatagtctgggtctcacttctttcggtaggggcaatgtgtgaggcagtttctcctaggaagggttggcagttaaccataattgatctgaagcttgggagagaggtctaggtcgtgactgatttaggagtcacttgtaggtggtagttgaaactcagagtatttgaaagagagagggagaatagagtgagaaaaagcagtgggccaaagatggggaccctgaagaacaccaacattgaaagactagagggagcacaaaagaaatggtaggtccccagacatcaaggagattggtgtcacagaagctgagcacgggagggtgcagtggctcacacctgtaatcccaaaacttggggaagtcgaggtgggaggactgcttgaacccaggaagttgaggctgtagccagcggtgatcatgccactgcattttagcctgggcaacagaatgagacactgtctcaaacagcctccccaccttccctagaaatgaggaagtgatatttagtgtctgttgcaacagataggtttagtaggataggcacagatagttttccactacgtttggaaattagatcattgtgactttagggagagcagtttgaattgagtgatggggcaaaaaccagatttcagtgggttgaaagagtaaatgaaaggaccaagtagagaggatagtgaatagagattatccttgagaaatatagatgaaggaagagatgaggcatttcctagaggaggatggaggttaaggtaggattttttttttcttctaatttttaacggctgatagtggagttacgttttacctggtgtttagcttctaatgtcagcatagaagatgaaaatcctacataaccaaaattatccttaaaaattcctttggaaagtattgtgttagagaccactgtgtcatttcttagtcaatcttgttttaatttggttgtataggtaaaactgaagcgacataaattaaatgaaaatactatattatattagtccaaggtatggtgttccaggaaatgtatacaaaatttaacattttaacaaataaaattgattagcctacctggttattattactattttttcttgaacagagtctcgctttgtcaggccggatcccaggtttaagcaattctcctccctcagcctcccgaatagctgagattacacacacccgccaccatgcctggctaagttttatgtttttagtagagatgggatttcaccatgttggccaggctggtctcgaactcctgacctcaagtgatccacccaccttggcctcccaaagtgctgggattacaggcatgagccactgcgcccagccttgttattacttttaaggtaaaaaattatataccaccaactctggtacattactgacaatgatttatatgtagcacggaggcatagaatttgtgaaaagtgtacattttggggacattgtccctttacagattgaggggaaggagagattagagaggaagataatgaaatacaagcttgagaggctgacagagaggcttctagagaggaaactggttccagagtccagaatggttggtcttggagaggagagtacagactgttctttgataatagtggaagaggtgaagactgccgtggacatagatcactttgtaataaaagagtggagagttgaatatgaccatagctaatggcctctcgttttttgtttttttggttttttttttttgagatggagccttgctcttgtcgcccaggctggagtgcagtggtacaacgtcgggtcactgcaatctctgcctccagggttcaagccattcttccgcctcagcctcccaagtagctgggaatacagttgcgcaccaccatgcctggccactttttgtatttttagtggagatggggttttatgttggccaggctggtctcgaactccagacctcaggcaatccgcctgccttggcctcccaaagtgctgggattacaggtgtgagccaccgcacccagctggcctcctgttttcttgataagaggtgaggtactttgctcatgaatttgagtagaggatgtaaagtttaaagtaaatgatgaaaatgtggactaagccattgagagggatagggaataagctgacaacatttctaaaaatattgttggtagcattgagagtgctcagttgacatcattagttcatagcagtggctgttcataagattttggactttattcattggaagtcaactgtccagtgtgggagtatggaaggtagattatgatactgagagtgtcattttgctggttggatatgatagaatgatgggcatatgagggaaatcaaggatatttgagagctttaagtgattaccatgtagcctgtcctggaagaggaaaaagggagaaaaaacacaaagagtttgaggaattagagttcccatgatgttgaagtatagacgtgaaggctttagaaaggggatagaacaggatggtgtgttctggaggaagataccggtgtttctgcaataatgtcctgaatgcgtggctggaaaaccatgttttccacaaaatcaatgcgctaaaagtaacaggacttatgcaaactataaagctggagcaaccccttaaaaccttgggaactttgtaggcattaatcagaacactacaaaaattacagtcctagtaaaataaaagcccagttaaattttcactgtgcccgatattacaggtggcttggtctgttgcagctttagactctgggtcttgagcttttgcttcttcaagaaggaatgattgaagttagagtggaagttagcgggaataaagaggttcaggaattaaaacgcagggaaaaaataattaaacgtgagtgttaagtgtgtaaatgtgcaggagagatacatgttgctatgagggcttgtaaaaaggagcttcaaccaagttggagagattagagaaagaatatttgaggaagtaaagcttgagctaagatttaaagtgtgagtaggacctacctactcaggctaagaaggaaaggtggagggaatagcatgtttacagactggcctgatcaatgtgaagaattgaaatagtgctgatgcggctggagcagaaaggaggtggaaagtgcaggtggagagcaagaccagacaaggtgctcaggaagcgtgtctttttcctaggccaaagaggaggctttggaaggaatcttagttgtattgagggctactgatagaaggacggctgatttatatttccagaaaggcactggctggctgcatgttggcgactggaagggagtgggaatagggtagaatggtttattcaaactctttccatcagattgtttgaataaaaagagctaaacttgctagccttagaattaggaagtattacatatgttttcttctaaagccacatagaaaacacttaatactgaagactttgtagttttaaaagtttaaactttggtagtatgaggttgttttttggttaccacagaatttgaggtaataataaactttcaggtgatgagcattgttagaaataggccctttgctgctgatattacaagtttgagcatcccaaatctgaaattcaaaatgctttcagaattcaaaacttgattttttatttttttatttttgggacagagtctcactctattgctcaggctggagtgtagtggcgctgtcaggcccttgcaacttctgcctcccaagttcaagcgattcttgtgcctcagcctcctgagtagctgggattacaggcgcacactaccatgccaggctaatttttgtatttttagtacagacagggtttcaccatgttggccaagctggtcttgaactcctgacctcaagtgatcgcccgcctcagcctcccaaagtgctggaattacaggcatgagccaccacgcccggctcaaaggaaatgcccaatgaaacattttagattttggatttttggatttaggatgctcaactggtaagtatgcacaaatattgtaaaatctgaaaaaaatctaaaacacttctggtcccaagcatgtcagataagggatactcaacttggactggtctcatttaagaaataatatgaaaccttataatcttgcatttaaacttttccttataccttttacatctaatttaaattttaatttaaacatgaaacaaatctttttagttttaatatttacagaatttatctgcaattagtgaatcctaacaaatataatggatccttgaagatttataactggtactttatagtaatttttgcataatggaaaaatgtatgggattttaattcatgcatggatctaatatatgtttctaccaatttggggctgggtatataatgtgtaaacattttatttttttttctgtaggcccatgacagattacagatttcttcatttcaaaaagtgaggttaaataatacctatttcgtaaatgttgaaagagaaaaatccatacaaaagcacccaactctttgagagactgtttactttcaaatattggtttctttctcttttcccgtagaagtagtcagaataggacatggggatatgtgaagtgatccccgaatgttcattgtaactaaatccttcatgtgggttcagagctcacactagatcaggtttcttgaatttaaatcccagcacaaatcctggtttggaattcgcttttagcagtatgactttgggcgagtttcattatcttcccttggattcctcaactgtgaaatgataatagatagtacctacctcatggggttgttttggatattaaatgagttaataaacttaatgctcttagagcagtgcctttcacacggtattaaatatatgtaactattatttgttattaagaatactttgggattactttatcactaaaagtttgggtcactccccttaaaaaatcagtggatttagaactgcagttagattttgtttagatagttttctatagatttatttgtaacaatctaatttttaaatatgtagtttccatggccttttctcaggtaacttaattatttgaacatattttgactgaaaaatgtgttttactgccaccataattaaattttattaaaaagtgactagtgcacagacttgtgcaattgtttcttttctgctgcttagctcagtgtaaatctattacctgcatcatatgttgaagtagttttgatgcatgtaaatactgttgcttccatttttgtcttgcctagccaagcttgttgactccttatggtcaccaggctaaaagaacttctgcccataacccaagttttcatggtaatggaaggagtggcagaattcattccatttttttgtggggggagtggggggtgtgaacatgtactaatttgcattgcaagtgtaaacttaagtgtttaatagtaataaggcatgtgttggaaatttgataaatttggtcaagtgtgtggtaagggaggatatgatctcattcatgtgtgatgattgtatatcttaagatacaatttttgacttacaagaaggtatttagttttaaaacaatcataaatttaaggagaattctgctacccatgaagataattttatagtatgactgaaagattaatgcgaagtttgtattgcgtggagcatatttaactagaacaccccaataatgatttagagtattgtttctcatgcagtccttttggggatatggagacttgtctcactcatactctatgagtactttctgacatgctacttcaacttctttctttattcttccatggttttgtggacatattttctcttaatattgtctacatgctagctttcaaggtaatttgtgtcttgggcgagaggtaggggaagtgattgtgagtttagcaaaccctgtgggattagaattgaggaatagctggtttaaaaagtttgaaagccattatctaaaagattttctaaagtgtcagcagtggcatggtgttacttctgttgtttaaaaagaaaaaaatacgtttagaaattagatgtatttctcaataagctattattggcccaagagattttatgaatcagctttaattaataagactataccaaagaacaaaactgtaaattcttaagaaagctgttttgccaattcaatctaattgtgtaagatttcacttagaaatatacaatacagatgcttctggtttaaagagccaggactttggcaagagtgtacagaaattatataagttatatgcaaatttagacctgataaaattgagatctttctctcatgttcttcatacagcctttttcctcttaaaaatatagtgtactctataatgtcttttatttaatttgcataaaaggctgctaggttcaatttccatatttggattctgcaatcttaataaaactagtaatagtgtgaagagttctgtggttaacttgggctattttgcatattgggttcatggtgatgataaacgttttattgagtatttgaactgataggagcagaaataatacatcattccaaaaacctatatgttcctgaattgtttaaggttttcatctttcagtgaatatctcatgtgacttcttttttccttcctgtttctatgcaggtcatggcaaaaccccaaaagatgccgcgtcagttcgagccacgcatccaataccagcagcctgtgggatttattattttgaagtaaaaattgtcagtaagggaagagatgggtaagtaaattttggtgagaaaaatcgtttgctagtttttttgttttggttcataatgtttatgatgtaattggaaagttggaatcctggaaattttgctaattggaaaagtggaatctgaatatttcagtataacagattggatctggttatgcttaaatactagctgaagttaaagcttgagttggtgatattaactaagcttttctggtaggtttattattaaaatggagaatttggaattaaggaatgaagggatggtgactcattttccatgacttttcttacactgctttttcgtgaattctgctaagaagttaaatcctctcaaactagtaatcatagtcagttggtgattcataggtattttacagatgttggacttagaattttaggtttcagctgggaaatgtgtatttgtatgctctcaactagaggagattttcaaggtttaggatgtggtttagaaatttccaaatgagaattccatggtagggcctggaaccaaattttatatcattgcttttcagcttgggattggtgtgtggtttgtatgggtatcagaattcacttatgagactattaaaaatatagtaatttttgggccttaccccaaaagttcctaaattaggattttcagaagtagagctttgggcaagataggcattttgagaaagctccacactgaattttggtgcctatccctggttaagcactaattacctagaatcattggatctatcctatagtatttcctgataactttattgcatatcagaggtctcttaaagcagtcatagggtctttagttgagttaccaagacaaagcttattgagctgtgtggataagttgccctgtgaggtcagtcagatggacctcaaatcaaacccctcttagtggtcctcctgtgtttaattaaccaaataagtgtattcagtagattactcctttatcggctgaatattctcgatgtcaacagtatgagcaacagaaaataaaaacttggaattcagtgacagctttttatgtaactgcctcagttttcttagggtaatcaagccaaagagaaaatcagagatgccaaggatagagtggttgagagaggcccatattgaaataggcacacgattgtcaccatttctcactttacaagctgtataatcagtaagctgattctttttatacttcaaattatatgaacttgacctcatatttggctgcaaataccctgatgattctcaaatctaatgctacatcttagcttattccctcgagctccagacaatgtgtctaaccaaatgtttgcatttgaatgtcccacaggcatttaaatttagcttgtttaaaatctttttctgaaaaaaaaaaaaaaaaaaaaaaaacatttggttggtggtttcactattgctagaaacttgagaatttcctgcttttaacttttctgttcatctctactgcctctccctttgtcagatctcaattatttatctgctgaattactctcagatagttggttgatgggtctccagttgctgcctgttttgctcttattctagtctataactgttgtcagggttcttagtaataaaaaactgagttgcctctacccgttttttgagatatctgttgcttcaaggataaaatgtagagcttcttaacaggacccctcagatctgactagctcttgggtcatttttcagtctctttgtagccaggataccttaccctttttcttttgtttttaaaattaggtatattttacacatagtaaactttattctttttagtgtactgttctgtgagttttgacaaacatgtatagtcatataaccagcatcgcagttgatatgggagactccccttatctgtgggggatacattgcaagaccctttgtggatgcttgaaactgcagatagtactgaactctatatatactatgttttttttcagtctgataattgagagggctactcagtgactaaagggcatgtggtaaatacagcgttgatatgctagacaaaggaatgattcccaggtggggacagggcgggactgaatccaatggcatgagattttatcatgttattcagaatggcatgcagtttaaaacttacaaattgcttatttctggaattttccaattaatatttttggacctcagttgactgtgggtaactgaaacactgaggaaagcaaaaccacagataaatgcggactgctttatatagaacagctctatcatcccccaaaattctgccatactcttttgtagacaacccttccccatatctagctcctggtaactgttgactggttttctgtctctatagtttgtccatttcaagaatggcatataaatggaatcatatagtttgtagccttttaagtctggtatctttcacttagcataacacattcgagattcctccctgttgtatatattcatagaacagtccttttaaatctaattttgtagataagtgaaccaaagtttgcttacccactccccagttgaagaacttctcagtttccagttttttggctggaactgtaaacatgtatatacaggtttttgtgtaaacataagttttcttttcacgagtaagtatctaggagtgggattgctggattgtagttaagtgtatttttaactttgtaagaaactgccaaattgtttcacaaagtggctatactagtttgcattttgttctttttgtttgtttgtttttgtttttttcctgagccagagtctcgctctgtcacccaggctggagtacagtggtgcagtcttggctcactgcaacctctgcctcccgggttcaagcaattctcctgcctcagcctcccaagtagctgggattacaggcgcccaccaccacacctggctaatttttgtatttttagtagagacagggtttcacaatgttggccaggctggtctcgagcgcctgacctcaaatgatccgcctgcctcagcctcccaaagtgctgggattgcaggcatgtgccacaacacccggcctctagcttttacatatatacgtttttcatatatacatttttttctcctgagccagacagtaagttccttacagacatagttcttgtgtttcatgtgcttgttgagtgacagaaaccagccatgctgtggagggatatgatatctgctgccacccccggctaatcttttgtatttttagtagagtcggggtttcaccatgttgcccaggctggtgttgaactcctgagctcaggtgatctgtccgcctcggcctccaaaagttctgggattgcaggtgtgagccactgtgcctggcccactggtttgcatttctaccagcagtgtatgagagttcctgttgatcttagcactaggtattgtcatttttttttaaatttttagccattataataggtttctagtgatttcttgctgtggttttaatttatatttccctaatgactaattatgttgaagaatccctaattctcacctgctcttcacctataaggtaccatttggagttctctgactacgcatgctggcttatatttctagttccttatgcatgcccttccttcaccttctcttatccctttctctatttgcctagctaattaattggtcttcaagtcctagtttaggagtacctttcttatggcattttctccttaaagtaggaatatgccttttctatgcctcctttacattttggccagactgtaattatgatatttgtattgtttcaattgtctgcttactgccaacatgaccctacagatttaagagtaagggactattttaatttctataactccagtacttaacttatagctggcttttaaaggtatgaataaatgaatggattagaagaagtactatttcttgtatgttcttggagaaaactatttttttgtttgttttgttttgagacagagtcttgctctgttgcccaggctggagtgcagtggcacgatcttggctcactgtaacttccacctcctgggttcaagcaattctgcctgtctcagccttccaagtagctgggattacagacatgtaccaccacacctggctaatttttgtatttttggtagagatggggtttcaccctgttgcccaggctggtgtcaaactcctgacctcaggtgatccgcctgcctctgccacccaaagtgctgggattacaggtgtgagccactgtgccctgcctttttgttttttgtgtttttttttttttttttttttttttttgagacggagtttcgctcttgttgcccaggctggagtgcgatggtgtgatttcagctcactgtaacctctgcctcccaggttcaagtgattctcctgcctcagccttccgagtagctggattacaggcatgcgccaccacggccagcttattttgtgcttttagtgtgttttgccatgttggccaagctggtttcgaacccctgacctcaggtgatccacccgcctcggcctcccaaagtgctgggattataggtgtgagccaccgcgcctggccaaactattgtacttctttggtcacattcatttatctctctggtaaacgtgtcgaacaaagttctaggcccagcccattgtttttggaagcaaagaacaattcatttatgaaaaaaaagcaactcatattgctaattttggccaactaatgtttttctggagaaaagattatttcctaaaaatctcaacatctttgtaaagtatggaccagaaagagtagctgttaggaaccttttgtttgcagtgatgtgtgcccatctgagagtttattctgcttaatttaaaactgaattttcgctgggcacagtggctctagcctttagcactttgagaggctgatgccggtggatcatgaggtcaggagttcaagaccagccttggccaacatagtgaaaccccgtctctactaaaaatacaaaaaattagccaggcgtggtggcaggcacctgtaatcccagctacttggggggctggggcaggagaatcgcttgaacacaggaggcagaggttgcagtgagccgacatcacgccactgcactccgtcccaggtgactgtgcgagactcagtctcaaaaacaaacaaacatacaaacaaacaaaaaaaaaacactgagttttcttttaaacagtgtttatcccagatctcagtttttaaaataaattgtccttggcaacaaattttctcatgaaatggcaagagttggatgtgaattgcctctttcaatagggtagaaagaactggtgttaatgtattatgtgcttgtaaagacttttaattcctatggtgtacgttatttctaggtttaccctggaaaattaggaatatgactgtcatgattgttacttgtatttctttattgcctagaaaatgagacctgaagaaagttccttttattgagtgaaagaatatatttcattttctgccatgagttttcatttaaactgaacctaagttttgtatatgtgcagctaaataaatttattaggactaaatagtctttaaatattattaatttaaaaataaaatctaatgcatttcacaagaaaaattaaatcactttatctacatgactttttttttttttttttttgagacggagtctctgtcacccaggttggagttcagtggcacaatcttggctcactgcaacctctgtctcctgggttcaaggaattctcttgtcttagtctgtcctagtagctgggattacaggtatgccccaccgcacccagctaatttttgtattttcaggagagatggggtttcaccatgttggccaggccggtcttgaactcctgacctcaaaatgatccacccacctcggcctcccaaagtgttgggattacagacgtgagccaccatgcctggccctgcataacttctttagggcatatatttaacgggtgtgtgtttactttcccttctttttagtgatcattgaccgttgagatgaatttctttaaggagtctgtatcttaggtactttcagttcagggatttcattcaaattttaaattatgcatattaatagaggcagtggacatactgttaattctaaatgtgagagagaacaaaatttttatttgaaagtttttagaattataatttattatgaatggtatttttagctcttcaaacaaaatattgatgccactctttgacagtgtttcagtaagaactggcaagtaattcagtctctctgttctgttcctaaattcttctgctgataataaagtgcactctttcagaatgttccttttatgcttgctgactttctagtttatttcttggcgggggaggagaacaaaggtctttcttcctgtctagctttgaaaactagaaggatctttccttctaggtttgattcgttgtaagcagcaaatggaagcacagggtaaatgtgaacaaagagtaaacaatacatttattataagtaagcaatatatttatttaacaaatatatgttgaacacctatgatatagcacatcgtcagcagctgagtggggataagaaattattttattgatttgtcttattcatagttcttactagaggacctgacatttagtagaaactcaattaatacagtgagtgaactgaatgtggtccctgcccttgaggaagatcaaatttagtgtagtcatatgtcacttaactacggaacatgttctaagacatgagtcattgggcgatgtttttttatgaacatcgtaaagggtacttatgtaaacctagatggtatagcctactacatacctgggctgtacctactacatacctggtctgtccaacagaggactacatacatagtcctttgttgaccaaactgttggtatatggtgtttggaagatatggtgggacaaggcaggaagcagaaatatgcaactcttaagacataatatactaagtacttagaaatgagaccatgtatgggaaaactgaggagagagtaattaattttggctcaaggaaatatttatacaggaagtagtagttggtagaccttacaaaatgagtaagaatttgagaggcctttttggggaagaacattccagactatggtaaatggccagaatagtctcacaggaagagtgcaactttgtggtctttggcagagatacatggttcagtattgttggggacttggattataaggaagagttataaaagtaagaacaggctgagtgtggtggctcatgcctgtaatcccaacacttagagagcccgaagcgggtggatcacctgagataaagagttcgagactagcctgaccaacatatagtgaaaccccatctctactaaaaagtacaaaaattagctgggtgtggtggcacatgcctgtagtcacatctacttggggagccaaggcagaagaatcgcttgaacccaggatacaaaggttgcagtgagccgagatcacaccactgcactccagcctagcgacagagtgagacttcatctctcaaaaaaaaaaaaaaggaaaaaaagtgagaatggaatcagatgttatagagccttgatgatagttctagggtgaaatatactctataggtagaagggagctttcagttttttgttttgttttgtttttgtttgcagcagagtcttgctctgtcacccaggctgtagtacagtggcacaatcaaggctctctgtagccttgacctcccttacttaagtgatcctcctgcttcagcttagcctcccaggtagctgggactatgggtgtgcgtcaccatgcccagcattttttttttttttttttttttgtggagatgggtctcggtatgttgcacaggctggtcttgaactcctggcctcaagctatcctcctgcctccctaagtgttgggattacaggcatgagtcactgcacccagactgccttcaatctttttgagtagggaagatatatgatacctgctttagaaagataatacaaagtggggagaggatgaagtgtgtgatggcggtctgcaagactgctacagagtttacgggctagggctaggagttaggttgtgaggcggttgcctgaggatagagtgtgatagagatttaaaaaaaaaaataacaggaggaaaataacagacgaggagatttagtttgtcgagtacctgttatgtgccagatactgtgctaagaacctaggattgacagagatggagacagggctgtaaacatggctgagaaagggtacctactttccagaagtttgcaggtaagaagggaaatgaacatgtaagtaactaataaaatccagtatgagatacacagtagtagacatataaacaaattagagaagtatgttggaggaggtaaccaacactgttggaagacagggtggtgatcagggaagtctatctaggaagcttacataaaattacagaagaggaatacagttaaacataagcttctctgtccttcagttgctcaggtatccttcacaagataggatatgaacagagatgttaaagattagtagctgttttagaagctgactagttacttttgttgagaaatatagtggagatgtaaatcttggctctgctacttaactggttctgtggttttgtattttttgacagactctctcagtctgtgaaaaggaaataatagtgccaacctcataagactaaattacataactcacttaaagcacttattagagtacctggtgtgaagcaaactcaaggtagcttgatgctgctctgaaaaaagatgcctggtgcacagcaaactcgtgtcttcttgctgctgctgttgctgctggctgctgccactgctgctgctggaggaagctcagcataaagttttgtgggaggaatgtgtctggagatgatcatgaagggacttctaatgctaatgggtgttaccttttatctttcaggtgctagttttaagcaagggaattatatggttggatttgctttttaggtgggttatctgagggtaatatggaaaatagatctgagactgacttctagagatcagttgggttattgtaataataaattgagggtttaatctgtgtggtggggttgtagaggaaagtagacagatttgttaactaattaggacttaattttttacatgaaatctgtctttatttccttgattaggaagtaggagtagtaagcacgtaaaggtagttgttgagagaatgttaagaatgactccctagcttttgtcttagaagattaaatggatagtgatgtgactaaatacatcagaaaataccagaagaggatttttttttttttaagagatagggcctcactttgttgcccaggctggagtgcagttgtgtgatcatagctcactgcagcctcaaattcctgggctcaagggatcctcctgcctcagcctcccaaagtactgggattacagttgtgagccatcacacctggccaggaagtggatctttaaagaagatgatgatgagaacagtgtttgagctgctaggggaatcccagaaaattaatagcaaaggctttgactaaaaataaatgggatttaggagagtagggctgaaggtagattttggagtggtcagaaggttaagttgttaaagccatgggaattgataggatcacccaagtatgtaatgtaacaaaaacaaagagggcctagggtggacacctgaaacaccatatttaaaggacatatagaaggagggaattcgtctgagattcttttcatgtacttatgaattttttaaaacaatttcttcttgttacataatcatctaagattctataaaagaatggtcagagaattagaaggcagatcctaggtgttttcagaagccaaggaagtcagttcaaaggaggactgctaagtctccactggtttgtcatttggggggttaattagtccttgtgatagcagtttccttaaaattggggtgatagcaggtgcagtgtgtcaaagagaggtaaggaatggagataatgtgccagtggacttagtagctgtgttgctgttgtgagaaacaataattcacaacccatttagaaaagtaatacactgccaatttgataattcaaggccaggcgtggtggctcatgcctgtaatcccagcacttttggcagctgaggtgggaggattgcctgagcccagtagttcgagaccagcttgggcaacaaagcgagaccctgtttattaggctgggcatggtggctcatgcctgtaatcccggcactttgggaggctgaggtgggtggatcacctgaggtcaggagttcgagaccagcctggccaacatggtaaaaccctgtctctacccaaaatacaaaaaaatagctgggcgtggtggcgcattcctgtacccagttacttgggaggctgaggcaggagaatcccttgaacctgggaggcagaggctgtagtgagccaagatcgcgccgctgcactccagcttgggcaacagagccagactccatctcaaaaaataaataaataaataaaaataataaaattagccgggtgtagtggcatgcacctgtggtcccagctatatgagaggctgagccaggaagatcgcttgagcccaggaggtcaaggctgcagtgaactgtgtttctgtcactacactccagcctaggctacagagtgagactctatttcggggggcgggggggggggggggaagaaattttggaaattcaggaaagaaaaaaaagtacagaaaaaatgtaagggagaaaactaaaccatgatttttgtataattaattgctatcaatacttctgctcgtttctttcggattttatatatacacttatattttaagcttagttatactcttttttttttttttgagacagagtctcgctctgttgccaggctggagtgcagtggtgcaatttcggcttactgcaatctctgcttcccaggttcaagcaattctcccacctcagcctccctcccattagctgggactacaggcgcacaccaccacgcccagctactttttgtattttcagtagagacagggtttcaccatgttggccaggatggtctcgatctcttgacctcgtgatcctcccacctaggcctcccaaagtgttgggattacaggtgtgagccaccgcgcccggcctggtatcctctttatacaggtttttacatcctgtgtttatcattgatttatttagtatttttggggagacagggtatttctctgttgcccaggctgtagtgcagtggcgcattcatagctcactgtaaccatagctcactgtaaactgttgggttcaagtgatcctcctgcctcagccactcgagtagctaggactacagagatgtatcctatgcctggcttatttttgaatttttttgtagaggattattattgatttatttctatgtagcagttatagtatgtttcttacataattataagcattcttctatgagattaaaagctctgaatatctttttatttttggctgtggcatagtctaagtttattaaggcacatccatagctgttctcctgttgccagttatttagattgttttaattctttcactattctaaatactcttttttgcatgaaatttgtctttatttccgtaggaaagatttcttgaagtggaattatggatcacaagaaggggtatgcacatttttaaggcttatgatgcacatggccaaattactctccggaaaaattattgcaatttatgtttgggtgggagagaccttgttgtatgtatatgctgaggagaaggaatcactagtgagtccaggagaaggctgaggaggcgaatgaggcaagtttctttgcccagtaggtgggatatggggttttaagtataaattaggaaggtgggatgctgtgcggaatttatttattggcacttatcactacttctggaagcctgtcttgacagccttttcacctccaaacaagatgaggctcctctgttaacaccctttcacagcatcttgtacttccccttcatagcatttaatcaccttcataattatttatttaagatctgtcctacccgttagagtatccctttagggagggcacagacttttgtctttgccacagctttatctgtgtcatcctacacatagatatttagtaaatgttcattgatcagagaagtgaaggtattgaggaactgtgagatttaaaaccacaaatttgtgacagcggtttacatacttacaattttttactatatacccagctggttagagaggaaagttgaattgtatgattgatgcaaaatgggaaactataggttaggtaagttggaagaacaattgtagtaattgaggttacgggtgagggaatatctaaatggaccattttagttcaggctgggtagggaaaaaatgaaatcagcacggagctgatatactcagacaaaatgagagatttatatattgctgtttttagtgagttttaaggagatgcagagggatttctgaggtggatttgctgcatttggctaagtgtagggcataacaatgaaagacaagagaagaaaatctttatcagagaggcttttttggtctgttttgtttactgctatatccatgttgtgtagaacaatgccagacacaaaataggtgctgcataaatatgttaactaagtagaggtgggtagggataataacatcttttcttttgtaatcccctagcacttgctgtgcatagtacagagtatagatagtcaatatttatggaatgaacagaatgtgagtcttggattttggatatgttctaaaaaccattaagaatggtaggagccacatttttggtggagagaaaaattggttatttaagaaggtatgaaatatgggaaaagtgacctaaagatatataaccatcatgtttctcaaattattcttgaagtggttatctttagtgcagtttaaatcccaaatcacccttacctcttactctgtcagttattttatacttaacaagtataggtgttttttttttcccaagaaatttttttttccaattacaaggtaatgcattcttaatgcaaaagggaaaatcaaataaacaaatcctgtgaaatagaaaaaaaataacatatttttaaaagcatatacaatcctaccacctggattaatggcagttgacattttggagtatattctctccagctttttttctctattaaaactgctttcaacattagtctaagaaagaaaaataggtttaagatgtatttgagtcacatgagagattaaaaaaaattattctcatgggtaccagttcttatactttcactttaatataaatttaattgaaaattcaggaagaaaatttcattttaatgtcttaaagacacccatgtcatataactttaagattgtatatagttttgtcctgatgaatatattacttgaaatcatatttcagtttttcagaaccaggaaaacagtttataaccattctatttatgtttatctcagatatattgaattcttgctctttgcctattgctggaatcacttaggttgattaacattccaagataaggagaaatgatctgttggtcctagacctttttggctttgtggatgatttagtagtatggatagttttttggaggagtggttgaaatgttttaaaatggttgatgagaagtaattgttgtcagatggaaaaacagactggttaagagttgagattcatcccagtgattctttgtgatttgtatagtacagaatctaaggagttttcctccccaacatttacaaacatacagaagacagagttaatacagtgaatacccttgtacacaccacctagattttagaattaagattttgctatatttactttattatagatctgtacatccacaccccatctttttaaaatgcatttcaaagtgagttcatgagttgcagagtttccaaatcagttttaaagtctctcattttatacttcttttttcttattctgagaatctttgattctagtgatatttacatatttatttgctttagcctagaatatcttgatacattgccaaattaaaatatcagtaatttgggaggcagaggtaggtgggtcacctgaggtcaggagttttgagaccagcctggccaacatggcgaaaccctgtctctactagtaacaaaaattagctgggcctggtggtgggcgcctgtaatcccagtgactcgggaggctgaggctggagaatcgcttgaacccaggaggcggaggttgcatggagccaagatcgtgccattgcactgcaggctgggcaacaagagcaaaactccatcaattaaaaaaaaaaattatgtattaagaacattgaatactgtatgtttttttgcagtcttttttttttttttttttaattttgcttcagtctttagaatatatcccattagggatggatattcaaaatactgtgttttaaagtcacttgaagtaattcttttttctgtatttctgccaccaacttgatatatactagtttcacttacttaaaattatcttccattcttagggactgatttttaaatttttgttttaattatataaaacatttacattgtttcaaagtaagactgttgaagaaggcacttggcccaggtgcggtggctcacgcctgtaatcccagcactttaagaggccgaggtgggaggaacacctgaggtcaggagttcgagaccagcctggccaatgtggcgaaaccccatctctactaaaaatacaaaaattaaccaggtgtggtggcacgtgcctgtaatcccagctactactcaggaggctgaggcaggagaatcgcttgagcctgggaggtggaggttgcagtgagccaagattgcttcactgcactctggcctgggtgacagcacgactctctctcaaaaaaaaaaggaaagaaggcacttcacagaaggttcacgtcatcctttttttcttcccccttcaggtaaccattttcattagttcttgatttattcttttgttatttccttttgaaaatggaagcaaatatgccatcgaaaactttgaagaggtatcacaaatagctgatgacactagttggctgtaagtagaggaagtggttaaatggggatgggagtgaaaggaaacttgaaacatttttgttgcttttgaatttttttattttatctattttgtttgctcttttttttttgagaggtttagtatatttttacattgagagaggtacatttatactaatacctatagtcccctccttttaaggtactcttgtattgtgagcaataatgaaattagctagtaacctcttcagcaccttttcttccctttccccagtgtctgtgggttttttgcacttaaaatgtattattgattaatgtgcagtaaaatacatttttttcagtgtatagttgtgagttttgacaaatagaattacataacaaccacaactaaaattacataacaaccacgccaaactctctcttgttgcccctttatctcaaaccctcctcccacccccaactcctcacaaccactgatctgtcttctgtccctatagttttgccttttgaagccagaatgttatataaatgtaaccttttgaaaatggctattttgtaatcacttagcatgatgcatgtgatactcatccaggtagttgagtgtatcagtaggtcattgctttttctgtaaattctcttttttgttaattgttttatatctatattttatgagcatataacatttgcatacactatactgttatctttattctgatcacttagtgttaattttaaattatattcaatactcatcatcagaccttatcccaaagatacttcgaggattttttggttatctgaagctcacattctacaagtgagctcatgggaacaatattcttttaagtccttttggttcaaactatttgcttgtgaccattatactcattatatttgaagctttgattgtatgtaaaatccctggctcatgttttctttctttcttttttttttttttccgagacagactctcacttagttgcccaggttggagggctgtggcacaatcatggctcactgcagcctcaacctcctggggccaagcgatcctcccgcctcagcctcctgagtagctgggagtacaggtgcgcaccactatgctcagctaactttattttttatttttatttttatttttgttgggacagggtcccattgtgttgctcaggcttgtcttgaactcctgggctcaagtgatgatcttcccacctcagcttcccaaagtgctgggattacacgcatgaaccactgtacccagccatgtttttttatgagctccatggacattttcaaagtcttcagacatttttttcttacaagaaatttggtcatttgcctgttacctgaaagatttttctttttctttaaagaaccattacttgactatgtcttggtgttgatcttggtatggtcttaagagtaggttcaagtgttttatttcagaaaagttttttcgtatgatggttttcagtatttgttctgttccattacatgggtttgttttttagggactctaattatgaatgtatgttgggtcttctttgactaacttcttctattattttgtttttttgaagagttttttggtaaaaactggaaaacctgccagagaaattctaaaggatctgtaacacttgactaacttcgttattttaaaaatttcctccattctctttcctcttttcttgtggggtcttttactttgtgttccaattagcttgtctttatttctgaaataattttcctttttttccttgtaattcttaagtaaataagaacactattttttgaccgatttatattaaaaattggagacttcctgtgaacaagtcttgaacatccagtgtaatttttaagttatagcacttgtgaagagaaatattattgaaaaacaaaacagtaaaacgcatctcagtctccatagttttataggtacatctcatttggtacaagtagaacctgtaatgtttatagaattgaaatgtaaatcagtttcttctgaacttatttgtgtgatttaaagttgctactttttatttattaatcttatagggatatgttgaaaaacaagattttaaatatggattaaaatataaataattttattaaccaaaaatgtcagtttattggaaacataaacaattttgtgtctgttgggtgaaaagtagaatatgttgttttatgcatatgatagattattttccttaacatttaacagtttaacaagttattttgtgttttgttgttgttgtagtagttaactacagatggaattattcgacaaagaatcgtcagaggaactctcaaactaataggcttttcttgtttttagagccttattgtcttaattattaaaaggcaggataaatgaataggtactttgaaggccatcttagtaaatatagccaggccttaattttaggtattgtatatttatatttttatagctcttcgagaggtaatgggagaaagatgcagctgaagaaagatgcagcttggtgtatattattgtgaactttccgaaggcaagaaagaatttctgtttttcatgattctttatgctttgggaagaatgtggtagagaaggtgcagtgtagagagagataagtagctgctttactgtcagcatagaattagaattggaacaaattttttttttaatcacagcagaatgttctaggtttgaaaaaaggatttctgttttctgttactttagttttaagtttcttacctcagttccattggtgcagataatcatctggtgattaatatttcactttgcaatattttgagcatgcatatacttaaatttattttgtatattaatagtggctattctaagaatgtaggtgttggatacggtgtggtaaagtctgggtagctgcagggggatatgagaataaggcttagaaggaagaattttattatactcacaggtctcagggagggtcactgcatgctacacaggggaagcaccaggttttagtcaggaagcagaagacaggagccacggaaaagtccaggccagagtattgggatttcctgggaaaggcaagggagggcagagtaaacagttgaggattgaagagtttggatgattcctccaggctttgagctgtagaggtggtctctaattgcctggtacctgactctggaatgatttagggcaggaaatactggcttcgtatgtgagcgttagataaggaggtggatttggctgtagactcaggattggttggtttgtatatggaagacatgctcctgtgagccctcttatctctaagaaagcactagccctggccagcaagcttttaaaaagccaaaacataataaaatatagtaaataagaaacatgttttaaatgcagtggccagctgaagttctgtttaccttgtcaaataatttctgtgttaataatctttgagaaccatagctttctcaacaattgctttccttttggttctttattattttttataagttctcatttcttttagatagtgattgccttttctaaacactgaaatacgtctcaagtatgtaacctgattgaaatattttcacaggagcatctgtaattgttttttgtttgttttttgagataagatctcactctgttgcccaggctggagtacagtgacgtgatcactgttcactgcagccttgaactcctggacttagtgatcctcccacctcagcttcttgagtagctggcactgcaggcacataccactatgcctggctaattttttatattttatgtagagacggggttttgccttgttgcccagaccagtttcaaactgttgggttcaagtgatccacccacctcagcctcctaaagtgctgggattataggcttgagccaccacacctggcctgcagttgttgctggaatgtttttggtttgattttataacactactatgtgaatcaccagttggtatatatcacttttaatattatttcacttatgatggttgaaagatgttaaagtttgttcttttacatgagaaaaaaatgggtatatgttcataagcttaaatgtttaagattggtaacttgtgaattatagacaagtgccctgagtttcttaatataaatagatatacgtatactagtgtatcttgctgtagtaactaacttttggtgctcttaagtcttattatattcataatgccatttggcagaaataaaacattttatttcaaaggtattaagtaatttttaggtcttgtaagataaaaaaaagatccctcttactgtgtcagtaacttatatacatgaataaactattcagaattcgaaattttaaaatttgagtcttcctgtccatgaacataggctatttttctatttatttagcttttctttgagtatttcagcagttttatagtttttatggtatcaattttgtcaatatttgttagatttatgcctaattatttcctttttgttggtgctaatataagtggtattgtgtgtttaaaattccagttcattgctggtgcgtaggaaattgacttctgcatattaaccttgtatcctgccaccttgctatgattgcttattttttccaagaggtttttttctgtcaattctttgatgttgtctgcataaacaatcttttcagctacaaaagtaggtttattttttctttctcaatctatataccttttatttccttttcttgtctcattgcattagctaggacttcccctatgatgttgaataagagccgtaaaaggaaatacctctgcctttttcctggtcttaaagagaaagtgtctagttttagccattaagtatgatactaattgtaggttttttgtagatgttctttattaagttgaggaagctccccctctattcctagtttactgagagtttttatcaagaatggtgttggattttgtcagatgcgttttctgcatctattggtctgatcacgtgatttttcttctttagtttcttgatgtgattgattacattgttttttttgaatgttgagccagccttgcatacctgggataaatcccacttagtcttggtgtatagttctttttttaaaattttaatttaatttatttattttaatatccagacttcaaggaggtatagttcttgtataccttgttggatttgatttgctaatactttattgaggatatttgcatctgtgttcataagagatatttgtctgcagttttcccttcttgtaatgtctttatttggttttggcattagggtaatgctagactcagaatgacttagaaagtgtaccctctgagtgtattttctggaaaagattggagacagttgtgttatttcttccttacatgtttggttggaattaccctgaagccatctgggcccagtgtttgttttttttggaaggttattaattgttactattatttttttctgagtatatgtttttatttagcttttacaaacaataaccacaataaaaaaaaataatgaatgcagataacttttgaacacaatatatcgtacacccttattggatatattctgaggacaaacattatgcaacaaatattcttgaattttatttaatagatttattatgggtgtgctttctactcttgggtatcattgcttctaggctctttcaatggatggagtttattttgacactacaattcgatctagttaccagagttcttcctcttctttctcatttctgtaaaggttattaattattgatttaattttttaatctatagaggcatattcagattttcattttctccttgtgtgttttgataaattatatctttcagggaattgccttgaaatccatttcatctaaataatcaaatttgtgggcataaagttagttataaatgtttctttaatacttttttaatgtctgggatcagtattgatattattactgataataatagtttcttatgtctttgattttggtattaataatttgtgttttttttttgttggttatcctggctagaggtttatcaattttactgatcttttcaaagaactggcttttaattttgttgatttttattttattttattttattttttaaaatttcattgctatctctatttctcatttcttcttctttctctaggtttgtatttattgctccagtttcctaaggcggaaagttaaatcattgatttttagatcaccattacattcagtgctataaatttctctgtaggcactgctttcactgcatcccacaaattttgataagttgttttcatttagttgaaaatagttttaaatttctctttagacttctttgatgtgttattttaaaatgtgttgtttaatctccagatatttggggattttccagctatctttcttttgttgatttctagtttaattctattaaagtctgagagcatagtttgtatgactttagttaaggcatgtctttcttatgtcccagaatgtgttctgttttggtgaatgtttttgtgagcttaagaagaatatgtattatgcggttattggataaagtatactataaatgtcaatgaaatccagttgatggatgatacttttcagtttgactatatgtttactggttttctgcctgctgtgtctgccagttgttgatataggggtgttgatgtcttcagttatagctgtggagttaactgctgcttctcgtagctctatcagtttttgtctcacatcttttgacactttgttgttaggctcagacacattaagtgtggctgactgccacagttactacttgagactgtcactgagacagttattactgttactacttgagaccatcattatgagactgaatcaagggggacagacatagaaatgaaaacttaagacaaaggtaactactttaaagtaagggtaacatggggaaggagaagagaagaagaaaagggctccctgcttttagtgagcaaaggcagctgcctaagactctacagcccttaatatgtattgggtagaaagagcagcaggaggaggtaatgattggtcagctgctggattgatcacaggttcacattattgctaacaggtttcagttatgcctaatcagaagaaacacttgtgcctgggtggtggctgccctcagcattccttctgggcaacagacacagtttgtcagtttgccgacatcctgcttttatgagaaacagtttgctgtttgcacatatagcctccagtactatactgagttgatcacgacccttgacaattaaggattgttatatcttgtttgataattgatccttgatcattatgtactattcctgtttttctccgataattttccttgttctgaattctgctttgttagaaattaatataactagtccagctgccttttgatcagtgttggcattgtatgtatttctccatccctttaacctatctgtgtctttatatttagagtgagtttcttgtagacaacatatatttgggtctttttgttcactcttgtcagttctgtcttttaattggtatatttagatgattcacattgaaagtattgttaaagttgggttttagtgtctaccatatttgtttcttactcattatacttgttccttgttgcttattttaaaatgtactttttttttttttttgagacaaggtctccctctgtcacccaggctggagtgcagtggcgggatctcagctcactgcagccttgacttcctggactcaagtgattctcccacttcaggttcccaagtggctagaactacaagggcacaccaccacacctggctaattttttgtattctttatagagatgggattttgccatgtaggccaggctggtcttgaactcctgggctcaagtgatcctcctgcctcggccttctgaagggattacaggcatgagctacgtgcctagcccattgtctgattttaattgagcattgtatattattccatttttcttttctgtataaaatactaattgtacttctttaaaaaagattttttggtagtttcccttagagctcatctaagttcatttttaaataccatttacactgcttcacacatagtgcaggtaccttataacagaatataaccaactcctccctcctgtcccttatagcattgctgttattcatttcacttatccatagtcagcagttacccaagatattgttactattttgaatacttatctatgtgatcaattaagattaagaaaaataaaagagtgtatcttcatttattccttcttggactctccctttcttcataaggattctattttctcacctatatcattttccttttctctgaagaacgtgtaacatttcttgcaaggcaagtttgtgggccacaagttccctctatttttgtttgtctgagaaagtctttatttttctttcacttctgagggataatttctctggatgctaaatcctagcttggtggggttttttcccaacacttaaatatttcactccactctcttcttgcttacatgatttctgaagagaaatctgatataattcttgcccttcttttatatagagtgagtgttttgttttgttttttcctgatttctttcaagacctactctttgtctttgacctaggtttgaagatgaggtgttgatgttttgatgtttatcctgtttagtgttttctgagctttctggatttggggtttgggggatctgtcattaattttggaaaatcatcaaccatcattacttcaaatacttcattttctttgtttcttctccttctagcattactattatgaatatttttcaccttttatagttgtcctccattctcaaataccatgttccagttttttttcaagctcactgattgttgttttttttagtctgctgattgctcgtcaaaggcattctttatttgtgttaatgctttttatttctagcattttgttttgattctttcttatagcccttagcattttaatgagttatttaaaatgtccagtttgatcattcaaaatctaccttatctgagtttggtttcgatgcttgctttgtctcttcagaccttttccttgcctgttacatgccttgcaattttttgttgaaatctggacatggcttattgagtagtagaaactcaggtaaacaggtgtttaatgtgagattttaggtttatctggctgggagttaggctgtgtttaatgttcactaggtatttatattgtttgtaggtataagacatttcattttcctctactttcctggtttttgtcttgttttgagtttccttagaaacttttattaattaaaaaaagtctatttcttgtaattttctcagttgtaatctgttatattggagccctgtttagtagagaggagaagtgttctataatcatatgatgaaatctgttgggttttttagtggaccagagttcctgaacggaccttcaaaagaatttcttaagcttttttcttccctcctctcaggcaggttagagggggctggaattattgctcttactctaggtcagatttcaaaatggttacttttcccttttccctactcaaaatggagggattttactctaataaaaaccaggtggagctccttttctcacctatattcttccttaagactgagccctcacaagttaaagctcaagttagttcactctcagtctccagcagtttgctacttacttttaaagtgttccttccagttattggctttagagtaaatatagctccatatgtctatattcacatgtttcttcagtttttctggaggtgttgtgacctgtgaactcagttttccagtgcttctaagagtagttgattttcagttgttctgctttttttcttgtgaggatgggagtgatgatttccaagctgtttacgtaatagagtggaacaaagttgtcatctttatttttttaatgagagttgtattgagatgtataattcatgtacatattcaccctttaaaaatgcacaatttggtaatttttactatattcacagagttatgcaacccttactatttaatttttaaacatttttgtcacctgaaaaaggaaccccaaaacactcactcctcccagttccaggcagcaactaactattttgtttttatggatttacttattctggacatttcatataaatggaattatacaaaatgtgacctctcgtttctgacttctttatcttaacatgttttaaaggttaatgttttaaaggttgatttatgctgtatcatatatcaatactccattcctttttgttgccaaattaatattccattgtattaatatatcacattttgtttatccattggttggtggaaacactttttgactgttaagaatattgctgttatgaagaattgtgtaacatagtatggctatgtgttttcatttttattgcagaaaatgggagtgtaatttctgggtcatagataccctatgattaactttttgaggagctgccagacggttttccaaagtggctgtaccattttacttactaccagctatgatagttgcagtttctccacattcttgtcaacacatatcttcttgattctagccatcctagtgtatgtaaaatgagagctcatagtgtcttttgatttgcatctctaattactaatgattaacatagttttacttgcttattggacatttatacatctttgaagaaatgtctattcagatcctttgcccattgttttagtagggttttccttttattgagctgtaagagttctttatatatactgtaaaaagttaccctatcagatatatgatttgcatatattgtctgccattctgtgaattgtcttttagtttccttgacagtatcctttaaatcacaaaaattttaaattttatggagtctagtttgtctacttttttttttttttttttttctaagatggaattttgctctgtctcccaggctggagtgcagtggtatgatcttggctaactgcaagctccacctcccgggttcacaccattctcctgcctcagcctcccaagtagctgggactacaggcgcccaccaccacgcccgtctaattttgtttttgtatttttggtagagacggggtttcaccgtgttagccaggatggtctcgatctcctgacctcgtgatctgcctgcctcagcctcccaaagtgctgggattacaggcatgagccaccacacctggcctagtttgtctattttttcttgtgtttcttctgcttctgatgtcatatctaagagaccattgtcttaagccactatcagaaagacttacatctgtgttttcatctaagagtttcatagttttagctcttcagttagctctctaatccattttgtgttaatttttatatatggtgtgagatagggatccagctacattctttttgaaaatatttttttatttttgagacagaatcttaatctgtcacccaggccagagtgcagtggcacaatctgagttcactgcaacctccgcctcccaggctcaagcaattctaatgcctcagcctcccgagaagctgggactacaggcatgtgccactgcacctggctaatttttgtatttttagtacagatgggcttttgctatgtcggctaggctggtcttgaactcctgacttgaagtgatccacccaccaccttggcctttcaaagcgcggggattatagacttgagccactgtgcccgacctcagctgcattcatttgcatttgtatgttttcccagtaccatttgttgaaaaaaaaaaaaccagttctttccccactggattgttttttcctgcttgtcaaaaatcaattcatctaccagatgctgtggctcacacctgtaatcccaacactttgggaggccaaggtggacagtattgcttgagcccaggagtttgagactagcctgggcaacatggagaaaccctgtctgtacaaaaaatgcgaaaaaaagttagccaggcatggtggcatgcaactgtagtcccagctactcgggggctgaggtgtgaggatcacctaatcgggagaaaaaaggctgcagtaagctgtggtcatgccactgcactgcagcctggttaaagtgagaccttacttgtcgcaaaacaacaacaataacaaaattaattgatcgtgaatacaagagtttctgaaatctcaattctatggcattgatctctatgtctgtttttaagccagcaacacattctcttggttactgtagctttttattgagttttaaaattggaatgtgtgagtcttccaacttttttgttctttttcaagattattttggctctactgggcccttgcatttgtgtatgatttcaggatcagtttgtcaatttctgcagcaaagcaagttaggattttgatagggtttgtgttgaatctctagattaatttggggagtattgctattttaacagcatttagtcttcaaatccatgaatatggcatggggagtctttccatttacttagcagttctttcattttttcaacaatgtcgtttttagtgttcagatttcacacttcttttgttatatttattcctaagtattctttttttttattctgttccaaatgaaagtattttcttaaattcattttcaaattatttctagtgtgtagaaatacaactgatttttgcatattaatcttgtatcttgtagtcttgttgaacttgattacttttaataattttgggggaggagattctttaggattttctatatacaaaattgtgccatctgtcaatagaggatgcttatttcttgctttctgatctgatggcttttatgtctttttcttgccctcttgcccagggtagaagtttcagtactatgttgaatagaagtggtgagagaagacatccttttttttgtccctaatcttaaggtcaaagtattcagtcttttaccactaagtatgctgttagctggggatttttcatagatgttctttatcagtgtgaggaagtttccttctgtttcaagcttgctgagtcatgatttttcatgattttttttaaatcgtgaaagggtgatgagttttgtgaaattctttttctatgcctgttgagatgattatatggattttgttctttattttcttaatatattacattgattgatttttgtttgttaaacgaacttcatgtttttgggatataaatcccatttggtcatgatttataatcttttttatgtgttgctggatttgatttcctagtaatttgttgaggatttttgcatttgtattaatgaaggatattttttctgtagtttttttgtgatgcctttatctagttttggtaacaagatagtactggctttgtagaatgagttaggaagtatttctagcttttttggaagagtctgggaaagattaatgttaatttttatgtttggtagatttccccagtgaagccatctgagcacgggcttgtctttgtgttttaaaattactatgcagtttcagtagtttgtgtctttctaggaatttgtccatttaaaggaggttatgtaattcattgttcatagtatttaataattgttttcttatgatcctttttagtttagtagtaatactcttgtaattcctgatgtttagtaatttgagtcttcttttatttttcttgcttagtagaacctacttttgaatttgttgattctattgtttttctagtctctcctcttatttctcccctaatctttataattccttttctgctacctgctttgggtttagttcattcttaatggtagaaattggattactaattagagatctttcttttttatttaattttaatttttgacaacagtaacaaaaaatgtgttgcgtaagaatggggatacgttctgaagaatgtgtggttaggtgattttgtcattgtaggaatatcatagaatgtacttacacaaacctaaatggtatagaccataccacatggcttattaaacacctaggccatgttgtgtggtctattgctctgctcctaggctacaaaactgaatagcttgttattgtgttacaatagggaattgtaacacaatggttttgtgtatctaaatacatcacataggaaagatacagtaaaaatgtgtggtataaaagatttaaaatggcacacttgtatagaacagctccattataatcttataggactattgttgtacatgcggtctgttgttgaccgaaacatttgttatgtggaacatcactgtaaataggtttttaaaagtgtttcttgcattgccagcatgtgatacatatactaacttaatcaagaatgtaatagatcaaagatgcattaaaatcttaataaggtagtcattaatatactgccaaaaggtatagcagaaaactaataatggccataaaacaaaaataagaattaaaaagaacacagaaaaagatggagagaacagatggacagatagcaagatagtaggcttaagcctatcaataataggaattaaactagaatgctgttagtctccattgtatgttaggcacaaacattacttacataactgttaataaatgcataatttgtgatgatctacgttgacatattgatctgaaaaatcttcatgttcattgctcttggtaaacacatagtaccacaataataaatttcttgttcacataaattttgcctgtccctcactgttggattgagtttgtttttatatgtcagatagcctttatatatctaccagctattcagtttactgtgtgtcatgagccacacccagccacaactggtattacaaatttccctttgtcagataaccctcctttcatcacttcacagtaactcacaagtggtaactcttatgacacccatttcccaggcataaacttaggtgtttttcaaggtaaaatactcactttcttgtagtatttattccataacaattttttgttgttgttgttgttttgagacaaggcctctgtcacccagactggagtgcagtagtaccatcatgtcttactgcagcctcgacctctcaggctcaagtgatcctcccgagtagctgggactacaggcaatgcaccaccctgccaatcttttttttttttttttttttttttttttggagagacggggtcccaggctggtcttgaactcctggactcaagcgcttctctcaccatggcctcccagttttgttttcctttgggattacaggcatgagccactgtgcctggcctattccttaataatttaattggtgtaaaattgtttttattgggttcttatcttttcaaaaatgtgttactgacatttttgcatgctgtgcttccaatcccatttccttcgtaaaccttgtagcttttattgcatgattttgtataatgtggtttttttgaaactcgtatgtcatgatatagcggacctgactataattattttataaggtatctctttattcctcttttcatcagttgatccgtcttagtctttgatacatttcagtgtaggtatacttccctcctaatcactacagcatgtatatatcattaactagagtttgatgtcagcttacttctctttttgtgtgtgtgtgtgtggtacagtttacatttggtgaaatgcacacatcttaagtgtactctttgataagttttgcagatgtgtatgcccatgaaatacaaacctctatcaaagtatagaacatcatcattctcagaaatgttccctcatgctccttcctagttaggcccttgagccaccctttcagaggcagccactgttttgacttgtttactaccttagattgatttttcttgttgcaaaatttcatataaaaggaattatatgacatatgctcttcttgtatgtaaagcttccttgagtcagcatgacattttgagattgatccatttgtgtttatcagtaattgtatttttgtttttgttgctgagtagaatataccacaatttgtatatctgttcgcttgttgatggatagccaggctgtttcaagtttttcactgttgtgaagaaatctgccatgaacctatttgtacaaatttttttggtagacacatcttcatttttcttatgagtggtattgctgggtcgtagggtaggcaggtgttcagtcctatgagcaactgccagcctttgtttcagaggttttattgttttaaattcccaccaaaaacatatgaaagttcctgttgtgccatatgcttggcaacactgatcttgttggttttataaattttaattattctggcaggtatgcagttgtatctcagtgtggttttaatttgcattttcctgatgactgacaatttggagcactttttcatgtactccttggctgtttgcagtatcttattttgtgaaatatctattcagaccttttgttcatttttgaaaattggatcatctatgtcttttgttaagttttaaattttgctaaagttttatttatgagtttactcttttatgggtcttcctttttgtgtcctaataaatctttgctttatcctcaagtcattaagatagttttacatgttttcttatagaacctttatagtttttaacatttatatttaggactgtgattcatcttcatttgatttttgtgtattgtgtgagatagagattaaggcttacttttttccacatggatgtcagttatctttttactatttgttcaaaagactttccatcctcttttggactgtctaggcacttttgtaaaatattaaatgactataaatgtgggtctctttgttagactccttaatctgttgcattgatctatttgttgatccttaagccagtaccatactgtttagattactcagcccatgctatgttttgaagtcagattgtgtaacttctacagctttccaagcttttttgggatgttttagatccttcacatttccatatacattttacttatttaatttaaattttttatagctgcataataggtgtccatgttttgggggtacagtgataatacattcatataattgtaaagatcaaatcagtgtattgggggtatctgttaccttaaatatttgtctttatgctggaaacatttgaattactctcttctagctattttgaaatgtgcaatagaatattgtgaactatagtcatcttactgatctaacactaggtcttatttcttctattaagctgtgtatgtacattcattaatcagcttctatatacactttagaatcagcttttcagattaaaaaaaaagaaaagcctattgtggttatgctttggattgtgttgactctgtgatcagtttgaagagaattgcagttgaggtgcccaattcgtagacatgatatgttttgccatttatttacgtcttttaagatttcccaaagtgatgtttggtaatttttagtagagagggctgcatggcttttgttcgatgttttatgttttctgatgctgttgtagatagaattggttttttaaattttgtttttctagtatttgctgccaaatacagtggactttgtatattaactttgtatcctgcaaccttcctaaattcacttattgcagttattttgtagattccttaggattttctttataaacagtcatatcatctgtacatagagccagctttatttctttttgatttttatgcattttatttctcttttttgccttgttgaaatggctaggatttgtagtatggtgttgaatacgagtggtgagcactggccttcttgcttttttgttggtccttggagaatagtgttcagtatttcactattaagcatgtaagttgtagagtttttgtaggtacaggttgaggaagttcccttgttagtttgccaagtgtatttattttgaatggtgttaaattgtatcaggtgttttcactgcagctatttcatgataggaattttcccctagtatagaaaaatacattgattggttttgaatgttaaaccaatcttttgttcttgggttaaacactatctagtaatcatatgttatcgttttgatacattattagaatttctttttatttactgacctttatgtctctgctatttttagccattctagattttgtgtatcttttttcataacctgttgagaattaatattgaaccattttatgtaaaatatagaaacttgcatttctacatttatcacttcctcctgtccttgctgtaattgtcatatgtattacatctatggtatgttataaactacacaatacatgttaccatttttgctttaaagagtcgtgttttaggaaaattaagagcatttttttaagtgtaggtttgctagcaacacattatgtttttcttttatctgaaaatgtgtttgtttcacttttattcttaagaatatttctcttgaaaataacattttgtgttggcaggcttttgggttttttttctttttagcacttttaaagatttcattccactgtcttctggccttatattttctaataagtcagtggaaattcaactcagtgttcctgtgaaagtaatatgtcgtttttctctagctgttttctgcactttttttcttttttgttagttttcagcagttcagctgtgatttgtgcctaggtgtggttttctttttatttaattaatgtttgctgagcttcttgaatctatacgtttttgtcttttaccaaatttggggaattattttcaatttcttttctgtcctattctctttttccttgggattggttatatgtattttgatactgttccaaggactctttccccccatacccctacctttttttctctgtccttcagataaggtctgttttcatgttactatttgttttgccatcttcagtctgccattaagtacatcagtaaagatttatttcatacagttttcagctccagaatttctgtttggttcttgtttttgtttgggctgcagtaacaaaacaccttaggccgggtaatttattgtataaacagcatacatttattgctcacagttctggaggcttgaaagcccaagtttaaaaggttccagcagattcagtttctggtgagaactctctgcttcatagaaaacacctatgtgtccttacatggcagaaggggcaaacaagccttctcacgcctcttttattagggcaaaaatcccattcctgagggtggagccttcatgacctcccagaggccccatctcataataccaccatattagggaccgggtttcaacataagaattttgggggacacacgcattcagaccatagtagtccctttttattgattctttttcttttctggaatttcttttcattcaaagcaagagtatttctccctacatcttgtgcattgtaacagtacctggtttaaatttttttgtctgctaattctcacatctggattgtctcagggccattccctgtttgtgctttcttttgagcatggatattttttgttcctttgtatgtcgggtaattgtgttctagcacattatgtatggatgatagattttaaaactctgaatagtattttttaaattgataatgacttttagtgatatattttgtcattttctgtgctgattgtttccttgtccatgcttttcttctattttcacttgtctccctgctgctaaagtatgtcgtcagatagttcttttgtgacagtctgtgtatagtaaaccattagcttttatgtgtcttaaaatatcttattttttccctcattcttgctgcattacctgggacctaagttctaggtagacagttactttactttcaatactttgaacatattgtgccattgtttttcgtcatcagttgttgctggggagaagtctgaagtcagtctaattgccatttcttgctaggtaatctgcttttctttctggtagcttttaagattatgcccgtgattgatattctacagtgtgtcttatgtgtgacttaatttttatcttcctcagtatgtagtgtgtattttcagttcaacaacatgtttttcaattctggaaaattactatctaaattatctcagcaaatattggtacaccactgtccttatatcttagtgattatgtttttttcttttagtatattcctaaatatacttatttttatgtttttttaaaatcatactatccattgggtgatatcatctagaatgaattcatgttccagccatttattttattggtctttctctttttttctcattttttttcccacatgcctgttgtgtcacatttgttgatattatattttagaattttgtccttgcagccttattttgattgggaagtttaacatttttcttcattttgcccatctgtctttttctatgcttattttctttcttacagtttttacttgattttcaattcattcctcccaatccaaaactaggtttgtattagagtttccgggttcttgcttcagcatgatattgagagtattgcaggttctgtcatggatccattcaataactaactggtttagatcctggttaagaggtttctcctctctctttccccttaactacaccacaatgtcaaataagctctagcttaggcaacaggggatatcagtatattcttagcttcctttcaagaggagaaggctattccagcctttggctttaagcagtaagcatagctaatactcctcttatggaacatttttagtccttgtttacccagaggagggggaactttgagccactattgagtgctcatagactcagagctttgcaggtccacagcttatatccccattcacagccttgtgtttcttctcatcttcttgtgacttagcctttctaaataaaaagtaatacttaacattttatattgtacttctagcaaaggggctgaatcaaaatacaaacttaatgagccttcttgactagacatctatgtgttgtttcttaatgttttgtcactcttgtctcacttggcatatgctcatagtagtaatattgctcttgtgaatctgagttttaatttctagtagggaaaactctgagttttcttttttaaaattttgtcttgatcaaaattatatatttttacatatgaactttgaaataattttgctcagttttaaaacttctgttggaatatgtcttgaaatgtataaatgtgtgtctacatcattttagaaaggttgtcctcctttttttgtttttgccctccagcctgagtgacaagagtcctggtctatcactcagggtggagtgcagtggtgtgatcattcatgtctcactgcagcctcaacctcctggggtcaagcagtcctcccacctcagtcccccacatagctaggaccacaggtgtgcaccaccgcacacaactgatggttttgtttttttttgagacaaggtttcccaatgttgcccaggctggtcttgaattcttgggctcaaaagatcctcctgcttcagtctctgaaagtgctgggattccaggtgtgagcctctgtgcctatctgaaagattgccatttttatgctctccagttatccagaagttaactatatccatttatatacagcttttaatatgtaattttgagccttccttgagaaccttattcctgttttatgttttctgtagttattgtggctgtccagctggctatactagaagaaatattaaaatgttcctcttacatgtagtcactttgccagaatgcctaaataattataaaaggttttggtagattctgtggttttctatgtatataatcataccaactacaaataaaggtacttttatatcttttaacatttatgctagtcatttagttttcttattttattaagctttctaaagcccctaaaacagtatttaacaattataggcatctctttgttcttgattttagtggaaatgccttcagtgtgttttactgttgaatatcttgcttgctgtatttgggggaaaagtctcatagttaaataatttccttttattcttattttattggagttcttattaggaatggtggccgaattttatcaaatgccatttaaaaccttgataacaataatgggcaattagccttttaacaaactggattcagtttgctttttattttgtttttccttttgtgttaatacttacaagtgtattgtgttatgttttcttcctttgaactatatttatcaggttttgttgttaatgttttataagcacttgaaaaataattgaataccttaataatcttcccttgtgtattgtgtggagactgttttgttctaactttataaattgataataaagaaccctctgtttaggtagattttgtcagtttgctcagttttagaaagctagtatagaaaatacataccttggggtaattttattaagatatttttatgtgagtttgaaattttttccaaatatgaatccatatttccgtgtgtgtgtgtgtgtgtgtgtgtgtgtgtgtgtgtgtatgtgtgtgtgtgtggggtctaaatttgtactgtgtcccttgggaaacacatttgtttccttaacattttttttccttctgcaatccctctgtgctttttttgtgagaaatcttaatcccaaacatttatctgtaaataagttggcgagattttttataggtgtcagtagagtgcatagctgtatattaatgctttgtgtgtatttatgaattattaccatatgagtttgctgtgaagtctgagtattactggtacttaatattgcccgttgttgttacataataaattgtaataaaatttttgttgctaccttaggagttccaacttgggcttggttctgatattgtttgagactgtttggtaatttatacatatatgactgtaataatgtccttttcttctctcccccaacctccgccaacagttacatgggaattggtctttctgctcaaggtgtgaacatgaatagactaccaggtacacttgtaattgaattacagtattatgtcttatgagtagctctttctggttaaatttttcaagtaagaaattgtaatatttaaagatactgattttctgtgtttttaatcatcattatgaattttaagtgaaagctgagtggggtttttttgttttgttttgtttttgagacagagtctcactgtgtcacccaggttggagggcagtggcgcagttttggcccactgcaacctctgcctcctgggatcaagcggttttcctgccctcagcctcccaagtagctgggatcacaggcatgcgccaccaggcccggctaatttttgtatttttagtagagatggggttttgccattttggccaggctggtctcgagcccctgacctcaggtgatccacctgcctcggcctcccaaactgttaggattacaggcgtgagccaccatgcccagcctgctgagcggtttttaataaatttaaatttcacactatttagtaaaacatatagtatatatatcatgcttttttttgtatttttatatttttaagttttagtacatagtaatatcagctactttaaatattttaatgtggctagttatattggctacccatcacatttttgacttttaacccatcttaatattcagggaatatcgactaatacttaaagtaaactaaggaagagatgaattgagatccagacctgtttcccagtaccacttatgagaaggaagtgattcttggattatgtcttctaatactctctttgctaaaattaaaaattaattttggcgagactttttgaagtacaaggcaaaactgtcaatgtcaaactacatgaagtaccttaaagaaacaaaccaagacaatgtagttgcatctgattgtaatcacatatgttaccttgacatgctttgttttgtacccttttgcttaaaattatacttgaaagagggtttaattgaggtttttattatttgaaaactccttatagaagtaactgataaggtaaaaatctcttaatgatgatataaacatatctgtagtgtggtaagaccacaccctgtttggcttttatatttggatcacagtcttgagaaacttgcagtgattgaataggatgtaatctcttatgttatataaaacgtgtatgtgtttctttaaatcaaaacaaaattattttggtgtattagcaaacggaatatgcacagaaaatgtgtcctcctgtggttgttgcatttatgtttgttttttctggtagggggttctctctgtttaatatttgttttagtgttctgtgtagctatttttcttaaatttgtaaactgtattttaatatagaataaattatgtagtgtaattgttgagaatttaaatgtacattgggaatttcatctttatattatcttgtactgttctgatttatcataatcttagtgaataaacctagtacagaggaaccttacttttcattgtaaatatgccggaactttctccttaggttgggataagcattcatatggttaccatggggatgatggacattcgttttgttcttctggaactggacaaccttatggaccaactttcactactggtgatgtcattggctgttgtgttaatcttatcaacaatacctgcttttacaccaagaatggacatagtttaggtactgagataatatattgcatgcaaaataaccaaatatggagattattatacttccaggatggtagttgtatttattatgtgattctcctttatagatggatgcctctggaaatggtttctttctttttcccagacagaagctgaggaaatggtgaatatttatattcaccctatttatattctgtgaaggccatctatataatacatatatgtataggagttactgtagaaataatccccacactgagatacttattctagaaatagaaatgccaagagttttctactttaaataaaacgctacacagtataatctaattctctgggtaacaggtgctaagaaaaaggggcagtcagttgttaggatagtgtggggaatagtaacaaaggaagggaaagcttgatgccacaagcatatgaagggcatcaacacactcaaaggtcagatctgctaacaaagatggctaagttggtaactacaagtttgttctatggaaggaagcagaattaaacaagcaaacagtgacaaaactgagaataaaaaacttctgaaaataaaataggttatggaaaacttgaaacccatacattgtaagactaatagtaagttaagattttcagtggactattcatgtactcatagcacttcaaatttaaagttatatgtggtcattatattccattttcttagaagtttttttttttaaactatagaaaatataaaggataataacactgatgctttttgttttataaaaaaagatttcaccttttactgctggaaaaatctttgactcaaagcaaattatttttaatgaggtaaaatgaaaggaagcataaactgagtaaccctagaaggcagaaactatttacaaatagtatttagaaattagacttaaagtagtatgcttagacatataatagatgttctttaacacaaaagctgttttttctgttatttcatagtataaaagaaaattctgaatttctggctgcattggcaatactcttttaagagtgtttcaataaagttaacttttttcatattcagcttagcatttctatttctgattactgatttttaattctgaagtccttctgtattatctgacttaaaagtttttctcaagtccacaagagatccttttctcactagtacaataatgttaaggaccccatgcaaattatgtatatttgtgtgtggtttcattgttgtggccacctggtttccaagaacaatacaggcctcttgaatttatttgttgttactattctgactgttcatataatcttagttggcttgactgcttaagatgttggaagttttgaatccggagaaatctgcttttaggtgtgacctttggctcaaaaaccaaaaaatacattttgaaaaaaccacaatctctttaacataaactttttaaactttccagagaagaaatttcattttgggagataagacaatcacaggtgataatgattttattttttccctattttcacaaatatttaaattaaatttttctcttggctaagaaagctatttttaaaatgtaagatgtgtctttaaaaaggtgcacctaataatggagtcacattataaatttttattttttgtttattttatttatttaatttttgagacggaatgtccttctgtcgccaaggcaggagtacagtgatgtgatctcggctcagaacctctgcctcctagtttcaagcaattctccttccccagcctcctgaatagctgggattataggcacgccatcacccccagctaatttttgtatttttagtagagatggggtttcaccatgttgtctaggctggtcttgaacctctgacctcaagtgatacacccgcctcagccttccaaagtgctggcattacaggcgtgagccactgtgcccagcctacattttaattttaagtaaacctgaatgtttggcattattcattcttaaatttaatgagtattaagcacatagagagatggtataacagtggttagtaagagttctttagtcagacttgcctgggattgactcccggcctatgccaggtaaccatatgtaaattacttaacatttctgtgcctcagttttcttagtttgtcaagtaggatcactgtaatacctatctcactaaggtggttagactaaactgcaatagtatgtgcacagttctggcatctagtgaataaccattaaatgttatttagtatcattgtttgtcagcccctgagctaggttcctgggatccactggtaaaccattgatgagcagaaattacttctctagaacaggagtctacaagctatggccaagttagcctcctgtttattttaaaataaaatttcattagcaaccagccacacctacttaaatattgtttatggttgctttcctgttacagtggcagagttggatatttgtgataaagaccatatggcctggaaagcagaacatattagtagtccttcataggaaagctttgcctacctctggtctaggttctggcatcttccaagataaaatactgttaaatatttagttactattcccttatacttcctaagtggataatctgtgcccaaaacttgatacatctttagtttctgtctcatggaagattttcagaatgtatatttgtttactatataaggaaaaatagaaaggttttatttgagaaaataagagaaactttgcagtatataggttaatgtaatttgataattttttactttgttttattgaatatcgttcaccaattgaagatcacttttcaaaaagcctgacaaatcaggaaattatgaatatagaaaattgctttctgtgtaaaattcaaatagttatgccatcttgttaaagtggcatcttttcgtggtctgattgagcaaaaacatgttgtggtaactatatttggctgtgttaaaaaatgttaacctttggaattaattttgaatttttcgttagagtttttggtaaagtgaagatttcagtaattacagacaaaggatttttgctaaagatagaatatacagtgttgattataactagacatctttgagaaaaattattttatgaaaaatattagaaatatgtatagtttatagtatattaaaatattctcttgctttctgtattctttttacttttgtgaaatttttgggaaagttttttatttgggctgatagtacttgctttctgtgttattaatgaagttaaatgtaatgataatgttttacgtggggaaaacaggaaccctaactttgctttccttttaacaagccaccatgaatttactagtttttaaaaatcataaaaacagggctttactaactacaaaagcattaattttacacattattttaaaagtataaaatttattttcagtttgtcttttaactttattaataaatagagttagatgttttctgttattacagcacagtcatagaggaataaaatgtcaagtaggaagagaccttaaaaacaatttaatggaaattccctcagttttaagatagtgatcaagactgtagaagcagtggtgctggcttggttttaatgtttgttttagactggaagaattgagatcagctgactgactcaccaatactgctctcccattattctagagctaaatctttaaaaatatatctacagaaatactttattattttcagctaagttgtatattggaatatttaaaggaggtcgttaaattgtcacgttgagttgacagtagacttattccaatgatattgccattgctcaagttgtatctagaacatgactgttgtaattactgtcaaaaggtattcaagagaaattctaaactgtgcaaaatcgttcatcctttgaaggaggaattgatttttcccacgagtaaatcataagttaaagaatttactttcataagaaacattttttaaagaagcaaaaatatactgtattttcccttgtttgccttttataacagaaaaactcttttctttccagctaaaattatttaaaagctaaatctagatgatgattattaaacggtgagggtacaaattgcaacttggggttaaaaaataaactgactattttgcaaccaactttcttaatgtgttttctaatgtagctttgaagatatatctaaaagtatttcaaaaatcctggagacaatggcagcatctcagaaataaaatttgtgtatgactagcaaggctgattatcttgaaaggggacagcgtttgttcactcagacatatgttagtattattgattaaaaattagtcttgttattttttatttaggctttaatgtttttttcttttgccatttgtttcctccttttagttagaaattcagcttgtcagtatagtctgctttgaaaaacagcttctaatgccacttttttttttctttttaggtattgctttcactgacctaccggtaagactttttttaaaagcagttttccatttttaattacaggaagtataaagaaactgatactgggcatatttagaaagtttaaaatacagtcttattgatatttattaggtttatatgacatgcaaagaaagagatcttttctctaaccaccttgggtgtagaccctcagaaattaagctccaacttgcactggattcattgtataaaggaaaataaatcagaattgattctcaagtgtctttttaaatgtcaccattcattcatttgaaatgtatttccttggacttttcagcagaaggctgtatagcagttataatcgtttattcatccaagctatatagaggcctactatgtggcaggtaaagtgcttggaatatattattcaacaggtagtaaaggtctctgccctcttggactttatagtattcaagctgtgaaagagaatgagcagtacatgaaaaacaagtaaagtagaacatattttaagggtgttaagtatactttggaaagaaagggaaaaaacagagaatgggaataccaacggtaggacacaaggttgtacaagttgctcccctttgctcaaggtgagacttgagctgaagcttttggaggagtgagggagtctgccaagtggatatgtagagcaagagttttcaggcagagggaggttagagaaaaggtgctcaggcaggagcacagatggcttgtttgaagaagagtgtgaagtgtggtagagaggagtgaggagggcagagcatatgtagtagcagatgatcagagataataatggggttgggggtaagctattaatagatcatctagacctgggcaagccattgggagggcttggaaatttactctgagtgaaatacaaagacattgtggacttttatttgtcatgataggacttcagtttttatgggatcactgtgattgcttagttgaaaagtagactaggccgggcatggtggctcacacctgtaatcccagcacttagggaggccgaggtgggcggatcacgaggtcaggagatcgagaccatcctggccaacacggtgaacccccgtctctactaaaaaaaaaaatacaaaaaattagctgggcgtggtggtgggcgcctgtagtcccagctactcaggaggctgaggcaggagaatggcgtgaacccaggaggcggagcttgcagtgagccaagattgtgccactgcactccagcctgggtgacagagcaagcctctgtctcaaaaaaaaaacaaaaaaacaaaacaacaacaacaacaaaaaactatatgggagtaagggtagaagcaaggggacctgtgagaagactattgcagaaattcaagcaaggggttacagtaactctcttcggtagaggtttgattccacgtatcttatttaccaaacccaaggcactgtcagttgtaatctgcatcatctgtgacaccaagggggaaaaaaactaacaaactgtgacataatgcctcccttatcacttagcatttttattttatactcactgaatgatctcttagggttatttaaacttagattttaatatgtgtctctttttaggtgttgcacacctaaaaaggatgagataagcaatataaattgattaaggtattcctaaaatttcatgttcagagtctaaccttttaaatcagttttttaaagactggatgccatgattttctttgatctcactctgtcacccaggttggagtgcagtggtgtgatcttggctcactgcaacctctgcttcccaggctcaagggatcctcctacctcagactcccaagtagctgggaccacaggtgcacgccagcatgcccgactgattttttgtatttttggtagagacggggtttcgccaggttgccgaggctgatgcccatgattttctatgtgatactgtcttctccgtcatcaagaacattttttaagattactcttattatgtctctgggattaatctccaagctgctgattacatcgtgcacgtttgatactgtcactttcatgatgttaaccaatatcacgaaaatgaaaatttcatcaggaaaagcaactcagtcccaagagtttttcagtgagctcattctttaacaaatcgctcctgtgcaggcattgacagctgtgtcatgacagctgcctgaccatagtaaggtgtcatcaattataaaatgcattccagttttcagagatgttttgaaagagatgatggaagattcagaggtagagaatagataccaaatctatagactatttatatcccttaataaaatgctaggaaaaaacagaaatcaaaattataatagaaaataattttaagccaaggaatatttgaaccctaccgatcaaaagtactcttcaagaagcattatttggctctgggtgtctgaggtgggaggactgcttgaggccaggagttcaacaccactttgggcaatataatgagatctcacctctactaaaaaaaaaaaaaacaaaaaaacacaacaacaacaaaaaaccctgccgcattatttagtaaatagtgatggaatgagtctttattatttatttttttaaaatacatattgttaggacaaagtgtaaagtaagttctagatggattaaagagttaaatttttaaaaatcccaaaataatagtaacaaaaatatgattcttttaaaaatccaactgaaaaccaagagaattggctaatggattggatctgaaaattacataaggtctgagaattgacaattgtacttagcagagtagaggtcgttggtgacctggacaagaaagtttcagctgtgggatggagacatcctgattggaatggattttaggaataggtgagttataggcagtggataactctggaggactttggccatggtgaggagtaaagaaatggagtagtagccagtggtggaagtgggggcagtagaaaaaaaaattaagttaggagattgagtatgctgatgaaaatgtcggtgtcgcatagaaagaggtagacagatgtgtaattgaggggatgggcttttgagaagagcattgtggggacaggcagagtgtgtaggtgcagattctggttagtgggttgatttggtctttaacagttaagagactggtgagaatgctgtaagtttcatttggagttggttaaagagtttagtgacttttttttttttttttttttctgttgtggcactaagcaactagtcagcgtgagcttttgttgttgttagctttcgttttcttgttcatagatagcggagatcatttggaaaaagcttggttgcttgtagacatgttgtttattttctctcccacttttgaatcaccagttatgttttttccctcaggtagccaatgatcatgtgcaactttgttgtaacaatgggtacagtggtggttttaggtttccttttagtgtagtatttttcatttttaatactgtaaatcttctgggacttccataggcttcatatcaattcttccttttaaaggaagcatcaaggaagtgtttatatcttctatacctgtgatctctcacaagctacccataccattgaatcctgagagaaagtatatttgcagaaaaaccagtttacctagattgttctgcacctgttatggaatataagtgtttatacagctttgaaaaccttagatttttttcaaaatagtcttttttcctcagcttacctcaccagtttgagaaatgacattaagtataactaattcagtttgggatttaattatacaattaaattatgatagttgcacagttctgtgaacatactaaaaaacattgaaggctgttgctttttaaaggcttttgttacagtagctgttctcattttaaatgatgctgttttcgaattctgggcactgacttgaaatctactttttgtggatacattatttgtatagtcatttttattaaaagagatcgaatgtagaccaaagctgtgctattgagaatataaatttatattgtgtacatttagcttttaagcaatttctagattgaaagtatgttttgcaagttaatagaaatgttttcctattcttttcataaagaacctattctgtctatatactattctacatgggcaggagtatttttctagaagacattattacatataaatctacagtgacaatgcacctgctgcatggatgaaccttgaaaacatgctaaataaaagaagccagccatctgggtgcggtggctcacgcctgtaattctagcactttgggaggccaaggcgggcggatcaagagatcaagactatcctggccaacatggtgaaaccccgtctctactaaaaatacaaaaattagccaggagtggtggcatgtggctgtagtcccatactcgggaggctgaggcaggagaattgcttgaacttgggagttagaggttgcagtgaaccgagattatgccactgcacttcagcctgggcggcagagtgagactccgtctcaaaaaaaaaaaaaaaaaaaaaaaaaaccagtcatataagatcacatattttgttgttccatttatgcaaaatgtccagaatgggcagatccatagagttagaaagtagattagtggttgccagggggaacggggaaatgggaagtggctgctgatgggtactgagtttctctctggggtgatgggattgttacacaattaaattacagtagttgcacagttctgtgaacatactaaaaaacattgaaggccgttgttttttaaaatctgtaatatagcaagttaaggactatgtccttaatcctcttctcccaattctccagttttaaggttgagtaaatggtataacaattatacttacttttcagtgagccaaaactgacttaatattactaaaagtttttttaatcaatatcagattacagaagtaatgtatagtattaaatacttaaatgagaaatgtttatatatacagaaatgtacaaaagagaagttcttcataatcccagtctctttggctataatgtttgttttaacttgaatatatatccttttagacttctttctaaacacatataagccagtatgttcattttttgaatgtttatgtgaaagatagggtcataccatatacaatatgttataccttgctttagtgtgtataggacatctttctgtgtccatatatacatttttcattctgttctttttgcctgctttatgttatcttattaacttactaccacaattgatcaattataaaatgtacatttttttcatattttagtatttctgaaatgagaatgcactgtagaatcaatgactggtcagagtttaatttgcattatgttttcctagacacaaaatagtgatgtttgttactattagattttgagacttgatgaatatggtataatatcacatatctgtgaatattttaaaattttgtttgtgttacaaataatgctacaagacatatctttgcacatacttatttttgtaggaatacactcttccaagtgaaattacttggtcaattttaatagatttttccagatttctttgttaaaagattatgtcagtttacatttctgtgtacagtagatgaaagggttatttccccaacccttatcagcattgggtattctcagcctttcaagtcttaatctgatgtgcaaaagtttttaaatcttgaacttttaattgattttatttttaagtgcgcattaaaaatgttcatctaaaaagttgagtgtgattaagcttctctttatgtgttgtcatttttatttcttctacaaattgcctacatattcattgccttttttaagaatttgaactggtagtctttgtcctcctgaattttttctgtatttgtaaaacacattttgccatatgtgtggcagatttttttttctagagagtcatttgtctttgccatttgtggcatgttttgtcatagggaagttttaaatttttatgaaatagttttatcagagaattcatgaatgttgattgtctttgatagtgttgatagaattattttttctgaatttgtaagaaaatttagatgagcagtcattttaaaaatgtctttatttagacaatactgaatatcatcattataaactgcttaatgaacagaattgtctttcactcaattgtgtttggcttatatgcttttgtgttaaagtatctcataactctgtagtgttttttctgtttttttgttttgttttgtttctgtttttgtgtttttaagacagagtttcactcttgttgcccaggctggaatgcagtggcacaatctcggctcaccagaacctccccatccccggttcaagcgattatccttcctcagcctcccgagtagctgggattacaggcatgcgccaccacacccagctaattttgtatttttagtagaggcggggtttcaccatgttggtcaggctggtcttgtactcctgacctgaggtgatctacctgccccagcctcccaaagtgctgggattacaggcgtgagccaccatgcctggcctgtttctataaagtctttaggtctcagttttctcattggtgaaatgggaaggctgtactatctcacctgtttttggcttaaaagtttataaacttgttagctctgttgattattaagaatcaatacatttgcatactttgctttaaccatttatttccataatccagtagtactttatatttttgatattttgatgtaatattttgtttctgatttgttctgcttgattgaacggttgtttttaaacacaccctctttgcattttactgtgaaatctatttaacatattcacacagaaattatccgctcttgatctttaccttgttttgtactgaaaaatacttgttataactattaaagatataagacataaatacagaaaatgaaaatatggtaggatttggagttgcaagaggaaaaatcagttttggatgtggtatcagacaaacttgtgttccaattccatctctgccatttgttagcagaacgaccatgagcaagttatttaaccttgaatcctcattttctctgtctttgaagtagaaataataatagtggcctcacagaattatgattaaaccctggcatttagtagccactcagaaactcattctgcctttagatgtaacaaccaattagtgacatagccaaaagaatgacccctgtattttttgtttacttgaagttatcaccttttcatcttgattaaccttgaaaccatggagtgtacctgaatgcatttctgagtttgggtatattcagattcatccttttcctcccttgaaatacatatatttgaggttttgtgttttttttttaatatagagaatctccactcttcctggcactgtgttttgcttatagttatggtcttatccccttccctttgtaaagttaggcatcccaaatatacagaatgaaaacagtaaatttaagctattaaatgccagactagctgagatcatacttttatgataactagctttaacatgcagtttatagaaatgtatcatatataaaatgtgggataaacctgagttatgtgtttatagttgaatttctgtaactactatatgacataatcttagaacaagaattacatgcacatatattagtagcataataccacgtggtataatacaacgtagtccctgaataaataaaacagagatcttgggtctctttgttttttcttgatgattacattgcaggaagtgatattttttcatctaacatataatgtattttagatcatttgttttagccttctaatattttgattgggattttaaaatatgaagtaaatttatagttctattcttttaaatgtaacattaaaagaattattaaatctaacataaaatggatagatgtttaatgaaatatgctatcttacagccaaatttgtatcctactgtggggcttcaaacaccaggagaagtggtcgatgccaattttgggcaacatcctttcgtgtttgatatagaagactatatgcgggagtggagaaccaaaatccaggcacagatagatcgatttcctatcggagatcgagaaggagaatggcagaccatgatacaaaagtaagagtgaagaaatttcaattgatgctattcagaatctgttttttataagacatttattctgttggtatccacagaagctttttaatccactaatttatatactgacatatctattatattattgattttaatctctcaacgaaaagtaatttactccactatttaaacaaattaaaaacaattgtttgacacacgtacagaattgtatttcagtctgaattaatttgatgaaggaaataaaatgatgttaggtcacctaggctaggttaattcatttgctattcttagtaataggatttaatgatttctgtaggttatacaatttaacttttaataatgttaatggaaaagataaagttgagagataatctagatcttataatcaggatctgtggtttttggtcatgaacttggctatgtccaagctcttaatatctgaactatcagcagtagttaagtatggacttaaaatttaaataaataccattaaatttaaaaagtcctcttcactattataatccaggtcaagaaaatagcagactttcagatacagttggtccaacacatttcatctttaatgtccttataattgctttgaatattcttaactttaaaattgtaataaaatgttgggggtattttttagaaaaggaagtgattgggagacatgatgatgactctgaaatcacacttcgtccctggagctattatcatctgtattacagagattggacactagtttttttgtccagcccagttgagaatagacaaccctgatgcagaatcctatagtcaccacgaagtgaagctagaatgggttgttctggggccacactgttttaatgctctgaaaatggttaccactgagtatcatggcaagatagtagaaaacatttatcttaaccttataaccaggatccttccacccacttcttcactgacttgatgttcaccatgaactcttgagaagtccattctaaaaggtcccctcccccttaaattaatttgaacaattgggtaaaataagatgcagatctgtttcttagacattttcctcccttttctccctccgctctttgcctcagtctcctcctgtggtgaaccactgcttcccacgattttctaactggcccttagtagtgtcaggtggaggcaagtttaaaaattgactgtttggagataacagatatttgggttaatattgttgcatcaccagtttttctaaccacatcttgtgggtagatgtaagtatatgttttgactacctggtacgtttttaaaagattattgtcttggaaatgtgtcacttacatgtaaaccatatttgataaatctcttgggtaaaaccatagtaattgatttagattagaaggctgattcctcctttaattagtagtacacttatagacatgttctggaagattgtctctctggattcaccttagtattctgtacatactttgtgatcccacttcatttaaccggtgtgtaaagaagatggttgaactctggaacattaagagttaatcttttattttaaagttggttattttacagaatgccagcaatactggaataagtcatatgataaagtcaaaatagaaattatggttagtagggctgaataataagataggaagggacctgggggtaatgagagtccaagaatcaaagaaaaggtcatttaatgtccttgattctcaagtaatatttattttagggagagtagtctcaacatagcatttgcagttatcttttcgaaaatagtacatgaatagaacaaaatgatgtttttcaaaagcttactttaaaggtgaggttcttaacgccttgtttcaaggaaataggttcgtttttataacaccagaatagattttgtttatataaattgtagtatgaagcatgtattctcttcactaaaagatgtatgtttcttctttttattttaagaatggtttcatcttatttagtccaccatgggtactgtgccacagcagaggcctttgccagatctacagaccagaccgttctagaagaattagcttccattaagaatagacaaagtaaggacactgtggtgcatggctaacatttgttttcagattatagatttggttactttaatttttagaaattttgtttttttaattaaaaaaatttcaaatatattaatttaaaatggatgcctctgaattttattttcactgacatttttgaagatcagtttaaaaattcacataggactatgtcagaattctaattctagagagattttacagaagttttttgaaggaatgtctttaccatttttttcttaaatgttttcttaagctttcaggaaataaacatttaataaaaagatttaaaaataataataaagtagtcctgattagttggaggagatagtatgtgaaagaaatgtaaatatctttgaatttaaatggctaatacagtattgatccataagtatttattatttagatcctagtgctggcctctgtggccagagataaaacaggtcctgtataacaatggcaagtcagcataactggtccatagttagccatcctaaaattggtgctgtttgtccatcagggtgggtatgacttgacaagagtatagagatgaaaacaaaatagatgggtgaaattaatgggtgaaaacaactatttcataggtcaaattgctgtaatagcactgattacattgggttgtagttaattgtgtgctgtccttttctactattttaataagctctgttgaacagagatcacttactcattttgtatccttatcatctaatttaacatataacagatcaagtgaatgctcaacgagtctctgttaaattggaatcttagtcaaaagctagcatttttcagtcctttgttcagaagattatgtttgataaggcattttagtatccctttaaaacagtctttttaatctcagtgtttgaaacttcaatattgcataataggtattttaactatattactcgtatgttcgtgattttaaaaaaaaaatttgtgaccgtacttgtttttctaattttctagtatgtctgaaatgtttcctggattgcctaatggaaactatgatgttagagaaagaaattgaaattaatcataatttatttaaagatttcttactaactttcttttctgaggtcactaagtttatgttttatctacttttgtaaaagttaatcgtttgctttcttttactgaataggaattcagaaattggtattagcaggaagaatgggagaagccattgaaacaacacaacagttatacccaagtttacttgaaagaaatcctaatctccttttcacattaaagtgagtttgcataataaaatgctatatttgttatatattataaatatttgtcaagttatgtaataaaagacattttcgtgcttttgtaattttagtttttttcgtttttcaagtatatacaattttgtaatgtcatttaagcaacatgttatgaaaaatacttttgtgttaaggaccataagcagaaggtgtcttttgctatgtatttgcttttattattctatttatgtgtttaaaaatgtgaaaatcttatttagaagatgggtgtctatttttccttctcagaagtaccttacatttaatctctctggcattttaaaaaattgtggtaaaatatacataaaatttaccattttttacattcacatcattgtgcaaccatcaccaccatccgactccagaacttctccatcttcccaaactgaaactctctattaaacactaaccatccattcatccccctagcccctggaaaccaccattctacattttgcctctatgaatttgactacccatataagtagaatcagagtatttattcttcattactggcttattttagtgtaatagccttaaggttcatctttattgtagtatgtatcagaattttcttccttttaaaggctgaattttactccattgtttggataatactgcattttgtttatccattcatccactgatggacacttaaagtttgcttctacctcttggctgttatgaataattctgctgtgaacataggtgtacaaatatctgagtccctgcattagatttttttggttatatacccagaagtgaactttctggatcatatggtaattctatgtttaactatttttttttaataatagccatcctgatttgacaattttaattggttttatgaatctttgttacttaaaaaatgagatgttactgagcttcagatttcaacttgttaagcaacagatatcctttgtaagtcaaatgacagaattgttttgctttagaataagaattttaaatgaggcccattttggttaagaggttgggaatgggacgggtggggagaaaggctacgctttatatgtatctcatatacataaaatcatgtccttaggcacaatttgatttgctaccaagcgcaaatgttattttgattaaattacttgtagccaaaaaaatggggttcatatcttcttataggtaaatttccatttggtaaatcctgattaaagggggtaatattattatagtgtctattacattgtactctcatttttctggaaattctaaaattctaagcattaaagcataggacaccatatttaatatttttagcttactaaagaccaatcctactgataaatcaaagttttaaaaatatttttagaaatctgttgctattaaataaaaggccatttgaagattgtgtctaagtaaatttttcttttctcctttagagtgcgtcagtttatagaaatggtgaatggtacagatagtgaagtacgatgtttgggaggccgaagtccaaagtctcaagacagttatcctgttagtcctcgaccttttagtagtccaagtatgagccccagccatggaatgaatatccacaatttagcatcaggcaaaggaagcaccgcacatttttcaggtgagatttaacttatgacattatttttagatttttcctctttataatcttaaacctttttccttttgaaaatctgtatatttccagctgggcacggtggctcacgcttgtaatcccagcactttgggaggccagggtgggcggatcacgaggtcaggagttcgagaccagcctggccaacatggtgataaccccatctctactaaaaatacaaaaatcagctgggcatggtggcaggtgcctgtagtcccagctactcgggaggctgaggcaggagaattgcttgaatcctggaggcagaggttgcagtgagctgagatcacgtcactgcactccagcctgggtgacagagggacactccatttgtctcagaaaatctgtatatttcctttgtagctgttttcaaatgtgtatacttaagatttttctgggtgaaaaattgtaggttcagattgacatgttctcagtaccaggaagtcacttgaagaacagctgtctgagaataggttattagcagaccttcctaaatgaaagtcagcattcacaatgagtagtcaccagaattaaattattgatttttaatagtgaaaaggtaattgtgtgttttaataaaatataaatttaaaggtgatgtggctgtgataccttatgccactggttaccacatctagctgggctgccgctgcctccctcctctccccccacccccaacctttcccaaccaagcctcttgcaaaagtcagctctgcctagttcgttttctcccatccgtttgttggctcaccagtcttactctctgtgactttgggctttctcttaattaaaattctctcctttcttggcttttgtgacatcacttctacaggtttttttggttttgtttttgtttctttttaaagagttggagtctcgcaatgtttctgatgctggtctcaaactcctggcctcaagcactgctcctgcctcagcctcccaaagtgctgggcttacaggtgtgagctaccgtgcccagccacagatttatttctgatgcttctcagtcttctgtttgcccatctctttaattctgcatttcccaagatgttatctttgtacatttaacattcttaaacaagtcagatagtgtctcctttcctttcatgaagtaacaccattgctttttcttatttcaatttattctcttttctgcattacttcctctcagtttatttacatcaccactctgtacaacaagtgtgattcccatgtctgttcttagccactactcctcttgaatatcatacagtcacttcaggcttggataaattctgagcctcagtgtattcatatgtaaaatggggatgatcataatattgccattttagggggattttgaggattaaatgagatgtgtaattaagccttcaataaatgttagatgaggtaataattaagatctcacaattaagtattcttagtatcctttcaaagaagttacctgtttacatcatccattgactctcctacgttctagaagtcttagtacaaaatcaacatggagacttgtttacaaccgtattaataaattagtgtttgtttctgtttctacgtggtatctttttcttcaggttttgaaagttgtagtaatggtgtaatatcaaataaagcacatcaatcatattgccatagtaataaacaccagtcatccaacttgaatgtaccagaactaaacagtataaatatgtcaagatcacagcaagttaataacttcaccaggtaagtaatttcactgacttttgcactaatataagcaacctagttataggtgtaatcgttgtaataattttgaaagaacttgaattatgtgacccacagaggggctctgggagttcttaagcccccagagaataaaagcgtagggagtcagttccccaaagctttttagtctcctattatgcacatgagctctttccttagtttcttcctcttctctactaccttcttccctctagtaaagttataaggacaaattcagggcttcatgcattgtcttcctgccagccacagagctatacaaatgatcacataaatgccatttgttatgttttcacagtggttaagacacagtagcatatttaaccttgaacggtgacataagataaatttacaactgattttttctctgtgtgtgagttttttttggtgtaaatgtgtagaatgttttccaagttcaaaactaactttacaaataatcttttttgaaagcctgcctttaagtagcttgcatatagcagatggttaagtcatttagtaaacattggtgtgaggatggttttgaggatttgttgggcaccaaacattctgctaggtagggtgtctcactttgaagaggtttgaaagatgatatctcagtcagtgtactatgacccttgatatactcaggtttaatatttatgaaacctaaaagttcatgaagtgacattatttgaattaaatactactgtgcagtagcaaattattgtgaattcaccctgcccaaatcatccaggactgggtcaatttaatattggtttggtctataacaaaccagttggttacattgcattttcaggaaatggtcatcagtgccacattttcttattaaaggagagagagcctaacttttagcatggaatcttaatggaaatatgattttgcagaaaggattgtatgtaaaaaaaaatctgtatttgaaaattgggagattaatctcaatttctgggttgtctgtcacacgtgacaaaaatttactgaagtaatagtgtgtgtgattgatataagttgtaatggagaaccacaaaagtgtatgagaagagcagaaaaatcgtctttcacagcagaggtgatatattggaaaatataaaatcaaaatattatagtttaaaaatagatggaaatgtaaaaagttaagtacttcatcatgctttatactaaatgcattggtactttatcattgatcaaggctcttgccaatgtttgagggtaagattgcagtcagtttgtgagtttttctcttgaatactatccctacagcaggaagttgctaaacagatctattattacctgagttcagggaagcaagcttaacggaagggtctgatgacacaacatcctcctttgtctgcagtataaaagggaaagaaagtcaactttgaactgccttaagctataagttattttgtagttggtaatggctttcctaactgtgaagtaggcaaagatggtattaactatttaaaccattttacagatgtagagcgggatatcagaaaagtaaatgacttttttttcttaaggtcaattattagtagctagtaagttgcagagctgaggctgcgtttcaggatttgacttgcaaacttgtgctttttccctgataccgcccaccatctgaaatgctcttcttcctaccctccctcacctccagtataacttctgtccaggctgagaaaattcaagttcagatgtcagttcttccaggatgttttccttgatttacatcccatcaaatatgtcatgttttgtgattaacttccatcatagtactgatcataattactctgtaatataataacttaattagctttttataggttgtttgctacaggaaggcagaggctgtttcataatatccttagcacctaacagggatcatacctcagaggctcttaaatgtgtgttaaatgaacgagttccttccaaatactaaactgagttatcaaaaaaaaaaaaaaagtttagtattttttaaaaagccactgaaagctgtgatggtaaggattttcttattcttaaagtttggtttttcttaccaattttcgaagtttgttaagattataaacaagctttcctggttgagtaagtctgctctggagtcgtagggccatatcccccttttccctagatctcttgttttttttttttttaccttaacaattttactaacaggagtgtatgcatgcacacacacacccccaaggtgttagaatttgttacctctggtggtattacgcatagtggtttttgctcatctgtgtttttttttctacaattgaatatatattgcttttgtaatgagaaatgtcatttttatctaagcattacctaaaatttcatcgagtgtttacttctagattgtataattattacctaggcttccataggataaatcctaaagattagatatttattgttgcttataagagtgcggatggttctgaaggacatacattgacagcttaaatatgtgcaaatatagttattggcagatagatattcattgagtggaatgagtgaaaactggaaactatccaggacatcagtttaaaagttaagattcagcaatactttagccaataagatagcctgtgagttcactctctgtcgtgtggtgaaaagggatgagagaatgaagctcaatcattttttaagttatcagttacccttgaaagaatgtatatttttaagtagtgaggacaaatgccagaatgctatttaaaaacagcctaggagtggattgagtatgaggtccggaacgaggtgaagcgggttccaggagtgagatgtatttgttttgagagtgaggttttccccttacatactagaaatcagtgctgggggtagggggagagggctggctggggagttggtggggcagcagttgattaacgaagacgtacagatctgaatttgaaaaataataggattgtgtggaagtatgatttctccatattgatgtaaagtcataaaaccactacattttagcatatgtactttttttcctcccttacctccgggggtacaaatttgttaaaagtcagcgacatgtttggctttgaatacgttcaagatttaactaaataccttttttgcagatttctgttgccttatgaaattagtttattcgtaggctatgtagttcagtagtgatttattttaaactaagctgcaagtatgatatttctaaaattaggtttgttttttcgttttcagtaatgatgtagacatggaaacagatcactactccaatggagttggagaaacttcatccaatggtttcctaaatggtagctctaaacatgaccacgaaatggaagattgtgacaccgaaatgggtctgcagtgatatttcttacatttttaataaaaaatgatggctacaaggttatgtttttacttgtactgattcacagctgatgagcataaaccagatttaaagatgtatgtgctgtaggacttgacagtaatgcatagcacttaaactcttgtttgagtgggctgctagagaaagtagagttacctttcagctacaggcagtgtttcttgctgaactgcttaggctcaggtttagcgctgtcactaatgcagcagtactgacttactggtgttgagcctctaggctattttaggttggagatgatagaacttcttatatttatgtcagtatagtcagtaaggccaaatggttagatgattttacaaatttctaatcagtatttcttaaatgagtttaacgtaaacgtgtgtgactttgcatagtactatccctggtatatagtaggtgcttaagtatgacctccctcaccaaaaaaaaaaaccccaccaccaacaaaaaaattatgtggctccaagacacattagcatgcataattttattttgtagacaacttaagtagtaaattgcctgtcccatcagcaaactatcccatcaaatggagagtgaaaatttatttgttggattacattttttcatttatttgttggaattccatggcaatgttagatttcttattattttgagattgagtggtattactaaaattgttttttaaaaagaaatgcagctttgttttactcttcaatatcagccacctcagtttctgaagagtaatttaagtacagtgataaagagcaggagttctagagccagattacatagatttgatttctgcaaaactgccatttactagctgtgtgaccttggaaaaattacttaactgctctgtgtctcagtttcttcatctgtaaaatgggtataataacgacctcataagttattgtgaaagtaaatgaataatccaaaaagctaatagcacaaagtgcttgggaaatattaaccatcatcatcgtcattaccttatttttaatgacttataagtaatttatacagttaaattattttatcaatcaagatatataaaactattttcttagctgggcatggtggctcacgcctgtaatcccagcactttgggaggccgaggtgggcggatcacaaggtcaggagtttgagaccagcctgaccaatatggtgaaaccccatttctactaaaaaatacaaaaattagccaggcatgatggcgcgtgcctgtaatcccagctactcaggaggctgaggcaggagaattgcttgaacctgggaggcagaggttccagtgagctgggatcacaccactgcactccagcttgggtgacagagtgtgagactccatccaaaaaaaaaaaaaattattttttcaaagtggtatttttctaaaagtagtgcatttaatcttttcagttagtataatatgctgtcttctgtatttttattgtagtcatttagcttttcttagctttcaggagcattttattacatctctactacgtcagttaaggcagcctgagtggcattattaacagttttcctttttttttttttttttttaaatgttgcttaatgtagttttagggaattatactttttctaaaatttttttctgacataagtaccctctaacactgaaaggttgtcccctctcaactgcatgctgaatactggatcctagactcttgagagctaaataaagtatatcttttagctgcagtttcatattaaaaatgaatttttaacaatctgcatatttagatgaaatattagggaatagttactaaatgtacaaaatggtataagaaatgtatgttcgtgtcctcattatactccattccataaggtagtaaaatacttgtctgtttttcttacagaagttgattcaagtcagttgagacgccagttgtgtggaggaagtcaggccgccatagaaagaatgatccactttggacgagagctgcaagcaatgagtgaacagctaaggagagactgtggcaagaacactgcaaacaaaaaaatgttgaaggtgaatatattttttcttgaaaaattatgaatatgtcagaggaactaaaatgtagttttgtgaaacactgagcagtgtaccagaaattcttgttagggaactgggacctgaccttccccctggctccttgcccatctgagagtggaaatatttgatgaagttaggcagttctgatctactggaaagagcattggactaaagcaaaaaaaaaaaaaaaaaaaaaaaaaaaaaaaaaaaaaaaaaaaaaaaaaggattaaatcccagtgctagtgcttatcaacattgtgtgtcctcgttaacttagtttcttagttttattttctcagctgtaaaatcagcagttactaggagcaatgtgggcgtgcagataaaactataggtctgagatctcattttagtaaatgttgttcaggtttatagcattttggatgtataacacatggttctcattttgatgggaattagtgaagaattgggtcacttttcatggccagaatagttaaaatacattttaaagtctcttctggattgttgtccatgagctgataggatggatacaatctaattcagtaaagtagccacagttttgtgtaccagttgaaggtggaggggctttctcctaacttaagtcagcattgcagttgtagagatgtacagctctttaacagttggttcattgtaaacattttcttctgaatattttggaagaagactgaaattaaaggggagatgaatgcagtggccttgagactaatgtttgggtatggtaggaaagggcaagcaaaagattcctgccgctgtttcttcctgacctggactgaaagttagtacaggttgagtatccctagtccgaaaatctgaagtgctccaaaatctgatacttaagagtgccgacatgatacacaaggatatgctcattggaacattttggactttaagatgagagatgctcaattagtaatgttttaacatttgaaaaaatctgaaatctgaaacatagcacaagtgtaggacataacatgcttgcctggcctaggatgtgttatagagcacctcaagttaaaggcatgcaatcttgtattttccctagctgagatgggaagtcaggtgtatttatcatactttgaacttcatctactccatagtataaaaactgctgtttctagtggttaccctgagctatcaaaaaagttaaattatttttatgttagataaaaaataattgataattgaaacaagtttaatttaaaaagtcaaatcaggccgggcgcggtggctcacacctgtattcccagcactttgggaggctgaggcgggcggatcatgagttcaagagattgagaccatcctgctaacacggtgaaaccccgtctctactaaaaatacaaaaaagtagctgggcctggtggcgggcgccggtagtcccagctactcaggaggctgaggcaggagaatcacttgaacccaggagttcaggttcagcctgtgcaacatagtgagaccttgcctcttaaaaaaaaaaaaatagaaaaatgagaagagtggcattgctttatatttttttgtaagtctctttaatgcttggtttaataggtgagctgtattcgcatacagaccagactgcctttagtctgttgtggtatcacatgtcttgtgcctctggaaaattccactatatagtcagaggaaatgaaagagaaaagggcaaggaacatcttagtactattatacaaataattttgacttcacagatcccctgaaaggtttttggacccaggtgtccctgaatcatactttgagtactgttgttttagggcatatttggaaataaagaatttttttttttttttaagaattcttaagactttttttacactaggtcatctgacttggttttctttttaaaactttatgctaattgagcaggatgaaatacctttgaaaatttaagattatactccattagcttactttgtgtttgattcttatttacatgaagctcagaagatggcattatatggccaattctcaaagatattccttggttatatactgaattgtgtgaagatgtatcatctttatttaaagagtatagatgtctttgattttgcacctctaacttctaagcaaatgccagctactttcagagactttcttaatactctgagctgcttccatctcatttcccaaacttatcttgatctagatagggataaggtgagcaactgacccaccttatatataagtagccaaagaacaaggccggatgatttgagggcaacatgaagagaaaacaggtttagaaatcattccacttctttttgtcacttcagttcacttgtaattgtagcattttttaaaattgtagcatcgtttttaggtttgcataaactttgagtcatgtgactcagaagttcatgcaaatacacacacacacacacacacacgagagagagagagagagagagagagacagagacatgagagagagagattgagagatttgattaatgttgaaggtcaggtggcacactgtttctcttgacctttttccttttagttttttcaaagtcttctttcctcttttcctgttgtctttgttccttatctgcctacgtcttccagtggctcccaaaagaactcttgaattgtttgttgagcagctgtttattgaatttttgcagtgtggagaggcattgttgtagggactgtggaaagtccagtatgaatgaacagccccagcctgcaaggaccctttagtaactgaagtagcaagagaaccatttagagtcaccctatttagaaactgctccagattctaaaccaaatatgagtacaatttgaaaatcctacctaaatgatgtcacatttccctcagaagttattccactgaggtaatgttttttgctttaaaataacccataatgctacatatttcaggtattttcagttttgtgccttaactcccatgtgcatgtatcttaactagctaataactgtagtgacactattttgtattctgttttgtcataagaatttatttcctcccagtttctatgcattatttccaattatttttaaataactacacgaggctgggtgtggtggcccacatctgtaatcccaacactttgggaggctgaggcaggaggattgcttgagcccagaagctcgaggctgcagtgagctgtgattgcaccactgcactgcagcctgggtgacatagcaagaccctgtctcaaaaaaacaaaaaggctcaatgatattttattgttgctgtataggtttatttcaacattgctctgttgttggatttttccatttgcttttatgtcagatgctttagtgaaatctttatacatgtatctttgtttcttaaattattccactgagataaatttctagaagtagaattgagtcaaagaatatgaacattattgtggctctcactgcatgttgctatactggttttcagaaaccctttaccaacttttaccagcagtaatgaaggaatgtaccaatggcactactacattaatgctactttagcgggtttaacatatgttagtatcttaaaattgcttatttgcatttctttggttatcatcaccagttaacttttacagcaggctttaaaccattagtattgttttgccagtttcattcattttcctttgtgaagaaagaatcaagtcctagatgtttacgactgggagtttgatggtataaaccattttttatttttaaggctctgttagttttgttgcttacagcttcactctacttccaagccatgttttatagtgtttttgtgtgatccttctaaaattaagtctaatccatattggtttccttcatttaaaaccttatttccttattggaaaaacttgaagctttttagtatgttttttggggtattttagctcctaacccctacccatgtttccaaccatgcttttttctcctttctctcagcctgagtttgcatgtattaagtcaatagtaatgtactgtgtgttatttatttacatgtaagccttttcttgaagcagtgactaggtcctggtcatcactgtatcctcaatatctgacagctgtatgttgaactgtactgaaaatgaaataccagagaaaaattttagatgttttttcttcttaacatttagattggtaactaaaagaatctgcatcttactattcactgcctcagtttgcttctctagatgatagacatgataacaactttagatgattattgtaaggattaaatagatgatccatattagtgcctaaaacacttcttcacacaatattagtgcacaatacgttgttgtcattttaaagaactttttctctgagtttttaaacactgcagtgtagtagtatttttttttcctttaagttccagggtacatgtgcaggatgtgcaggtttgttacataggtaaacgtgtgccatggtggtttgctgcactagacagtgtagtcttaatttaagatttgggagtgcgacatttcacattttcggtggtgtgttaggatgtaggctatgaatatagttttgtacttgaagtttttgtttaccaagtattccttggaaaaattgttcagtatttctttttaaatttatctgtactatgggtatggtaccctcatcagatggttgtggggtaaattaagtcttgagcaaagctcagtccttaaaaataacgtgattttttttttttttttttttttttggagatggagtctctctctgtcgtccatgctggagtgcagtggcgtgatcttggctcactgcagcctccgcctactgggttcaagtgattctcctgcctcagcctcccgagtagctgagattagaggcatgcaccaccatgcctgactaatttttgtatttttagtggagatggggtttcaccatgttggctaggttggtcttgaactcctggcctcaaatgatctgcctgcctctgcttcccaaagtgctgggattacaggtgtgagccaccacacccggccaaaaacaaaataatgtgtttgatttgagttagctttacaggataaagggtcatatattctttccatgggttgggaagtgtgggttgggttaggggcgggaagtagaaccaagtagctttgtgggatgcataaaacatcttcattgctggaagaagcaggtcttgctctcaacaggcatatgaattatcttcctgtaccaagcacctgcatagcttcaggggattcaaaatagtatagtaaataatttttatcttcaaagaacttctattgtaattggaggagaaaactacccagaatgaaatactcagcaatataaaacaatggaggagccatgtgtgtttgcgtagaggcacgtgtattccatgccttgtggtctcagactgacttcacagcatttcttcatgggttattcttctttaaatccacaatattagaggcttatttggatgagaaagggcaagagtacagttaatcagaagcctttcccccacctctgctttcataacactagtaagataactagagaaatgatggaaaatgggtgtggaatctggttttttgagcagctgaacctaggagatggtgctctttaggaatttcagtagtcagtattttcaaagtgttgtgttcctgaactcacaaattgacagtttctgcagcaactctccatgtctgccttccaaattggtaagagtgttctgaatttctctatttttatatttgtataatattgctctggattagggtattgacttttggcataataataagacgtcatttattgaaagattagaatgaactgatactgctaatttcatttagtcctcatacaaatctaggaaatagggcctcttatagtccccattatgcagtaatgaaactggcacttagattgtcaattgccaaaggctacacagccagttagtggtggagcttggacttgaagccagtatctgaaaccaccattagtatgtgcctcccatagaaagaagacaaaaaatataaagtagttgtttgaaaagaagacgactgtcagtcattttaagttttgaagaggtgtggcttgagatagttggaaatactgaatgcataaacaggtcctgaagggcagcctgtttaattttttcataactgaatttgagaagatgacatcccagtgagatgtgtccagttcctaaatctgttgaaaaaaggaaatgcagacaggccctgtcctttgactgtcacattcatatcagtagtaataaattgtgaagtaaaacatctgaatgttttgccttccactctccctacaccagtactagttcattcctttgaaatttttttttcctgttttgtgtttagggatgggaggaagttgaatgagaatggctgtccacaggaaaaatgaaaataaattaggctttgctgcataatttaatgttcaaaaatgtagagcgtcccagtgctgggagtaaatgggtttaaagtttacattattagtctgtgcctggaagccatattttacctctcaacttggaaacatttgtgagcataatagttgaactatttgaattaaaaccaaatcgatgtgttttcaacaggatgcattcagtctactagcatattcagatccctggaacagcccagttggaaatcagcttgacccgattcagagagaacctgtgtgctcagctcttaacagtgcaatattaggtaagtaaagccaaataaggcacaatttcagttagattctctgaaaatttaagagagggtgtttgtactggcatttacactttggtaaaatcatcaggaaaatgttttctatatttttaaaatataaaaatacctaaaatatagaaaccccctcctttaattccagattcaagtggatttaaatagaataaaaacagtaagatggggtacaacttgggatgtttgggaaatagaagtttttgtgtgcatgtatgtaagcatttctggtagccacgaatgtctacttctctcattagaatgagagatttggtggtccttgtgtataattcaaaatactaccctaccagagacattccttacagccctctttagtgaaaggcattttctgccactgatttctaggctaggaattgggtggcattctctcgtttggctgctgtagaaggaatcggagaacgttaagaacatagattaataattgtcacaagagttaggctagaagggaacagggtacatttgaagaaaagaggtcaagaaaggttttgatggagagaatgaaaatggaagtaagggagtgaagagcttgaatatcagagaagctcaaactgatccagtagagggcaggattcctagctggtcctcccctgttacctggttcccaaccattttgcttgagctaaatttgcaatgggtagcagcagcctaagccactggtatcacagctcccaccatgcttatgaatatgggcacaaggggcttcctgatgacttgtgagtacccggcaggatcaagccttgatgtcacattctatttgcatttatattagccggattcaactacatgcccttacccaataaaaagggtgggtgaggaagagaaaagcaatttaaaaggcgaggcttagccaggggtgagcatcaagtgcgaaacgctaattcgatgttcgtttggttgccattcctatgagcagctcactgtagcgtttgtgattatagtatttatatactgaacaagtactttttatatgaattgtgtaactgcacatattgtgcatttctatataaatgtgatagggtcgattgtttacataaaacaagtttgagttttgggcagttctcatcaaaggtaatttatataaagagtgagttttcatttgacttcagagtctaattcccaggtaattgggactccagtctagtttagaagtctgtgctgtgctgtttggccctgcaaggttcagggacttttagtcacatatttcaaactagtttaggaagatgagggcagtgccacaaaaagtagattaaagagtagtttagatagggagacttgcaatgagggccaggactcttacagcaagaatgtaaaggaagcaatgaaaagcattcatatttaagactcagtctgtttctttgcccttagaaaatttattaatttgttaaggaccaatactgaagtttgggaataggagtagtgtcctcagtgttgtagttctccggaatttaggatttgtatataaatgtgaattttctttggttaatgtgttatattttcattggttctacaaaattcatttagctccgttggtaaaagtaacttagtaataatgctggaattgtaaggaaaattatggtttactataaatgtctttttgaagttatattgtaggtaatcattaagacctaattattagatgatactaatctttaaagtgaccagttttcttacaatttagtttcttgagttcttcaagggaatttaattgttgagcaccattatctatagacacatatactcttacatattgtgctatattatgtagattcagccataaatagtgcttaatcttattaatataaatgtatgcgattcctgtaaaattaatgacacaattattaaactgctatagatgggcatgtatatgtttataaataccatgctatattatgtaggtccatctatatagtgttatgaaaatttcatacatccaaaaaagttaaagatgcatcgccagatgcttcctttggccaaaataaaattaaaaaaatattccctgtagatgtttgtctttgagcacggtcttccctgtgaaccctcaagacaccacactttctcatcaatctatgtgcccttttttgcacacgtttattcttaatcctgtttttgttttctcttctacctttaagtcctgaatttgcttctttctgatattgtgctttttcccttttggaaatttcctcttctttcttccaccatcaaattgcatcctctgaaccaagagtggagttaaaccatatgaagccttcctagccatgtgtcaactgtttttgccctttgttgtcaactgtgcctataaagaactgattagtaattttattgattagtttggacattgccttctcataaagagaaattaccagcttctgagtctggccacttttaccattagttcatttttttccatctctggcaaggaacaaattttgttaattattgcatttgtactacaaatgtctgacaaagaaacttatgatatgcaggaccctgaaaatttattggcatttttttaaatgtctgaactgtccactgtaaattagcacctccaaaactgtggggtggctctgctgtatgttctctcactgtcaccaccaccacttactccccaccagcccaaataacattacctatatatgccttggagatggctaggcagcctgtttggtcctatccacagaggtggaagaacccatcagtggaaacttgtaatgaaaacctggtgccttttttagttttagttagtatcaactgactttgatcaaccagaagggaaataattccttactctccactccaaatatcagataaaaaattgtacctttcccatcatagttaatatggaagtattttagtatctgatactttaaaagtctgattctgccagagtttatcttatagttgaatacacaatacccacactaccttgtcagaatagtatgtccaaggcggcatctgtcttttgcttagaaaccttcatttgctgatatttcagagtggtatgggagtggtagtttttaaagtcattgcagtattctcctgattgaaatgttttttaaaatgtcttgctaattgctgttctcatttttaaattatttttcctcagaaacccacaatctgccaaagcaacctccacttgccctagcaatgggacaggccacacaatgtctaggactgatggctcgatcaggaattggatcctgcgcatttgccacagtggaagactacctacattagctatgcatttcaagagctcacacttatattgtggcatatagtcaacatggaagtagaccagctctgctgatttgaaatttagattttttaaattatgtactggggacaggtttttgtcgctttacattgcttcctagtttacagcatgatgcaaatgattttctaacttagtgttaggagaaattattttccatctttaacctcttagttgtctaagagttaaatattactgaatttcagacgttcaaattgatcatcacaaatcctttaaaacaattacctaaaagaaaccaaaaatcctgccttctttgtgggggaggggggagagaggggaaggaaatggaacaagttgtgtttgtgttagcatgtgggtgatgtaaacttcaaattgggagatgttccgacccccactcccatataagcattcaatcagtgtaacttgcaaaatgcataaacatccgacagtttgaatttatagtgttgatggaagaaatcatttttaatgtgtactgtaaaacttgaaatactcaggagctgagtgaatatgtttgttgctacttacaatcccgacctgttagtcccagtagttttgttttaacatggtctttttcaactttgtttcctgtttaactacagatgacttctgttgtagactcacaagtttaactgttgtattataacagtattacatgtcaacggtgtggttatgacctttatttatataaaaaccaaatatttagtcaatttaccgtgtcttaatttaatctttgtacaccttccatttttaagtgcttaaatgagtactatattgcaataaaatgtagtgatataattaaccagccattaaaaatttacttctacag

SEQ ID NO: 36204 - DNA, 11273 bp, Homo sapiens
gcacgcactggccccggcgcccacccgcacccctccccaggtcagtgcgtgcccgcgcgtgtctgggggggcgcctctgcggggaggggcagcggcaccgggggagggcgggggcgtgctggtgcggggctccctgggggctgtgcggctgtgtatccgtggttgtgatccgtgtgtgtttgcgtggctgtgttccccgggcgctggggatctgtgcctcgctgcctgtgcctttgtggatccgtgcgtgtgtgtgcgtgtgtgtttgtgtgtgttgcagccccttccagcctccgagatagtcacccctttgttctggctggcactcccggggctccaggtcactgcccttggcatgtcccagcttgggcccagagagggagagctgtggcctggctccctgccccagaggacctggacaggggcagcctctgtgctccgtagggctatcgtgtcactccacttctagtgctgggtgcattggagaacaccccctggatgctcagagcttgccctagcctcctgaccagggccagcgcttggggccttcccacagcactgctcagtggccgcctggtactcctcagcagcagcaggacaggcccagagaggggacaccaactgcccaaggtcacacagctgagtgatggagctgggattcgaaccctagtcagttgccacccactgggaaccgactacgttgggtcagaagctgggagacctgggcttgccttggccttgtcttgtgattggggttaagtcaccgtccctctgggcttcggccccacaggccccttagcagaccatccagtcatattaggagtcgctggggccttgacccaggggccttataaggcctgggtgcttagcccgtaacccaactccatcctagacccctgtcctctgtgaggcctcctcacgacccaagttattttggatcaaggaagtggcaggtgccatcagggcggagggggcttagattaccaggaggggggcggggcagggcggggtcgaggccacttctcagggcttcactgtggttgtccctggcccaggacgctccccctcccatgggcagctgctgaggggcacttggcagctcctacccccgctgaagcacactcagcaggaaaagtggctgccactcctgcctggggcagcaggggcatcagcaaagccacttcagctgctactgggtgccaggcccagcgtagcagaaactcagggccgagttggaccctagctggccctcgaaccagtctgtcctcctccccatgcctcagtttcctcccaagatggcagtgaggatggaacgaggctccccagccctgtgctcagcccatgccaggcccagtcaatgggatcccaggcccgcagcacagaagaggggcccagtacagcgtggttgtgcagtgcagggcaggtttccaggaggcacctgccagtgtgggagtggagggcagagtccaggaaggcttcctgaaggaggtggcacctgagctgagtcccacacaatagcaaggtggggaaaggcatccaggcattgggtacaacatctgccagtggcagctgatagggttgcagagggcagcagaggtcagctcaccgggacctatccactatgtcaaggggcccaggctttgtctgggagccgagagggccacacatgcaaggttgtaagcgggtgtgtgatgtggtctgatacttgccagagaaaatcctgcaaattgcgtggcagggtgtggaggcttcaaggcccatgtggaggcgggggcagtggcccaggccccttacttagcacaggacatagtggtgaggagacagacggagagagcctggggaggggagggttgggcagtgggtgtgcagggctgtggagaggagagaggagccttcacactgactcagcctgtggcttggccataggggcctggagctgggacttggggagggctgttcagagcctgagaagcctgtggggcttctggggcctgtctcgggggcatggatgtctggggctggagagaaaggcctgggctgcctgcacagggatgggggtccttggagcctgaagccaagtagagagggtggtgtgggtgccttgggtggaggtcccggtgcgggtggggtcgctggctggaggtcaaggctggaggggagtgtggctgtggtggttgcgagtggccttggggagggctggtggctgggagtgaagaagtggaggccaaaggtgtccagagggcagttctgagataggggggcgaggtaggggaggtcctgggggctgtggcagcacagggtggggtcgcaggtgtgattgggctcatgggcaggctgagggcaaggtgggggcagtaaagccaggtcctcaaagggtgggggtgcaggggacatgcgtggggctggttgttgggcctgtagaggtgaagagcctgggaccgcctcactttgacaactgtaaagggctgtgttcatgcgagcggctcctgtagattccttcaccccaggcctctgtcccttagaggatccccatccaaacctcatcccagacacacatagttcctggccacctcccacctcctggcagcttccctctggccctggggagcgttgtcaaggtgtctgggcagacgctggccctgcgccctgttttctgggagtttcgaggggagcagctctgcagttgtgtggccgctgtttatgtccctcggtgccatcctcactgtcccagcccctccagcgggaacccaggtggatgggagggggctactgcccttctgtgacaggtgaggccatggaggccagagaggaaaggtgacttttccaaggtcactttcccaaggtggctttctcagggaaggggtcctgggccttccctgcccccagcagccccctctgccctcagactgcatgtcgggcctggcacacaccagttgccttgggtgtggcttagtggaaggtgagtcagggtgaggaggaaaatccctccccaacctgtgcccttgtcttacagagcactgacacggctcccgggacctcggcaggatggaaggtatgagcctcctctccttttgcccattgcctgggcctcagtgtgcctgactattaagggggtgcgctctcagggagacattctgggaggggttggaggaggctctggggctgccggagggggcctggctgggagcctccagtatcctcctctggcctctcacgggatgtgccagctccaagattaattttagacgtgacgaggcctccccaaggctcctgagggccccagcgcacaccccctatgctgggtttatagagctgagaccctgccccatggagaggccacagatacacaaaacaccaggtctaatgaggacaaggcaattccccgtacctctccgggactcagtttccctatcatccagtgagggtgggccttgaggaagtcttggaccctcctagttcctatgggctgggacttagagggagacacgggcaggcagagagtccagaacgggcccgccctcagctgctggcagcaccatccgtccagttcctggcactgtgccttggcctgggcagctcttaaagacacccagcgggcctgctgctgctgctgctgctgctctgcctgagctccaaatatcaacagccatagggctgcggccactgcacccccgggataggggcccacaggaggagcccttcttgacagctcctgtagggctccagccttatggctgggagggcccctgggagccgcccagcccacctcctccctggggaaggggcagagaaccagagaggggcaggcctttcctaagtcacacagcaaggtgggatacagcctggtcctctatttccctgggaagcgggggagcctgaaagcccagtggggagcttgggttctggttttggttctgacatcccttgagcaggccttccctctctcgagctcagtttccctctgcccagtggggctgtggccttgctgggatctaacagcaggcgggacgagacagaggttggagccaagctcaccgccctctctgggcaagagttccacatgcccaccacagccctccaccccggcaactgtctccatggcaacatatgttgtggttgctaagcccccactgccgggggaggcgggtgatgggccggcccagggcctgagaggggaagggcagggtgcacaggagacacggcaggacgggaccatgggctgctgctcctcgagtgacccccgcagagaagacgatctgagagccagaggtgaccggccccggggtccaggcacccacagggaggcgccatgagggctggcggcccagcccgctggctgtgtggagagtacttagcctttaggcttttgcctctgcccgtctggctgcctggagcaccctctcttccctgacctctcccaggctccgagctcactcacatccctgctgactctgggctgtgacttgtctgcctccctgacaggagcgccagcggtgtctgtccctccgcctggggcccagcacaggcctgggactccagaggtgcctctggctgtgggtccagcgagtgactgagccctgctccccttttctctcccgcagagaagctgaagaaaaccaagatcatctttgtggtgggtgagttgcgggcaggcgggtggtgcagcaagggtcttcactggcactggagggagcccgggcctggggctgcaccctgggctctgcccctccctctctgggagaccctggcagcccctgttcctcctgggaccctgtgtctcggggtttatgaatgggtgggcgtttgcaggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggtgagtgggccctggtggggtgagaggcaggggatgacagtagccctgagtgggtgtcccaccagcagcaaagcccacggcacacaggcaaagctgaccgtaaccgcccccggctccaaacccttctgtggttccccattgccctggacagaaagttccttccagaagctcccaagaccttgcaggactctgccctgcccccaactctctcccttccctccatccttcagccaccctggcctctgtcccctcagactagccatactccttccagcctggaatattctttcctcttcagctttcagacttccctaactccccagatttggcctaagacctccccccccaattttctactccagaagccccacttctctgcccgtacaacctgtgccatgcttagaaatggagaaatcatctgtggaatgtgtctgtcccctcaccagcccctgagctccccagggcagggaaggcctaattggtccatggccgtgtcctcgggacccaggacagcacctggctggaaggagggtctcagtgaatactgttgagtgaatgcatcattcattcattcattcactcagtccaggtctccacaattccgaggaagcttcctggagggggaggcttgtttgggacatttgtgttggggagagggcatttcaggtggcaggagcagcgtgagcagaggctgggagaagggatggggaggagaggctcatggccccttcctcctttgctgtgccccaggagacagtgttggacatgctccgggatgccatggtggccaaagtcaatacttccaaaggcttcctgattgatggctacccgcgggaggtgcagcaaggagaagagtttgagcgacgggtaaggcactgacccaagtggggatcctggtgggctggggcaggataagactcccatccccatgggcgggcctgcgggggctgtgatgcaggtcagagttctgagcagaggctgattcatggagtgtgggtgaggaggaaaaccaggaagactttctggaagtgtagaagaaaatgtgtagaaggggaagcgccaggaggggcagttgccaaacctgggctcagattccagctcaacggcttgagatcttgggccagtcattctgcctcctgaacctcagttttcccatctgcaaaatgcagggagtgggaggaccaggtcacagctgccttaagggacagtgtggggactggagaggatgtgcccttccagtgtgggccttggctccctataaacacacagaggggcagggaacagcactggcagggctggaaaggcaaggccagtgtggggagaacagaatatgtgggcaggacaacaagggaggttccagcctggctggaggctgcaaatgccataaagggacatcagtctccttccaggggtcatgaggagcctggctggaaagagcaggcctggaaaatgatggccctgagcttcctagcacgagcatcctgcagatacaccttccccaggatggggcaccccacacacgcacacacgtggacgcttgcacatacacatgcacaagccccacaagttcatacacacaaggccaggggcatgtgcacacatgcacacacacggcagtggatactgcactcctgcacatgcatgtcacggacgcagcacacatatgcaggaatgcacacgtgctcgcacacatggccctgtgcacacacatacacttttacctcggtgtcacaaggctgtatgggagaaataaacgggactgcaagggcctaggagggagaggtcggcaagggctagggggagcctaaccagcatcctggtgggctggggcaggataagactcccatccccatgccccattcccatgccccattcccatgccccgtctccgtagggccttctgggcttccgtagcttccagcctcatctggggataggaggccatattttctgacctctgagtggctgcatgagtggctgcaagacctcaggaaagtgtctaccccactctgcccctcaccttccctatctgaaatgggggttagctggattccttcagacctcagacccctgaccctgtgttaggtgccacagttctgaaagatgtcctggcctggctcacacataccagctgtgtggtaccacctgtgaccctcagggccacatctagaaaatagagttaatgaaagtcggccgggtgcagtggctcacgcctgagatcctagcactttgggaggccaaagagggcagatcacttgaggtcagggtcaaaaccagcctggccaacatggtgaaaactcatgtactaaaaatacaaaaattagccaggcatggtggcgggcgcctgtaatcccagctactcaggaggctgagacacgagaatcatttgaacctggctggacggaggttgcagtgagccaagatcacgccattgcactcaagcctgaacaacagaatgagactccgtctcaaaaaaaaaaaaaaaaaaagtccccacccttccagggctgttgtaggtgccgctgagggccgcaggctcagccctggtcccatccctgctgtggcctccaggtgtccgggcagctggtcttcttggctctggacaccagggggcgccagggcttcaccgaaggagggagggtcagcctggaagtgtggccggctcacacccaaagcttttctggagactggcagtgcccgttgtggactccccgggctagatgtccattgtcctgacagggagactgaggccccacagccagaatctcaagcccagaggctgagctggctctcccagatttaccacctctgctgggtgtgtgtaaagagcctactgtgcttggtcctggagacccagatgaaccagagactgtgagtctgtgccctggaggagctcagcagctgatggatgatgatggggggtgggtgaccttgaagttgaggtcagactgctgcatccaggcccagcctttgcccccatggtaatctgtaaggtagaagcagccgctgggtggtacggagtcatctccctgaaggcagctgacgctgtcaccctgaatccttaactacggaggagctagggatgagcgctaggatgggtatcgcaggcgaggacaaagggcttgccccaggtcacacagctgaacagaggcaggggtgagcctgggtccaggtcagtctgacgccggaggtcaggctgcttctcgcctctgtccagctgtgtggccttggacaagcctcttggttacacagctggacagaggcacgaaacagcctgacctgagaggcagtgccccaaggccttgacaggggtccagggccaaagctgcgcagaaacccttgggggctggcccaggcagttggaagcaggagacagggtttgaaggtcccaatcccattcctaaagctgtggcagtcatgggtgactctggggtggctctgccctcccaaccaggcagctgtggtagctggattgagcgaggcaggggctgcagaaccttattcctcttgcctttccaaggcgtcccatggatgacatggatgacatgctgttccaatgacacggacattgctcagaaccccccaggactcagcagcccctcaccccttccctcatcccttgttcctttgtcaaaggaccccagaattgtgagacaagtgcctccctgccctcaggggcccttgggagacctgcttaaggaaagataaaggcgctggaagagcctgttccaggaggcggggagtactggggggcggggggtggcatcagagagactgccctgaggaagtgagcttcgcactgaaacctgatgcttggtattgaggtgaaggcgagttaggatcaggctcgggggagagggctcctagcagagggaacagcatgagcacaggtctggcatggaaggaggttgatgagagcctagagcagagagagtcaggctctctcagtctggcaagtagtgtggactttctcctgagggcactggggagccatggtgtaggtttgagcaggggagtggcaggaaagattggttttaggaaggtctttcaggctgccttggggaagggattgaaggtctgagggggtatctactggggcttcatagatgggaagatggggaggagatggccctagggggcaggaatggggtccctgtgacatggtgcccgcctgcagattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacctgtcatcgccttctatgagaaacgtggcattgtgcgcaaggtgggccccgcgggcccaggggcagctccgggaagaacgggttcctatgtggctccgcctcagctcactgtgtggcctcaggccagcccctctctctgggccttggtttccccactggttcaatgaggggctgctgtcaattaggttgggctcggggaggcaggcctggtctctggggcctgccatggtgaggcccaccccactccacctggtgactcagccctcacggcccatctccccacaggtcaacgctgagggctccgtggacagtgtcttctcccaggtctgcacccacctggacgccctaaagtagcaacgctggagccgcttccccagctcagagccccgccccaccccgtcctgattcgaggtcctcctggcctgagcgcagcgcctccaccctgccctgctgagcacagacggaggaagccgcttatcctgttttcatggacagctgagcactaaaggaatttctaaggacatttggttttactgctttttctctgcttccagttggagttgattcatgtgcttgtgcctacctggccgcaagtccccagcccctcaaccctccgttcctcctcagcctccctttgccagccacccctcctctagctctggtgggaggcccggggcccttcctcgcacagggcatgcctggcctgaggacccggcgctgagtggcggggcccctgctccgaggggctcatgttcaggcagaaccggtcccagcctgggctcctctgcatcttgctctgtggccttggccctgacccccatcgctctgagcatatgttccatgcctggcccttgccggggcctggactgcacaggcagcaaggtcatggtctgagtggggcttcctgggcagttggggcggcccacgccagctggcccagtgggtagtgaattggcttccttgacgcgagaggctctgagggtctgaaaagggcatctcaatggcatgggtgggtggggagtcagtcatgtcactgaaattgaatgggggaggcccaatgaggtggctcatgcctgtaatcccagcactttgggaagctgaggcaggaggatcccctgaggtcaggagttcgagagcagcctggccaacatggcaaaaccccttatttactaaaaatacaaaaattagccgggcatggtggcatgtgcctgtattcccagctactcatgaggctgaggcaggagaatggcgtgaacccgggaggtggagcttgcaatgagccaagattgcgccactgcactccagcctgggtgacagagcaagactccgtctcaaaaaaaaaaaaaaaaaaaaagaaattgaattgggggagtcatggtcaggggtgagacctgaaggacctccccctgtgtggccctggacacagcccaccctctgtgagccgtttccaattctaaaacagactcaatgtccccctcacccccacctcaaggtcaggatgagaacacactgagtgaggagtggacgctgtccattgccacggccatgagggctggagaccagaacagcatggcccgaagcgtgcggggccccggatgacttggggacaccccagaatcccctggggagaacccttcctgcgcgctttcattttttgacctcatcactgagaaaggctcaatttggtgctcacgtgtccttaacacctgatctggcccaagctgggctccctttaagccaagagagcctcttgtggaccccgcctgcccgaatgaaatccgaacagttggggctgttcatggcaagtggggctggtttttcatttccattggttatttaaagtttcctttaaaataaacgattttaagttataaaaggtgaatctattgaaagaagaacatgaaagaaataaacaggagttcagcggagctagcagaagacaaggcatgtagggggagccattctgtcccag

SEQ ID NO: 36205 - DNA, 12083 bp, Homo sapiens
ccctgcgtggctgggctgctcgggttagatcgtcaggtgagggaggaagggatagccagcgcgaaggaagtgctggagtcgtgtgttttggctgcgcgtgatcctgcgtgggtcgggaggtgtttctgtgtaggtgtctggccctttcatcagtcgtgcggaggaccgcgtgatttccttccagttctcctcggttttcaggtggtggcgccatcttcggtaaagggtgtccacctctccctatggtgtggctggctagcccgggggtctctacgctgcttggtctttgttaacggagatgaaggcagtaatttttcagtaacaggtttcagatataagtcccttggtgatgctaatatttatggaggccttactatgcattaagaacttttttagaagtttagaaaatggcagtgaataaagcagatacaaatctctgctctaagggagcttgcatagtaatgaaatttgagaagacagtggattggaagtgggattaactcagaatcaaaattttgtcgatgggttggaggaagaggaagttatttgggaccaaaaagacatacaggtgtgagtttatttgggagggaggaaggaatcctcatcagatgtgcaggaatgttggtacgttgtggtcacaaaattggagtgcataaaaattatgaatatagttaggaatttaggactggtgagttgtacttttgccataagaggtaatgtttttttcttattttgtttttttccttcaggaaaagcctaaagattagactgtaagaaaagaaaatagaagccatgtttcgaagacctgtattacaggtagtcacttgtctgtattaatactgagatgtattactatcagccacagtgatcagaagacttctttaggcttttaactacaggggcaaaagacctttgagctcacccacccacctctatactcatttgatatggaggattggggacgattttgccagtgtaaattatgttcactaaaacaaaaaaaaagttcaggtttattcacacgtaataggaatcattaatttttaaaatgtgtgtgtgttgcttgaatttaaccagtgagaggacattaaaggtctttagtgacctaaagactgtaggaatcattgttccaacttttttcttaaggcatgtagttgcttttttgaccatctacctcctgtgttgctaaacgttcctcttcccccatctttccacactgaagagagcatctcaagtctcagtggtcaccagagatttcactatgtagaaaatgccttctcattccacttagtatgggtcctcacttttccagacactagcccaccttgagccagcttagactaccatttttcctcacttaccacattcgggcaccagctcctgtagattcttctttggctctcctactccccatcctcctgtgaagaccaatgaagaaccagttcctccatgactctgtcattttccccaccttaatcctatattcttggatccccactttaacctgtatgtatctttaatctatttttttctgtattgaaatgtgaaacatgaaaaagttattgcttcttaacactaacgttacagtattaaaatgtctttaaataagagttaaaagtttaatttaaaaaattatccaagttaaataatcctttcctaatcttctccagtagatttttgtgtgccccaaatgagacattgttattataaatctctgtgtaagatttatgaggtctagcttgtctgagcactcaaatgacatttccagaatcatgacacaggttctcattagcagtttgattctatagtatgttgtactcatatctttattttcttatctgccctctgctcctaagtttagtgataggattagatagccaacagcaccctggggattggtgtttatttgattggtggacttctgctttttatattaacagtactgccacttcaaaaatgtttctctgatagaatggctagctctctgagctctgaattcagtgatgtgtactcccatctttacaggagctcttgaaattaaggaggcagcagagggcttcgggaaagcagtagcattggtgtcaagggccctgggtccttgagatcacttgccacatacttcctgcaggagcttgggcaggtgatgcagtctctctgaggtgttttctcagccctaaatgggaataattttacataacttgtagatttagttttagaattgataatagataaatcccttagctgatattcagtaatgattgctgctattatgtggtagtgactacctttgctgacagtgatgtgactttgacttggacagtcgagtctttgtgtttaatcaaagaaccaaatttattagaccttttttgatgcactaaaaacaggaaatttcctatgaaatatttataaaaactgtattaggctaagctcactactgaagctgtttaatttttgcaatagccttgtgaagtaggtattatgtatcataatttttgcttattttaaaatgaaacactttagattagtcatattaggtatcctaattccttttaaggtctgaaggagcaaccaggggaaggcagtttcatagacacagggaatctgactttggaatatgttcctgttgctgtgtcagaaagtcattcatgtgattagttttagaatgtattgttttgttggaatgtaacctatctctcgttctctaaaccagcagaccccaacctttttggcactgataactggtttcatggaagacaatttttccatggaggaggggggtgccgtggggatggtttcaagatgaaactgttccacctcagatcatcaggcattagttagattctcataaggagtgcacaccctagatccctcgcatgagcggtttataatggggttctgctcctgtgagaatctaatgccactgctgatctgacaggaggcggatcttggtcagtaatgcttgctcgctgcttgctgctcacctcctgctgtgcagccaggttcctaacaggccacagaactctactagtcctcagccctggaggttggggactctcctctaactggctgttcgttatgcctgagagtaaggctttgcatttattccacacctcctgacacttgtttgatcattgcatatgttattaatgaatctacttattaaattattaattataaagcatctcttttaactctcctttggtctaatgatggattaaatcagtacccatgttggatctaaatttcttaatttctaaagtctactgtaaccaaaatacagtagtaatataccagttgtttatactaaaaaaaaaaattagaggatgtatatattgaatatatgtagtactttttgtctctttttgtctttccagctaatgaaagctggattttgaaaatacttggcagcaactcttaggtacaggttggatttacaaatattatcatactctgtaatgttaaagtgatactattttgatttttccttttgtgtgcaaacacagaagtgccataatcaaggagatgtcgcaaaataaatgggagtactataacttaactttgagcatgccttctagtaccttccttctacctttgggcttctgcattaggctgctcttgaagtgtttgccggggccttctggcactctgttgggagaacatgagaagagcttctcttctcttctggaattttcaggaactactgactatatggtgaatgaacgtgagtaattcttctgtttgcatttgcctttcctaaaaaattaaagccatgttattcatttgttcttctttaggtacttcgtcagtttgtaagacatgagtccgaaacaactaccagtttggttcttgaaagatgtaagtagctaatttccaagtttaaaatgttatttttagtaatttgccaatctcaaatgtgttgtagaagaggtatgctgcttgggttaaccatgttgccattgtgcttttagctcatgtttgctcttcagatcttagccttgacacatcaggctgtggagacatagtataaactgagcccctgttctccttatcagccagttactactcattcttgtcaacactgtcctgcataagaatttccttgagtcatatttggttatctgagtcttcccgggttatgttgtattaggctgagattgtaaaagatattgtttcttcacagaaatattcccttgtgtttataaagattttcagatctcagatttgttcttttagctccacagtcagttaaaaaagatatcttaaagaatttaagatctagagcttacagtttgttttgtggggctgctttctctatgactattttcttctttcttgccaactctcttctctcgcaacctctccttattcattccttaacttattttctgatcttccagaacttgggttttacttaatgcagagattgaagttgaagtcatatttatagcatttcttctggacatttctctcagtcttgagtgtggatttctttttttttgagactgagtcttgctctgtcgcccaggctggagtgcagtggcgcggtctccgctcactgcaaactctgcctcccgggttcatgccattctcctgcctcagccttccaagtagctgggactacaggcgcccgccaccacgcccagctaattttttgtattttagtagagatggggtttcaccgtgttagccagcatggtctctctctcctgaccttgtgatccgcccgccttggcctcccaaagtgctgggattacaggcgtgagccaccgcgcccagccaggtgtggatttctttaatggtcagcttagaggctgctataaaaaaataccatagaccaggtggcttcaccaacagcatttatttctcacagttctagaggctaaaaatccaagattcgtgtgccagtatgattgagctcttggcgagggctgtcttcctggcttgcagatggttgccttctcaccgtgtcttcatatggtagagacagaaagttctgaactcttcctgttcctatagggacacctcaccctcatgacgtcatctaagcctaattaccttttaaggatcccacttccaaataccattacattgagggttagagcttcaacatacaaattttgggggaaggggcacaactattcagtctatagcaggttgtctcatttggtcttgatgttgtgtttcagccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgagtacaaaagactggggttttaattttatcagcaataaatagatattatttattgccagttatctaatttagagataaaccactttaaacaagatctgtctttcattctgtttgttctcttagaaatcgtgacattggttttcctgggcatgttgtctgttggcatttgtaaccaatttcctatttttatgatttaggtgatgtcagtcaaaagacaacatggcacagaatatcagtattccggccaggcctcagagacgtggcatatcaatatgtgaaaaaggggtaagttgaagagggaaggatcttatgaattgaatgatttaaagaaccgataagaagtgttctcatggcaaggagtgtgtagtctcttaaatccctgagtactactaatgactgtattaatttaagaggtatttactaagtccttgatactatatgcatggcatgttgccatgtgtgactaatttgaagatatataaaacatagttttagctttctaagaacttacagtttagggcaaacagggtgtgtacataaatagaaatagatgaggcaggagagaaggcaaagtgtatcaagtggcatttgagcaagtcaaacatctgctttgaggaattcctgtgcctctgtggccggggatgctgagggtggcttcttgcctgttggctgccacatggtatttccagcagaggatctggaatgtctgaagcctgacatgccaacttcatcttcgtggcagttattttatatttgatgattttctgtaggcttaatagttcccttttggaaggcttggattgagtatgtataaaaagtatgttttccaaactcatagaaggacaaaacggtgtgtgtaacagcagttgtattgatagttaatatgtttagaaatgtacttgttttgtagaaagaaaacatattttatgaaaaataatttagcaatcactaaaatttttcttttcaataactgtatagcttttcttcctatgtatcttcattgccctttatgtatgtttatgaatatgtgcacatacacacacaaacacatataaggtatttcaagggaagtgtctgcactcccacttactgattgatgggtgtgtgtgtggggtggggagcacctgatgtttcactaatctttctgtgttgtacttttttggtggtggtagactctcaaaactggtactattgtcatctttccactcttgaaaatcacgattaggtttgttatctagtttagcctctagatagtgtagaaatagtcttagtaattacctctaagtggtatactaagctgatacagtgtagaaatagtcttagtaattaactcagggtaatattatactaaactaactacaaatccatattttgaattttaatcatctaagtttctaaggtcatagaaaataattgataaataagtgaaaatcaagtctgttagggactccaaaatcaaaggtcaaggaaaatgatacattggaaattattcctagagatttaaatgttgccactaaatttccctttgaactgttttgttttattttttaacttccgtaagagaaatagctgacagatgaaaacattgtctgttttacctagatgttaccaagtctgtttggacactctgtttcagtactcctaatcctgaaccttgagaagtggtagcaaaaattagcttatatatgattatatatttcatccttgtcatatactcagtaccaccctgacctgactcttataaagcatattaagatctcaactaaaaactgtacattttatttatatcaggtctcgaatttatttggaagggaaaatagactatggtgaatacatggataaaaataatgtgaggcgacaagcaacaacaatcatagctggtaagaagcttgtgaaaatagctgtttttttctttttctccttttcttttttaaaagcttggctacactgtaactaactagggttaagagtaccagtacttatgagttaaggcaactcactagaagatgtccataactcttatttctctacttgctaagagtttgtacatttatcccttcctttaaaaaattatttttatacttacagttttagtcacaagtaacttttgaataaagcctaaaactgaattatccatcccagtacttattgttgagaattacaaaaactctgaatgtattgtcttttggaaggatctagccctaaccaggaagaagcgtatgccaagataagaattacactaatgtgagtgtgcagatttattcggaacctctttggtacttagtatgtgaaatttctatttgaaattaagatttttttaattttattttttttgagccagaatctcactctgtcacccaggctggagtgcaatggcacaatctcggctcattgcaacctctgtctcctggattcaagtgattctcctgcctcagcctcctgagtagctaggattataggtgcgtgccacaccacctggctaatttttgtaattttcgtagaggcggggtttcaccatgttggtcaggctggtcttgaactcctgacctcaggtgatccatccacctcggcctcccaaagttgtgagattacaggcatgagccactgtgcccagccaagaagtttttaattttctctttttttgtttttgttttgagacagggtctccctctgtcaaccaggctggagtgcaatggtgtgatcacagcttactgcagcctctacctccccaggctcaggtgatcttcccacctcagccttctcccaagtagctgggacaacaggtgtacaccatcatgcctggctaatttgtcaatttttttgtagagatgaggtttcaccatgttgcccaggctggtctcaaactgctgggctcaaatgatcctcccaccttagcctccccaaatactggaattacaggcatgagccattatgcccggcctaatattctctttaaacaaaatacagtacaacatagaaaagatgtacacgtaaaggttaaagaagattaagaagatatcccttaggaaagagtttttaaacttttgaaaatgctataagaattttgaaaataatatacccctctggatgtctgcaagcgacattaagaaatttttttcaatacaaaattgtgttatttttaaatgtatcaatggaatctaaatagcatagcaatgtgatacctactatcctgtaaaaaaataccagttcagcatttggaaattttccattattcttttttctttgaacttgttttactgtttttattttcccctcagaagtgtatcttaatagtatatggtatagttaagaactttttattaccctgtttgtaacaaaaatgcatgcataaaagaaactttaaaatatttaaaagaattctatgacaaattcttctcaattgacttatcattaaagttgtttttagtacctaattgatcaaaacaattttaatgtatttaaattatattggaaatatgtctttaaatgagatagatggtgcttttttcacttcttgagtaaattgctaaaattagacattgtgaattttgtgcttttgtttgcttttatggacataaatactaagaaagctttttaaaataaatacatggcaataaactaaattttactatattaatgtttctgtgtttatgaacttctgagatatgcccaaattagattttttttttttttttttttttttgagacagcgtctcactctgttgccccggctagagtacagtgacacgatcctggctcactgcaaccttcgcctcccgggttcaagcgattctcctgcctcagcctcctgagtagctgggactacaggcacgcgccaccacgcccagctaatttttgtatttgtagtagagatggggtttcaccatattggccaggctggtctcgaactcctgacctcgtgatctgcccacttcagcctcccaaagtgctgggattacaggcgtgagccaccgtgcccggctagataatattttttaaaaattgatttttgggctggatgcagtggctcacgcctgtaatcccaggcctttgggaggctgaggtgggtggatcatttgaagtcaagagttcaagaccagcctgggaacatggtgaaaccctgtctctacacaaaatgcaaaaagtagccgggtctagtaatgcgtgtctgtagtcccagctactcaggaggctgagtcatgagaattgcttgaacccaggaggcagtgtttgtagcgaattgagatcacaccactgcactccagcctgggcaatagaggaagactctctcaaaaaaaaaaaaaaaaaaaaaatttttttttttttactatggaaaatgtcaaacatgtataagagcagaaaaaatggtaaaatgaactcctaccatttcgcttcagtgtcagctgatggacagtgttatatccatgcctccagcgacttgacctacacctggattattttgaaacagattctagacataagtttattcataaatttccatagggatctctaaaagataaggtgtctttttgaaaatgtaactaccgtgctattatcacacctaatattaataaattactgttaatttttttactaaatatcgtagtgttcaaatttccttgataacttcataaacattcatacattatattacatgatttctaccttaagtctcttagatttgccttttatctttcttctttcctttgctccagagttcatgtcttaaccaccataccttattaataatttataatttgtatagaatgctcacatggtttcttactgctaagtttctttgaaagtgtattaaccttgaaaagcagtgtaggtattttcctaccctcctgtgggtcccaatataaaccacaagtgtgggcaaactttagattgttcggattattgagttgttactaataagccaaacggaagcatttcagatgatatgctgttttgttttttttccttgtcactaggttccactagcacagtcagtttactttaggtttatgtctaatggtaaaattgaagagctcttcagtgacatttgaattgaagaaaatagagtttattggttgatctgttttattggtgatttttttttctcctagggatcctatctgtaactaaaaaaccaccaccagtggatggcactcttggctttttccacagtgatattaattcgagtagtttgttctgaagtaaccgttctggaccaaaacattctagtttttggaagactatggtcatgaacaaatattcagtccttggtggataattttatagttacaagaatcttttggaattataaaggaaatgcagtcattcctccatgtcccttgtttctgcatctgtggattcaaccaagcacagattgaatatatgtgaaaaaaagaaaccaataaaaataatacaacaacaacaaaaatacaagtgaaacaatacagtgtaacagctgttaacatagcatttaccttgtattagatattgtaagtaatctaaagatgatttaaagtatataagaggaagtacataggttatatgtgattactataccattttatatcagggacttgagcattgtggattttggtatctataggggtcctggaaccagtcccccaatggatactgaaggatgactactacttgcctctgttcttttgtttatttttagctaactccctctggaacagcattttaagagcaacgtctgatatttttggataaaaatgctaactctgtgatgttgattcataaaatgttcccaagaattggtatattaaaattattctgggccaggtgcggtgctcatgcctgtaatcccagcactttgggaggccaaggcgggcagatcacttgaggtcaggagttcaagaccagcctggccaacatggtgaaaccctgtctctattaaaaatacaaaagttagccaggcatggtggtgcacacctataatcccagctactggagaggctgaggcaggagaatcgcttgaacccaggaggcagaggttgcagtaagctgagattgcaccacttcactccagcctgggtgacagagactccatctccaaaggaaaaacaaaaagttattctgtattgtaatttaaaaataaaatttcttctatttgaatttttaaagttaaaaacgtaagtaaatcctgtcattgctaacagggccacatatggactcttactctttcctctagacccccagagtgtagaatgtgatacacttttgtccttttctctgaggatgtgctgcctagtgtcgtggaatctgcctgaccattgcaagcatccaattttgtgaccagttcttttgcaggaaattgtttctgagaagactggaagacaagaaatatcccacctcttctaacaagatctgaattgttcgaaaagcagccagtgcctaacttgtagctccacttatgccaactgtatatatacctctcgtgagcatagcaagtgatttaatattttgaaaagatggctaaaatccttttaatgaacagcactaaagttatatgtattagaggagaattattgaatgagatggagaaagagttctgaaattaatatttacattttggcttttttacagataatattatatttctgagtgaccagacgaaagagaaggagtagaaaggatgattcttctttggccatcatttggtacagtctcatttccaagtcatgtataatctttatggcttccaaggacaagaattaaaatactcttttacgt

SEQ ID NO: 36206 - DNA, 20434 bp, Homo sapiens
actccctctctggatgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagccacgacgcgcccgagaacacgctggcggccattcggcaggtgagacccccacgttcgcgcccctcggtcctcccgagagctcggacttctacttttccttcccagggttccccgatcttctcaggacggccttcccacttcctcattcgtccacaaggcacactcccggcccttgatcgctcccagtgtctagggatctccggacttgaggttttatatttacagaagacagcagatatgtatatagtttctgtgcgcctgacgctaaggttacatacagccaggaacaaggtcaaaagtgtccctggtttacagagtgtacatcggaatgggggaggcaagccttaaacaagtaaacacataaatgagataactttaagagagtgaaaggtgcaatgaagaaatcgggggaactcgaaggaaagagttacgctattttatttagatggaatagtcaagagaaatcgtctccgaagaagcaacatttgaacagaaaccggaattataaggagccaggcaggtgcagaaggtcctgagatgggaataatataggggtgttcaggtaacagaagaggcagtgtgtggcctgacttcaaggaagagaacaaagactggtgtgtgaatgaagtagaaaatgggtcaggtcaaataggttcttggtcagtaattgaggttagtctaaatagatcacccttcacaagacatacgtttgcttgtcttgtaaatcacttgagtcatttccttatcaccttttccccagacacacacattcgcactcgcacaaccctggcagctggactcacatcagtttctgccccctccttttcacaaggcactcctgaaacttttgatacctcccagctcttggcattctcctagcttcataataatgacagcttacagagagggcttttcagtggattaggcacttttgcatctgtgtaaatatatctgattctcttcttttttatttttctctctcttcttccttccttcttcttcttttttttttttttactttacagagtctcactcttttacccaggctggagggcagtggtgcaatctccacgcactgcaacccctgcctcccgtgttcaagcgattctcgtgcctcagcctccggagtagctgggattacaggcgtgtgccaccacgcccagctaatttttgtatttttagtagagatggggttctgctatgttggccagactggtctcaaactcctggcctcaaagtgatccacccgcctcggcctcccaaggtactaggattacaggcatgagccatcatgcctggcctccctcatttcctttttttttctttttttttttctttttttttaaacgaagtctcactgtctcccaggctacagtgcatcggcgcaaccccagctcactgcaacctctgtatcccaggttcaagtgattctactgcctcaacctcccgagtagctgcgattacaggcatgagccaccgtgcccggccaagatttatacttttaaagctgcactctggcccatgtggagaatgtactgtgggtgtaatttcattcctttgccactgtttatagtagtgtatctgtttttggaatacactcaactcacatttatcaagtttttccttctatatctcatttataatctaccagaaattctagcactgtcagaaatgtatatatgtatgtatacattcgactttaccaataattttatttatttatttatttttgagacagggtctctctctgtcacccaggtttgagtgcagtggggcgatctcaactcactgcaacttccacctcccaggttgaagcgattcttgtgcctcaggctcccaagtagctaagattacagatgtactcctccactcccagctaatttttgttttttgtttttagtagagatggtgttttgccatgttggcaaggctggtctcaaactcctgacctcaagtgatccacctgcctcagtggattacagagtgctgggattacaggcaaagtgctgggatcacaggcatgagccactgcctggccagctttaccagtacttctatgttattccagtaattgagataaaaagatgaatccctggttctaattcacatattagtatatataggagatattgcaagttcagttccagacctgagtaaatagtcaataaagcaaatatagtaataaagggagtcacaaattttttggtttcccagtgcatataaaagttatgtttacactatattgtaatctattaagtattgtgtatgtatatatatatatatatatatatatgcacatacacacacatatataggttttcatccatggttcctggctcataactctcagcccttgctacagtattttgttaggcatcctaggccttaggagcaggccttgggaaacagaatctctcctgccctcctttcacctaccccaaggcaggactggaatctttccctgtctttcaaattgtgagtcttaagaccctcctcagagagggaccccaccctataccctgggggaaggaatgctgacatcatgaagcttccataaaaacctaagaggaattaaaaaaataaaaactaaaataaacctaagaggacttgaagccaattggtcagaagttccataggccccagcttgctatttgtgtctggaggagggtggggtgcagtcttggggaccaagccctcaacctatgatctgacactatctccaggtagatagtgtcaaaattgagttggaggatacccagctggtgtccactacttattggtggggaaaaacccccacatttttggtcacagacgtcggggttgattgttgtgagagcagagggaaaatgtgatgtgtttttccaaaatagtcgtacatctgtatcacatgggaaaaggaaaagatttaaataaagcagaaaaatctccacccataaaggacgttattgataaatttgactatattacctttaaagatgtgtttaaaaggacataataaataacaatggctaacatttattgaaatcttaactattcactagcacagtgctctgtgttgtttatgggtacttaaataaaaaccggtaagggagtgacatgagaatgatatacaccaactttaagatggtaattacctctggagaggaaaggaggagaatgaaagggagaatttcagctgtatctgtagtgttgatagtaaaactgaagcggataagagtgcaacttctactgcatcctagcttgtgcagccctgggcaagtttcctactctttctttgtctcagttttcttatctgttaaatgagaatattaatagtacctgcttcagggttgtgaggatcaaataagttaatacatttaaagcacttagaagagtgcctggcaagtagaaaaggctcaataaataatagtttttgtttttgtttttgttttagtacagaaagagactgaggaaattaggtcaaaatattcacatatgttaaatcttttttactgtagatgtttgcaatagaccatgacttaaaatattttttaaaaaattaaaaatcttgatcatagctgggcacagtggctcacacctgtaatcccagcactttgggagactgaggcaggaggattgcttgatctcaggagttcgagaccagcctggacaacatggtgaaaccccatctctacaaaaaatacaaaaattagctgggcatggtggcacgtgccagtagtcccggctacttgggagactgaggtgggaggatggcttgaacccaggaggcggaggttttagtgagccgagatcatgccactgcactctagcctgaacaacagagccagatcctgtctccaaaaaaaaaaaaaaagaaagaaatcttcatcgtaatgagcatttcacatctttattgtgatgaggaagccaaggaagcaaacattaaatagtgtgtctccagaggagcatggctcgtgtaatttaaggttcaaattctctttttagataaattctaatctacctcatcaagcttaacaacttatgggccaacagccagtgctgcttacataaacaaaatgtgatatgtcctagaagcaggcgtggtgtctttgtggtagagggtggaattaaaccaacaaaaacctgactcatttatgccaaagtagtgaaatatctgactaatcaacaaccgtagggtgatcatcagaactgctgtaccaacaaatagtgtaggtaaacagtggaattgtctaagtattcataagccattgatgacccatatagttaaacatccagagaaaacataagttcctgaagtctcctagtcttccactgtgaaagtaagaagagtgggaaaattaaagtttttaaggaatccatcagttaggaattgaagtaaggttatatacacagaaaacagaaacagatcaggattgctgtttggtgggggaagtggaaggaaaatgaatcaaaaaggacagctgtcttaggagccctgctggtcttttgggtggttagatgcaaaataatgtttgtggccatttgacagtaatattcttgatgtttttgttaaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggtaagtagtttattgtcacttaaacagatcttttagcttttattggaaatgacagacactggtgccttctaattacatctgccccaggagagttgtcttgttttgttttgaactgtacgtaggtcttgtaagtaatgagcaagtgccaggaacaacagaaatttggcattatgtttttaatctttcccactgaggctaaatttggcttcagaattattgtcaagataatactgtctagtcatagaatcatgaggctgaaagtcattgcttggcaatcttcttgccttcaggtgtaccaagaagcaaattatacattcattaaaagcttcaagtaacattataatatcacattttaacttaacccatttaattcttctgatcctcataacaaacttctgaggaatcacagaattgtaggaatagagagtatcctagaaatcatctagaatagcactttgcagtagaactttctgcaatgatggaaatattttatatctgcactgtgtaatatggtaggtacttgtggctattgagcacttgatatgtggctagtgacacgaggaagtgaatttttaatttaaatgtaaatttaaactgaaatagccatgtgtggctaccatataggatactacagatctagatcaatcttgcctttagatataatcccagaaaagttaaattatttactcaagggcaaataactagttcataaagaagccaaaactagaatctatcccaagttttagtccaaatcatgctgtttttagctgcccccaatgtctttcaaccctgtaagagcaaaagttctttcagtgtctaatttaattccttcctggtagagtgtaaacgtagcttccaaagtatatacactagagctaatcttacaagatgttctgcaaaaacagggttcaagtaagatcaaacagtgtattctgaatacttctgttgtggataaacagtccacatcagctgattcttacttgtaacttagcttttctcaaacttacatgatcacagaacctacatcctcttccccacttacagcggtaaacacccttggaattggtatgctgagtaatatactgtactttggaatgtggttatttaaatccctctctgcttgtcatctttgcagtactgaaaagggtgtgctcactggttattcatgtaatatcaattatccagacaatgatcgattctcttggaaaattaagtatttgacccaacagttaagttatactttttcctaaaagatgatccagacctgttttcctaggatctgaaaaacattagtctgccgaaggaagtcatactgtaggcaggaaagaatattggtaacacttgagaattatgagtccaagttgctagaattgttcttgagtgtcatcagatactgtattgctctgcttatgcaagggaaaggctggtttgaatattataatgacattgcagctaataaaatgtcaggttcaaagttaatacttaaagcaaaaatgtttagggtcatcattacccttaaaaatcctttaagggagcactgagtccatttctctggaatttgtgcatcctaggaaaaaaaattgtgattttcaaaaaatcccttaagaagacagcaaaggcaacatattatctcagtgtctttaacacaaccagtctttgctccactattggaacagagtgtgttctatgattgaaaactaaatgaagtaattggcttgtgtttacggattatgttgtgggaaaaaatagatattttctctagaattatgctcagtgtgatgagatgcttgtcctgagaggaggataaggaggaaactaagatcagccaaaggaataacaaattcaggtctcccatctttcactctcagggaatagaaattgattagaatggctgggataattgcctgtaatgtttaaattatccttatcttttttttttttttttttgagttggagtttcactcttgttgcccagtttggagtgcaatggcatgatcttggctcactgcaacctccacctcccgggttcaagtgattctcctgcctcagcctccagaatgctgggattacaggcacatgccaccacacccagctaatttttgcatttttagtagaaacggggtttcgccatgttggccaggctggtctcgaactcctgacctcaggtgatctgcctgcctcagcttcccaaagtgctgaatttacaggcatgagcccactgtacctggcctatccttacccttttttaaaagcatgatcttacagttgaaataatgcagttgaattagcattaagttaaataataattttattatgagagaaaagctaatttcttttgtatcaagcacttagttttcattttctttatcagaaaattatgtcttagaacattatttattttaaacagttgcacttaaataaatacacaatacagttaacagatttatgtattcctaagaattcctcctgcatagcattctattagggaaattacaatctgaaaattaagtctttgagttttccaaaggtggcatatactctgccctttgggaagtagggttattaataatgttattaattcaatagaaattcagtgatttcttaaaaattaaatgatttttgttgttgttgctggtctttggtcaagaatatctgtatttgaacacatggaggttcctgaatgatggagcactcagaaagggcatggaagctctatgcccctttccccatacctcaccctatgcatgtcttcatctgtatgctgtgtaacatactttataataaacctgtaaacgtgtttgagttccgcaagccactctaacaaattaattgaacccaaggaggaggaggtgggaaccccaatttatagctagtgtcagaagcacagaattaccagaaaaggaaaacaaatcaaaacaaaacaaaacaaaaaacagaaaaataacatccattatacaatataagaaaccaaagaccatcaatctctaatctctgtgctcaggtgtctgtgtgcttcaattcttctcatctacgagtcttgggttttcaatgctcacttgtcaccaggatatgaattaaaaatgtcttgggcaccaccatgtggtccagttgtcttaacctttctaaaagtgcttgtgcaaaccatttacttgttgcttcttacacaattacagcccaacctacttgtgtttaaaagcaaccacagcatgtttgaaagtcttatgcaataaaagggaagtttatgattacatttagtctgtacttactggatactttcagttttatcagttccaagtacagcaaactctggataatatggttaattacttcctccatgattctttcgaccttcatatcaattttgctaaatatggaatgattgactagccagagcaatcaggaaagagaaagaaataaaaggcatccaaattggaaaaagaggaagtcagattgtacctctttgctgacaacatgattttgtatgtagaaaaacctaaagacttcaccaaaaaactgttaaaactgataaacaaatttagtaaaattgcaggatataaaatcaacgtacaaaaatcagtagcatgtctatacgtaaataatgaactagctgtaaaagaaatcaagaaagtaatcccatttacatagctaccaaaaaaaaaataacaaaatacctaggaataaatataaccaaagaggtgaaagagctcttacaaggaaaactacaaaacactgatgagaaaacttaagaggacacaaatggaaagacatcccatgctcatggatcagaagaattaatattcctaaagtgaccattctactcaaaataatttacaattcagtgcaatccctatcaaaatatcaaagacattcttcagagaaatagaaaagcaacaatcctaaaattcatatggaaccgtaaagaagcccaaatagctaaagcaatactgaacaaaaaggacaaagctggacatatcacactacctcatttcaagatatactacaaagccacagtaaccaaaacagcatggtattggtataaatactgacacacacacacacacacacacacacacacacacacacacaaaacagatacatagaccagtggaatacaatagagaaccaagaaataaatccatatatttacagccaactgattttccatgaaggcaccaagaacattacagtgggggaaaggaactctcttcaataactggtactgggtaaactggatatccatatgcaggataatgaaactagacccctatctctcactatatttaaaaaatcaacacaaaatggattaaaagtttaaatttaagaccagaaactataaaactactagaagaaaacacaggggaaaagctctgggacattgatctaggcaaagattttatggctaagacctcaaaagcacaggcaacaaaaacaggcaaatgtgactatattaaactaaaaagcttctgcacagcaaaggaaataatcaacagagtaaaaagaaaacctgttgaataggagaaaatatttgcaaactattcaacagacaagtaactaatatccagaatatacaaggaacttaacagcaaaaacaataataatcccattaaaaacatctattcaaatcctaatttgaataaacatttttcaaaagaggacacacaaatggccaacaggcatatgaaaaaacaccacaaattattagggaaatgcaaatcaaaaccacaatgaagtaccatcttatctagttagaatggccattatttaaaagatttttaaaataacagatgctggcgaggatacagagcaaaaggaactcttatattctgttggtgggaatgtaaattagtacagccattatggaaaacagtatggaggtttctcaaaaaactaaaaatatagaactaccatacaatccagtaatcccactagttggtatctatccaaaagaaaggaaactagtgtatcaaaggcatacttgcacccccatgtttattgcaacactattcacaatagccaagatacagaatcaacctaagtgttcatcagtggatgaatggataaactgtggtaaatatactcaatggaatactatgtagttagccataaaaaaggatgatatcctgtcatttacagcaacatggatggaactgaaggtattatgttaaatgaaataagataagccaggcacagaaaggcaaatattacatgttgtcactcatatatgggagctaaaaaagttgatctcatggaggtagagaggagaatgatagttaccagaggctgggaagggtttggggttgggggaagaggagaataaggagaatttggttaatgagtacaaacatacagttcgatagaaggtataaattctagtgttcaataacatagtaaagtgattatagttaacaatctgttgtatatttcaaaatagctaggagatttagatgttcctaacacaaagaaatgataaatatttggggtgatggacatcctaaataccctgattttatcattatacattatgcgcatatcacaaaaatatgtctaagtgtatagcaataaaaatgtggaaaaaagaatatctataatttggttcaaattattacagtaggacaggcgcagtggctcacacctgtaatcctagcactttgggaggccaaggcaggtagatcacttgaggtcaggagttcaagaccagcctggccaccatggtgaaaccccgcctctactaaaaacacaaaaaattagccaggcgtggtgtcacacgcctgtagtcctagctacttgggaggctggggcgggagaattgcttgaacctgggagttggtagttccagtgagctgagattgcaccactgcactccaggctgggcaacagagcaagactccgtctcaaaaaaaaaaaaaaaaatcttaaagtaaagtatctttggactttgctatggtcgaaaaaaggaagttggagaaaacactctttccttttgattgagagacatatgcaaaatgtttgttgcaatacagtttatctgtttctcttttttcctacaacgtattttctcttctcttacaggaatgatttccctgatgaaaagatccctaccctaagggaagctgttgcagagtgcctaaaccataacctcacaatcttctttgatgtcaaaggccatgcacacaaggtacagtttaaattgtggacttcactttgttaaaaagacatcttatttcattgacggtcatttccgaagttacatatattttgttatttattctttttaaaacttatttttataaattgtatttgtttaatggaagtgtacaatgcaggaatctatatcatttaaggaaacagtgcattatggaactttttaaccttttatggaaactttacaaaaccagcataaaatggaagagtcaagtttctattatttacataaagcatttacaaaagatattaagtaaacagtaaaaaagacatttctagaaaaaaaccactgtagtaaccttgagttacttgaaaaaaaggaattccgaagttgtacacaagaccaattttatctagcttaaaagttaagggccttatatggacaactatggactgcatttaaagagaattcctatattaaaagcttctaatagttaacagaacatataccttttacatagatttatccctttgtataatttatatcccttatgtatagttttttattcattgattttagcagttatacttttatcagaaaatcatttattttcttcaaatgtatttgacattcctagataaaattttgcttaaattttagggcctgcacttacactcataagaacatattattacagtgaaaatcagtgggaagatatgattctgattacatttgttctcttataaccagcttttcaagtgcaagtacttttttccccatttgggcaacttgagtatttttcccctagcaatattaataatcggtaagggccatctactggttgagaattctgatgatgccaatttttttttttaattaatcccatgatatcattgaaaccagttgttaaaacccaaaatgggccgggtgcagtggctcacacctgtaatcccagcactttgggagtggatcacctgaggtcaggagttcgagaccagcctggccaacatggtgaaacccctgtctccactaaaaatacaaaaattagctggacttggtggcgggcacctgtaatcccagctactcgggaggctgaggcaggagaatcgcttgaaccggggagacagaggttgcactgagccgagattgcgccagtagtactccagcctgggtgacagagcgagactccgtctcaaaaaaaaaaaaaaaacctgaaatgtggagcctaagtatacactctaattttattaacagttaattcctatttttgaagaaggaagataatggtaactaatttattattctagtaaaccgatagttgtatacgtctaggttttccaattggtctgcgttagaatcacctgtacctattttaaaatataaattcctgggccattctccctagggaagagattctgaaaatgtctagggtgggctcaaggaacatgtatttttaatgagcacctcaggtgctcattgttgatgttgcagcccacatttgggaaccctgataggtcctacatttcacccatggtatactgacttttatgcttattctcttagattttttgagacagagtctcactctgtcacctaggctggagtgcattggcgcgatctcggctcaatgcaacctctgcctccggggttcaagcaattctcctgcctcagcctcccaagcagctgagattagaggcatgtgccatcacacccggctaatttttgtatatttagtagagatggggttttgccatgttggccaggctggtctcaaactcctggcctcgagtgatccgcccaccttggcctcccaaagtgctgggattacaggtgtgagccaccacgcctggcttctcttagaatactttttaaaaagaagtagacatttaaaaaagaaaatctagctatttgagtcttctgaatgggtgctcatgggtgttcagccaagactgggtagaacatagtgacctaattcaccaagatggtagtagaaaggcacaagtgtaggcaacaaagtggagctagtagagcacagtggccaaaatcatgggcttgggactccaacagtccttgactgagctcttactacagggtaaccttaactttgatgagcttcagtttcttcatgggtaaaatggggatactaaaagcagttaccacataaggttgttgtgagaattaaataatgtaaatgctaagagtttacagtgcatgtctttgttcaaacagaaaaaaaaatgctttctatagcttgccttcagttgcattagcgaagaggaggcatgacatggataatttgtgtccttttttattttggtgggggaatgcattttgctcatcatatttggttaggggtatgtgtaacattccaaaaattagcagtgtttcacaaattatgcagcagcagcattgcgtcccacatggctggtgactttcttgttgttagctgctattgatgtcacttcactaggggttaccaaataatacttaaattctatcatgtcttcttcatttcgtagctagactactataaaaagaaacttctgttcaccttgggaagaattgggagccccttaactcttcccagtccctcctacccttgccccattacttctccctccatattggtgatgggtaatgcgtcctctcagtcccctggactgagaaatctatcctctgtagttcccagactggctggctcatgtttcatttagaaaaggcacagagtgatagagctgtgggtatgaaaggacttttcatagtggctaaactagggtataaggcaaggaaaattttgcctctggcctcatctgacctacggcttaccacacttttcaaaagtattccaaaaggggtgaggccctcagagggagtaaagcagcagtactccaccttcttccttgtttgctgctggtgtgagtttaaaatgcatcccagtggataatagactctaccaatactttcagtacctccatttctagtaaacttctgttttattccatagggttgtacttaatatgtgatagttattggctggggctatctatcacattttaatcaattttaaatatatgaatctctttattttacaggctactgaggctctaaagaaaatgtatatggaatttcctcaactgtataataatagtgtggtctgttctttcttgccagaagttatctacaaggtaacattcgggatttttcttgtacatattaggtgagctggtgtagataattgcaatgggctgcgtaagcacaggatagatgcctattaaattgaactgcatcagggtcacagttgagaagctcctcttttaaattaaccagagaaattccagaaggggaatgtactcataccccttacagaatgccattattcctcttttgccccttcttttatgttgtttataggctcactcagattactgtagtaaaattctcacaacagaaaagaattatgtagcccctacttctcaccaactaacagcagaacataccttcataaaataaattcttaattatggagaatctaaaacatgcataaaataaagtagtagtgtaccccccctttaactgtgatccagctcatttcacccataaccccattgatcctccccagtgttattttgaagcaaatcttattccatccataaaattgcattaagaatctttaaaaagtgatgccattttatttatttatttatttatttatttatttatttatttattttaaaagacgggttctccctcagtttcccaggctggagtgcagtggtgtgatcacagctcactgcactcttgaccttccaggctcaaatgatcctcctgcctcagccttccaagtagctgggaccacaggcgcacgtcaccacgcccagctaattttttatttttattttttgtagagacagggtctccctgtattacccaggcagttctccaactcctaagctcaagcaatccttccacctcagcctctcaaagtgctgggattacaggcatgagccacagtaaccagcctagtgatgcctttttaaaaacatagccacaatgccattgtcccatctaaaaattattaacaataaattattcatatcatcaaatatccagtgtataaattttgacttgtctcggaaatgtcataaatggttgtttttcataaattgctcattcgaataggacccaagtaagatcggcgtgttacaatcgtaaatctttttttgtttgtttttgagacggagtcttgctctgtcgcccagtggtatgatctcggctcatcgcaacctctgcctcccgggttcaagcaattctcttgcctcagcctcctgagtagctgggattacaagcacacaccaccatgcctggctaattttttttgtattttagtagagacggggttttgccatgttggccaggctggtctcgagctcctgacctcaggtgatctgcctgcctcggcctcccaaaatgattacaggtgtgagccactatgccctgccggcaactgtaaatcttaaaacttgcaggttctgtctctctctctctctgttttttttgtttgtttgttttggggggggtccttgttttgtatttactgaagaaaccggattattgttttgtagagtttacccaagtccaaattttgctgattatgccatgatatggcttaatatttttttctctttattttctataaactggtagcgagagctggaagcttgccttgatgaggttagggttggttattcttggcaagataactctagagatgagggtgtttttccgtcaggaggcacttgacatctggttgactcctgttgtttttggctgctattgatgctcattggccagatctgtccattttctagggagctacaaaatgctgatattttaattctattacttcttgcattagctgaaatagatctttaaaaagaaacttttcctcctctactatttagttaccaaataggcagaataaatgctttatctttccttttatttaccagtttccagaataacaagctggttccgtagcattctttaccagtgaccaacagagcatacattgaaaatttttacagtgaggatagagcctatcaatagaagctgtcatggagttgaatagggtcatggggcttgcagacatttggaacagtgtttcccaaacttccttgaccacagagtcctttaaaacgtataagacattcccccagaggagcacaagagcagagactaaaggaactccatccacatctctccatttctctgttgtcctctcccattctctcgtcacaatcccttctctcccttcccacctcacttccccatccccctcctcacccctacaactcttcagccatttgctctggaaagggtcaaaactaaacagcccatcttgaactgaccttggttccctcctcattgagttctaattaattatctctggccaggatttaagtcaatagccaattaaaagtttattctcatgacattattaaaatttgatcctgaagttttaatttttccattttaaagataggattgcagtttttaaggactgggaaaaaaaagttctcatatgtgctgcatattagtgctttacattcttcacattattttctcaaagggtttatgattgagaacttatttagtagataccggggcagggtaccaaccatgaccacctcatctgattgagcacattggctaaatctaaactaataagtattcaactttacatatgatcattattttacttccccaaattcctttgcagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccgtaagttggaaggttttttattttacccagacagacatcctgaatgctcttatttgaaaggaaggattaacagagtagacaacctgaattggttctgacctgcaaagcttaccatacctctaaattggattaccaatttcgcttcttaggtgggaagagttcaggcatatttcactgttttcagaccgagtcgatcacatattttcggttttttagtgtattttgaagaaaaaaaatgaacctgtgacactatgctgagcaagggattttatttctgtgactggtttttttgaaagccaacacaggatcctgggcagaaccacagtgaagacatcctgtgggcaccagcctccccactaccgtcttatgttataggcactcccccacctctccccataaaatttccatttcctaacctgctagcgatctcggaatcatttctttggcaattctgtatctgtatatttcagctaattagagttgtaggtctagtattatttcagacatacatgattcagttcaataaatatttggtaagtgcctatactattgcaaggttccatgttgagaagctgaagatgcagtgggtaaagaatcaaagccatgatctctgccctcgtgacgtttatagccaagtgggagagtgagagatgctaatcaaataaaaatccaatcaatataaagttaaaactaagatacaggctatgtcagagaaaactgtgcatgggctataatctaatctggtctgggttgtcagaaacagcatccccaaggaagtgacagttaagctaagatctgaagggtgagtgggaattgggaggaatccagatcagagagaaaaatacatgtaatgtgctctggcaggaaggaacatggttctttccaggaagtgaaagaaaattaatattctttcaattaatttaaaattaatcagcacagaaaagaaagggggaatgtggtgtgagatgaagccaaggagacaggtcggggccaggtcaggcacaccttcagtggctgtgccaaggacatttgggggtggcgatcattagtgagctactgaaatgttttaagctgggacagtgtagaggaggttcatggcatcctgggttttggaacagtccctctgatcacagtgcagaggccagttaggaggcattctctgggcaccattggtatgcagtgaacaccatacttagtggccattatggattcctgagacagctgcttattattctaacaggattggctttcctctttccccagggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacagtttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactaaaggaaaactgtgtgccaagcatcatatcctaaggcatacggaatttggggaagccaccatgcaatccagtgaggcttcagtgtacagcaaccaaaatggtagggaggtcttgaagccaatgagggatttatagcatcttgaatagagagctgcaaaccaccagggggcagagttgcatttttccaggctttttaggaagctctgcaacagatgtgatctgatcataggcaattagaactggaagaaacttccaaaaatatctaggtttgtcctcattttacaaatgaggaaactaaactctgtggaagggaaggggttgcctcaaaagtcacagcttagctgggcacagtggctcatgccgataatcccagcaattcagaaagctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgactcttaaaaaaaaaaaaaaaaaaaaaaaaaaaaagataactagaacttctagaacatcttgtttacagttagccagaaactatacaagtggtttaacatgcattatcttactcaatccatacaaaagtcttatggaggtgttagcactctttctactgatgaagaactgaggtacttcataaaaccacttacccaaggtgtcttgagtctggtacaactggcattcaaatctaggtcagtctgcccccagagccactacccttacccctcactgaatctgcctttatattgttgagcccatgaccccaaactgctctttccaatttgaacttccagggattttattgtgaacttacatagcaacattaaaatgaagttgaattgtttttaatggcaacgccgtctgtctcctctagcttaccgcttctcacctttcaaccccatctgtggcctttgtccaggcccacagcttagccatggcttccctcctgcatccctgccgtgggttgctggcctcacacttgcagcagctggacagtgattttagaaggccaccagtccccatagctatgtgacaatgagaagcaaacttttttgtgacagattgtattggcataggcatgatagatggggattggtacgttttgaatcagcatttgcaaaaaaattgtcttgaattttaaaataaacaacaaagatttgttcattgagtgc

SEQ ID NO: 36207 - DNA, 12642 bp, Homo sapiens
ccgccgtagcgcgtcttgggtctcccggctgccgctgctgccgccgccgcctcgggtcgtggagccaggagcgacgtcaccgccatggcaggcatcaaaggtgggcctgggttgcaggacgcgggagggctggggccggcgggggaagatgggccgggggtcccacgcggcccccgcacttcccctccgggctcgcgcgcgcgcgtggggtccctgcgccggggaagcgacccccgccccggccctgcgcttggcccggaggtgggcgcggcgccctcgggcaacggacggttgcgaccccggcttcgccccgcagcccccactttctgccgatttcggcagcctctctcccacccatcgccccccggacaaaatatgaagtggttggcggtcagtgaggagtcccgtcgcgacttggacggccacacacgttttgcaggagtttgcatccgagagagaggcaggcagagcgtgggattgagaaggctgaggctgctagagatgccagctatggaaaaccagtcatttcccaccgaaaggcacaagtgcggtctgcgggcgctgcacgggtctgcccgaaacctcgaccccacgtccaccccggccgcccgcgcccgaggctttacaggctcccgaaacgggtgcattttcatctgcggtgtctggaccctagagttgatcctgtaggcgaccccaaagtgctcctggctctcttccctctccgcagttgcaccctgaggctttttcaaatttcaaaatttttctttttttccttttttttttttaagaagataaaatactggtacaacttaatgaaaaactactggcttattcatgtattttcttttaaaaaaaggaatgttgcatttgttccacctgttaggtagttttgttgtcagtgtgatgagaagcaaagttttcagctactgcttaactaattacattgatttcttgacctgccgctctgtagaagggcagtcaggcaggaagcaggtaactttgggagcagtggttttctttgtattttttcttctctaaggaaaacttaatcgagttttttttcagggtcacagtcttactgtttcttgtttattttcaatgtctgaaaacatttcatttcccatataaaaccttgtcatttaagcaactgggatactttgtaatctccttttgaactatgatagactctaaacccttatgtgaaaggcagttattgtgaattgctgtggtttttaggatgttgcccgtttccctgttcttccctgtttcttcagtgtcaataatgcgggggtctcttaagaaaatagctttgtaatttacttctccagacctagggaaatactgcattaaactgatgaaggtgcctcaggtgaactgcacttttgatttcagcaggattttctggttgttatgagtcagtatgtttctttctcttggcctaatatctttatattaggaaggagtgttgctgtaattagagaccattaggcattgcttgagccatttgtctattactttttgatatattggattttctggtaactcccaggttagagaagtggtccctccttctactctaatttctttgtaatcacagaatcagcatcttgtctctagagagttttgctagataattgggctgctccatgcctagcctagaggctttgggagtagaacccagacttatctaagctttgtcttccaaatgttgcatcactcaattactgtatgaattcttgccttgttgatgtgtcatttaagaaacagcttatatacaaatgatgaagtgtatatataaatcttcctagttgccaatttcataagattgaagaaactgcaagttttgagaacacttttaagcaatttatttaacctctaattggctaccttattcggtatgactggaagatgagatgtcacatcaaactgtgttatgaatatttaaaaaaaatttagtatttaatcctggcgcggtggctcacacctgtaatcccagcactttgggaggccgagacggatggatcatgaggtcaggagttcaagaccaacctgtccaagatggtgaaaccccatctctactaaaaatacaaaaaaattagctgggcatggtggcaggcacctgtaatcccagctactcaggaggctgaggcagggaattgcttgaacccgggaggcagaggttgcagtgagccaagattacgccactgcactccagcctgggcaacagagtgagactctgtctcaaaaaaaaaaaaaatatatatatatatacacacacacacacacacacacacacacatatttagtatttaatggagtagaagtattatctcaaggtatcttgattcccccaaacaaatgttattccagtattcatattcatagcacttacaataagacaatcttggtttatgtttttaaaattgttttttgatacctgagccttatctcattttagtcccttggtttttttttttttttaaggaatcatttttcattaactttgtaagagtgtaatcaaagaatttaggccttcttttttgataaaaacttgaatgactgttctctgtcacagaacagccaccttcagaggccctcatggtcctaaggtggcttgcctcttgcggagattaccgtgaacatgctttttgagatttttctgcctggtttaaattttttttgttgtttcctccctcctgtcaaagggcaattcttgcttgtatgcaactctttctcctaattcccatttgtttcagtgtgggaagataaacttagaaaattttgtgtcacaaggtatataggtaatagtgattacttttgataagagaaagttccttttcacttaatttttgttctgggtatatgaattacctattgaaaaatatatataagtgagcatagatgattctttaaaataaaaatgtgttttactctgaattcccatctaacaattgtgtcacgaaaatgagttagtataaataagaacttaagggtctgtttatagagaatgttggctttagtatatgggctttgtaacatctattttgtctctttttagtggcctttgttttctccaggattctaagttgcgtataaatggcttctgaatgaatgaggtgttactaggtagtatttatagtaatggacttagctgtcttaacagtacctttagtgttcagaaaattatctgcatttaagatctagtccaactgtcattttagagaaggaagaactgagactcataaattacttggacaactagttagtaactattagggccttggaccctccagagtctcagttccatgctgcttccactctgctacattcattccacaaatatttgttgagtgttaagagccaggcacgatcatcacaacagaaaaacttgctccctcctttcgtgaaatggacagttgagaaggaaagacaaaatacaaaccagtaggaaatcgcagctgataattgagcaaaggagaggcattcagtgaacagaggacctcagcatacacgggtctctgccaggaatactcatcccaaatacccacatgatttcctccctcccctcatacagatctttgctcaggtggtgcttcatcagagatgccttccctggccactgtatctagactagcactcccatcccttactctacctgacgtttgtcatcacttgacatttattcacttgcttattaaaaatcattttcttctcccactagaacgtgagagcaaaagctttgattgttgtcattgctctgtctccagtagcaagaacagtatctgacacacgttaggtgctccatagatgtttgttagaggaatgaataaataaatataacagggaattggtctaatcaggaggtttggaaaaacttcactgaggccaggtgcagtggctcacgcctataatcccagcactttgggaggccaaggtgggcagatcgtgaggtcaagagatggagaccatcctggccaatgtggtgaaaccccgtctctactaaaaatacaaaaaaaaaaaaaattagctaggcatggtggtgcacagctgtagtcccagctactcagaaaggctgaggcaggaggatggcttgaacctgggaggcggaggttgcagtgagtcaagatcgcgccactgcactccatcctggcgacagcgcaagactccatttaaaaaaaaaaaaaaaaaaaaaaaaaaccagcaaaaaaacacttcactggttgagctgagatctgaaggaaaagcaggagttaagttggaggaaagtagagaggagtgggaaaggaccatgcctcattcactgttgtatccctagtgcttgtcacatatttagtgctcagtgaatatttcttgaatgaaaaaatgtctgaggcagaagggacaaagtgtgcacaggccacgtgagtgagcaagtctgctgatttccaggaaaggaaagagggccagtataactgaagtgagggttcagggacactgtagtagcctggtgtgacacgtcacaggagaggtgggcagggcccggtcatgagaaccaatttggaactgaagaaaacaaatggtaaattcagtgttttccttacagtttatattgcattcccctgtaaacttgaagtgcctcgtttgctgtaaagtaaaaatgcaattcttttcctgtagctggaaatagaatggtattcaggactaagtgatgtgttcggggttgccatgacctgcatcagcgatctaaccaaaaaccaaatctgccaagccactatgtcatggggtgtccttgattatgactgttttagttgtgcagagtatatcagtagtacttggcaaagtttaacttgtttcctgttcattttggtttctctatgttagcctttgttttggtaacttttagaccttctacaaatctttcgaattttaacttttgaattttaataaaatgacctaacaacaacaaaactagttattttcttagccactgtaactgtagaaatacaggttatatagaactcaaaataaatttatcatttacttatttatttattttttttgagatggagtcttgctctgtcgcacaggctggaatgcaaaggcgcagtctaggctcactgcaacctacgcctcccgggttcaagcaattctcctgcctcagcctcccaagtagctgggactacaggcatgtgccaccacacccagctaattttttgtattcttagtagagacaaggtttcaccatactgaccaggctggtctcaaacccccaacctcatgatccgcccgccttggcctcccaaagtgctgggattacaggcgtgagccactgcactcggctatcatttatttctttgctttagtctaggtcattggttaactatgcctattcaagaaagttgtttctattcactaacgtgagagcaccttaaaatgtactgctgtgtgtgtgtgtgtgtgtctgtgtgtgcgcgcgtagctttagaaactatatttcacctgtagaatgcatctattgcttataataacatgttaaagtagtgatacctcagaaggattataacccattgtcctacagattttctaatgtagattagggaaggaaacccagctctacttttgcaaactatttaaagatttgcaacaaaattaattgattaaaatcattaactacagatattctcgggcattttttctggtcagttttatgcacattgagagtgtatgtgccagaaacaggagctgattagaagaggttttcctataggatgaggtttctaaagtccagtaaacttgagcatgtggagtttctccacatactgcttttcaaaactgtagtgatctgtgaagtaaatataattctaatgcccagaagagcattgagcctgtggactttgactctttagaaagggaaccagcgtctggggaatatggtggggtactagcagtaggttagagctttaaaaatcggtgtcactggctggatgtggtggctcacgcctgtaatcccagcactttgggaggccaaggcaggtggatcacctgaggtcgggagttcgagaccagcctgaccaacatggagaaactccatctctactgaaaatagaaaattaacaggatgtggtagtgcattcctgtaatcccagcttactcaggaggctgaggcaggagaatcacttgaacctgggaggtggaggttgtggtgagccgagatcaagccattggactccagcctgggcaacaagagtgaaactccatctcacaaaaaaaaaaaaaaaaaaaaaaaaggccagtgtcacttcattttgccttgaagataccacagaagacttattctaagactagataacttacacttctgatggcaacttgctattaatacgttttagggatttttgcttctgaggttacagataatgttcagactgctgatattaataaaaataatatttaatttatattcctgttgcactttttatttgctttgcagctttgattagtttgtcctttggaggagcaatcggactgatgtttttgatgcttggatgtgcccttccaatatacaagtatgtaaaatgtttgtctttctgaatatttaagggtaaaatttttctacttttaaagcttaaaaaaatgtttttttactactgtaaaagtaatgcagagaaatgttcacttaccaaacacatacctttgtaaaaatcaccacttaaagtttgtttctaaagattttaggacaccaagatgcaaataatatttttggctgttacctgctctttcactactgctgagtctgcagtggcaagatagctacacagtacctcagccctcctgctcagtttttaacatctattgataatactaattacaagaaaatttaaaatgtctttttgcaaaaaaataccataagcagtcaaaacacaattaaaaaaaaagagagagatgtaaacaattactttccggccgggtgcggtggctcacacctgtaatcccagcattttgggagaccaaggcgggaggattgcctgaggtcaggagttcaagaccagcctggctaacatggtgaaaccccatctctactaaaaatacaaaaaaatagccaggcgtggtgacacatgcctgtagtcccaggtactcgggaggctgaggcaggagaatcgcctgaacccaggagatggaggttgcggtgagccaagatcacgccactgcactccagcctgggtgatagagcaagactctgtttccaaaaaaaaaaaaaaaatttctttccttaggatagaaagaacttctcaaagttaacattttaacatttagataaattagaaaaagatggacaactcaatagaaaaataaatacaaaaagagaactacaaattgctaataagcacataaaaatatccccagcctcactcaaaactaaacaaaatctattgacaaagacaagagacagggcaagcagggactcttttgtgctgtggggggagtacacatagatagttttcttggagataagtttgcttgtagctctcaaagtatatattctttgagttagccctttcacttgttagactttctgatacaaacccacttgcagatgtttacaaagatatatttagtgggggagagtatggatgttcaagcagccttgtttattttttggtttttgtttttgttttgttgttttatgcgttatttataagagccaaaaaaaattctgaaaacatcctaaatgtccttcaaaagaaaaatggttaaattatagtaaatcttttaatggaaatactaggcagtcttaaaaagaatgaggaagagctgtaagtgctaacatgtaaatatgttcaagacatattgttagaaaactgcagggacccattcatattttaaagtttatgtggaaatgtggaagggtccctgagaagctcaataggaaagtgggcaagaggagatttggaacttttagtctttactttttgtgcttttgtactgtttgaattatttttcttaagcatatattcaatttttaattttttttcttaaaatatttaggaaatggtcaggcgcagtggctcatgcctgtaatcctagcactttgggaggccaaggtgggtggatcacctgaggtcaggagtttaagaccagcttagccaacatggtgaaactccatctccactaaaaatacaaaaattagccgggcatggtggtgcacgcctgtaatcccagctagtcacgggggctgaggcaggagagtcacttgaacccaggaggcagaagttgcagtgagccgagatcatgccactgcactccagcctgggcagcagagcgagactctgtctcaaaaaaaaaaaaaaaaaatttaggaaacataagtagctgcttatcattagcctctgtacaatcagatctccaccatgatacctattttattctatggtagttttaagggcatctatttctttttaactttttattttgaaacaattttagattctgaagaagttgtgaaaatcatacacagaggtcccctgtaccctccacacagcctgccagagtcataagatcttacataaccatagttatcaaaaccaggaaatgactgtggtacaatacagttaactagatgtagagtaaaagccatctatttttattgtgataaattctatattctgactgaaagtgttcttacttttagcttcttttctgtattttgatttctgtaatttgggagttcctcgtgttgtaagggaagtttagggttgtttcagctttatgctaaggttgggtatcatccattagaagtcaagcgattgaatcttgattttttaaaaagaccatattttgtgtgtaggaaaatgacatagcaaaaattacattaacttatttttctttttctagcaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctggtaagtgaatatattcttccattaatgattttatattgaacatgtgttacatttttctcaagcaaagtttttgttaatgacatgaaaagaggtgaaagacataagagcctagaagatagagattaaaatctcactttattgtttgttcttgttaactaataaaagtgatattggagaacgtggcttggatctgcagcagctgttggcttgctaatacttttttttttcttttttttttttttttgagatggagtcttgctctgtcgcccagcctggagtgcagtggcgtgatctcacctcactgcaagctctgcctcccgggttcacgccattctcctgcctcagcctcccgagtagctgggactacaggtgcccgccaccacgcccagctgatattttttgtgtttttagtggagacgaggtttcaccgtgttagccagaatggtctcgacctcctgacctcgtgatccgtccgcctcggcctcccaaagtgctgggattacaggcatgagccaccgcacccgtctggcttgctaatacttaactgtcagagttgagcatatcaactcccccagtgctgaacaacccaggcctatcctgtaaaacctaaaatatggaagacctgagaaggtgcatgtgctctgcaggcagaaaagcactgaagaggggaaggggctggctacgggtactcagttcttcctcccaaactcactgatccacgcgccttcatctctggggaggtagagaagacagccatatggagaaggcaattgttttcccaccccttcaaaagaatgtacatgggtgtgtttccatctgtgatatgctaaaatttaatctactctagatagatttttatattaaggaagagtaagcacattcctttataaacagaaacttgtagaattttatgctgcttcttcatagcccagaagtcaagcttgtttttgaatggtcatttcatgactttctttttaaaggaaccaaaggtaaatgaaaatactagtataaaagtaccacttttatactataaatatatttatactgtatatatttatatatatttatactatatatttttttactatatatatttatactatatatatttataagtatgtgttcagcactgtgacaattattgttacaaggcatgcttcttttagatcataattgggatacaactagagccttgatttttttttttattttcctttcgtttttcatgcctgttgactgagtgtatcttatttccatagattgagtggggagcttgtgcacttgttctcacaggaaacacagtcatctttgcaactatactaggctttttcttggtctttggaagcaatgacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttggaaaagcttgactgatttcacacttatctatagtatgctttttgtggtgtcctgctgaatttaaatatttatgtgtttttcctgttaggttgattttttttggaatcaatatgcaatgttaaacacttttttaatgtaatcatttgcattggttaggaattcagaattccgccggctctattactggtcaagtacatcttttctcttaaaattatttagcctccattattacaaaaaattataaaaataagttttcagtcagtcaggatgacatcactcccaatgttatgcagacatacagacggttggcatacgttatagactgtatactcagtgcaaatatagctgcatttatacctcagaggggccaagtgttaatgcccatgccctccgttaagggttgttggttttactggtagacagatgttttgtggattgaaaattattttatggaattgctacagaggagtgcttttcttctcaattgttagaagaatttatgttaaactttaaggtaagggtgtaaaaacatttttgagataaggtttttatttatgtttattattgttagagtgagttgcaatgtgggaagaaatgacattgaaattccagtttttgaatcctgtttctatttataagtgaaatttgtgatctcctatcaacctttcatgttttaccctgttaaaatggacatacatggaaccactactgatgagggacagttgtatgtttgcatcatatatgccagaaaaccttcctctgcttcctccttttgacttatttggtatgttgtatatattacataaaataacttttcaaatatagtttaataacacttagaagtgtttacttacctggaaaataattgctatgccgtacattcagagtgccccctcccctgcaaggccttgccatgattaacaagtaacttgttagtcttacagataattcatgcattaacagtttaagatttagaccatggtaatagtagttcttattctctaaggttatatcatatgtaatttaaaagtatttttaagacaagtttcctgtatacctctgaactgttttgattttgagttcatcatgatagatctgctgtttccttataaaaggcatttgttgtgtgagttaatgcaaagtagccaagtccagctatatagcagcttcagaaacatacctgaccaaaaaattcccagtaaccaggcatgatcaatttatagtggtcgtttacatctaataattatcaggacttttttcaggagtgggttataaaaacattcaagttggtctgacagtattttgttaaggatatttgtttgtatgtttattcagtatacttacataaaaattatttcgccatcagccaaaactcagtaatcatgacagctgtctgttgttttatgaagtttatttctcaagaaaatgggaataaatttgggatttgttcagcttttttactaaagatgcctaaagccacaggttttattgcctaacttaagccatgacttttagatatgagatgacgggaagcaggacgaaatatcggcgtgtggctggagccttcccactggaggctgaaagtggcttgtggtattataatgttcagatttcaagaggaaggtgcaggtacacatgagttagagagctggtgagacagttgggaactctttgtgcttgtgatctactggacttttttttgcaggaagtgcattctctggtccttccctattttctgttctggatgtcagtgcagtgcactgctactgttttatccacttggccacagactttttctaacagctgcgtattatttctatatactaactgcattggcagcattgtgtctttgaccttgtatactagcttgacatagtgctgtctctgatttctaggctagttacttgagatatgaattttccatagaatatgcactgatacaatattaccattcttctatggaaagaaaacttttgatgatgaaacaataaagattttaaatatctatttt

SEQ ID NO: 36208 - DNA, 18218 bp, Homo sapiens
gagctcggcgcacctgggctgggcaggtaagggctggtgcgggacggggagaggaacctgcagtccctacttgggtagagccaggcgccccttggctaagacgtcgaggagcgtggtagcgacgggtgatcttcgctgcggacttggttcggagggacgtccgcttctggtggacagattgagcaaaggtgggtacgccaacttctggggaccagcttgagggaggagaggctcccccgtgggtggggtaggacccatccccggagtttgtagggggtgagagaacttgcttgggggcatctgtgtgtttggggtgggtacccactggggctgggtgcctgtcgcccttttccagatagctttggggcggcctcagttctgtagcgctaggcccctctcgaatctacacttgtgtctactctccctacccccaccgccgaagcggagggcactgctctcggccgtcaacaaccccactatccggtagagctaaagcaccgcgcccccttcagtcttaccaacttgcggctggcccctgtgtcccagagaggggacttcccaggtccgcaggtccttgatcctagtgggcgttttgggaaactggagtgagggtggccaggagctttggagcattggcggtttgtcttccctccctgagtctgtttggcacagttaggcccttcgccctgggcctgggagacaaccttggatttccaaggagcggagctaggtgctggggagggtggcgctggggtgtggttgctctgggggtgggccctctttgcccgaaggggctggagggtggtgtggagaatggggaaagtctcccaggcctgacttggaaaggaggcctgaggtgtcactctttacagggagcctgctttgtggtaaaggggtcatcctgttccaacctgttctcttggtggatgtcaagagtggaagtcagggaaaagagatggatagagagaggaaggcgcttgggtgggattggtgaaagctggtgttgacccaggagtgtggtttaggatgagacgtgtgtatgatgtatgacagtggcactcaataccttgtaactcccattcgccatcccccagcttccatccagcagaagggaagggtgtgggcattttgactagaggcctgcagtttacccctaagcagggctaaacagggaagcctgaggaacggaacttagacgatggcatttcatttctttcaggagaaagggaagagctgggactgctaagaattgtctgcgagaaatggcgtgtgttttaacctgagcaaaaccactgacggccaaatctcggcttttgtgtggcagtgcccctggaaactagtctggggaggagctatggaggtggcaatgagggtgtttatggaggacctgctccctagaataggggtatgggagaggacagttatgctcggaggaggctgaaagtgtccctcctctatgctcactgtgaggggaatagataggttagcatcattgtcctttggctgtttaagtacctgttagagacacaggccttacattttgctgtgatggcagctagagataccaagatgagttcaactaggctaaggtggttcttcaggcgttgggatttgggtggcaagagtgtttagaaagagaactctgatttaggtgtgtttgagagtggatgttatgcagtctccacctcaatcactttattggccctctatgctgctgggatctttgttgatgtttttagtttactttcttggtgcgcagaagatgagagggacatggaagacaaggtgcagtggcagggtttggtacagaacactgtgacttaggaaataaagcacctcagcccagatgtaaaatggggatagtaatatcacattcaggtttatgaggatgaaatcagacatgttaggtaaaggttcatgtaaaaattgtaaagcctacacagatacaaaggattgttgttaccatccttcataagaaatgtcttattgtcctgaggttaagaaaaaattacttgtagttttttaaattataaattgaaacatatcattgtaggaaaatatgaatcatatataatgtatatgggagaatgtaaaaagcacccatagttgcatcactagataaccattacaaatattttgttgcattgttgtatttatttccttttttcagttctgtgtgtatgtgcacatgtatgcaagtatatgctgtgttacaagatggagatagtgctacacagtcaagttgtatgctgtttccccctgcccccacaacttcatattgtaaacatttccttgagtataatacaaattctgacacctgttgttaatggctacttaatattgcagcctgtggttgtgacgtaatgaatgtttctgtcttggccatttgggttttcaattgttccatctctgcctgtttttagacttgtagttactgggtggtgagtgggggagatcttggctgactttcagaaggtggagagggtttacagtgagagaggcagggcatgggcttggaggagggcaggctggggctccttccatggggctgaggcaaggctgctcttgtgtagtcccatcttaggagaacactgagaacccagggctctagatcttaatcactgatttctgtgggtggctgcttctcctttcccatcatcaggtgcagctcctggtcttggcctgattgccttaatttttgcatggtgggatttggatcaactacaataagtccttttggacttttcttccagtccactatcagtcaagagttggattttaatgtctgacaggcccaaacacagcacttaccagtattgcaatggaaattctcaaaagctctttactagattgactggtttggtgcctatttccctatcctctttttccttctcttgctccatccccctttcagtagtgataggactggggagcagaaggtagaactagccgttgagagaatatgcatcccctcctccttataaggcttataatgcactccatggtttgatggtttcacatgctgccctacaaaacaccgtaattcaaggccaactacatgggggtacttgaacactgcgtgccaacctgacctacccactatgctcccagggggaaggtttcagttgcaggacttggtaattgggtcagaaagctcaggtgagagcaggtcttgccttgctcttaaagtgccagacgctgagttgggtttgggtttttcacatttgttgggagtctggctggggagagaagtggtgttatgggccaccccgtcagctaagctcttctgagtaggagccttcagctgacccttttaacctcttttctttcccacctggcacagtttattcccatatttagctgctttgctgtaaggttgtttggtttcagaactgtggtccaggtagggatctttctgggtatgaaggtgacctatttatcttcccctccttctcaggccattgtggggcttgagaagttccagtgtggagtttctcaagaaggaacatggagcgtcagtgtttagtaactaacaccgtgcttggcacacagtagctgatgaacaaatatttgttgaatgagtgttctttttccaggcatctcattctcatcttaagtaaaaacaaaataagaacaccaaaaaatccaaacacaacatctcagacaaacaattctccagtgactgtttttttatcagtcacccaatctgggaaggcttttgttttctgctgtgagtgccagctgctcttgaatgttatctgctatgcccatgtatttttacaagaatcaattgcagactttacccatgctggctcctgcaaccaattggttcactccagccttcactgggagataaacagacccaagggaggaggctgtcctagccatgcaaagcttgtctcatgactgcttttagtactctaagtactcttagtactttagtatttggttattctagggcttctgagctttaccagactcagtagtggagacgtgttctcagcctttgtcgccagtgttcccaagccttctcccagacactggattgttgtatggatagccagctgagacccctccttttctccatacagaatctttgagcggtcaagggaaagacaagccgactcttcagatccctgtggacacactgcctgctcttccatgtaagtgaggactctggagtccaggatctaccccttatctacttctccctcatcatggtggtgtcatttatttctaaaatattcccattcacctttagttgtcttgtttaaaaagagaacatgtgtcaccttctcacttatatagttgttgctgtttccataacttttttcttccctctcctgagatgagattgaaaagagcaattttccttctcttccaaagcccttggtgcttcaggaaggactgtgttccagcaggatgacatcacctttttatttttctgcttcaggatttaaatagaagaaatgtgatctacttagctgataagtctgatttggctagagcatgaagtgtaaatggctttggaatcagaataaaaaggaccttttaacctcttttctttcccacctggcacagcttattcccatatttagtttctttgctgtaatctagtgaaactgtagctctagtagatgggaaaggtggctgggaagggttcccagtggctggcctaattcttctgctcttcccatttctccctctgacccccccagatcatggccctccacccccgcagagtccggctaaagccctggctggtggcccaggtggatagtggcctctaccctgggctcatctggctacacagggactctaaacgcttccagattccctggaaacatgccacccggcatagccctcaacaagaagaggaaaataccatttttaaggtaaaggacttcttctaccatcagacctttctggatttttttttttttttttttttggcatggggaatacactagatctaaaactctggtgaaacagagagaatgcttatgatgggggtgcccaaactcagcaggcatagtaattcctcttttgggggcatgtctgcaatggttgaagccgtttattctttcccactcattgaaggtactcactcacatcccaaaggataccagctggggttggctaaaactctcattagtgattgtagtgatgtgtttgtttcaaaagctagcgagggtcagcagttgactcttcctcctcaataactcagagctcttgctatgcagagagttgcttgggcctgggaatggatactcagaccaggacagaactatcaggtgttagcaggcacgcagtatagcctatgtgattggtatagagggctctcagcaagtttttctttctttttctttttttgtgggatatggtcttgctctgtcaaccaggctggagtgcaagtggcatgatcatagctcactgcagccctgacctcctaggctcaagcgatcctcccgcctcaacctcccacgtagctggaactataagcacacaccaccacgcctggctaatttttgtattttttctgtagagacggggtttcaccatgttgcccaggctggtcttgaactcctggggtcaagtgatcctccctccttagcctcccagagtgttcagattacaggcataagccactgcacctggcaagcttttcttttgagttaaaatatttcgccccatctataactggggcttaaaaatcaaaggtgatttaattacaagttttaattttttaaatggttttaaaaataagaaatagcactgatatgacagtcattttatttaactgaaaacaagatttaatcacatagcattttacaaaatttaagtgaaaccaaagcttgacttaagacagaagtaggtggacaggcttgttgtgggaaaggttttcacatggtttgaaaccctggaggctacgtctctgctccacaccagcttctttcttggtcacttccatctcatgagtagctttagttcctgcatcccaagacactgagaagttagttttgtttgcccttttcttctttgagtataagctagaagtcacaagtgaaatacagtctctactgtgggtctctcaagattcatgctttgggtccttgctgaaattgggttgggaaagggcagaaaatgtaagcgcagggttcaaaagaaagccatccttaggatgtttcccacccaactcagttatgtcaggtgtagagaggacaggcagagagaatattgacctgaaggtacttagaaggtatttagaaaatctaaatcttaatttagattttaaataacaatataaaagttgataaggttagtacctataaaccagcaccaattattggagttggcattgagaagggcacgggcccatcttggcccatttggcctcttgtggccatggtctgaaactggatttgctgttcaagtgtctgacagtggctggccctggggaagaggctatttcctgaaagccctactcatgagagtgatgctttgggcttgcatgcttggggcttgaggaaaattgggctgtggggaggtggctttgttttagttatatctgtgcatctgtttgcagagtgcagggggagggtgctttcacagataccaagctctgatggcctttagcagaatatgcagctggggcactaacattaaatgggtgtctgtgtccattatctcttttaattctcgtgacaaccctgtaagggaggtattaccttcatgttgttgatacagaagccaagtcttagaggggctgaataacttgccaaagtcacacagccagtaagtggtgggggtaggatttgaacccatgactttctgtctgcatcccaccccccattatactgccctttctgatcaagaactggaagacctggcctcaaattctactaccgtcaactgcatgtgtagccctgagcaagttaacctctctgggcttcagctctccctttggtaaaatggggatgaaattagtcttgcctgtgagaatcaagtgaaataaagtatggaaagggatttgtaaagcactataaaaatgcagagattatttcctctttagaaagagaaataaggacctgcacagtgatcagaatctcttgctagcaagactcagaatgggtttgaacaagtgatgtttataaatcacaatgattgccacatggttcctcctaggctctcctttcttgattctttttttttttttttttttttttgagacagagtcttgctctgtcacccagactggagtgcagtggcgcgatcttggctcactgcaaactccgcctcccgggttcaagcgattctcctgcctcagcctcccaagtagctgggattacaggtgtgcaccaccatgcccagataatttttgtatttttagtagagacggggtttcaccacgttggccaggatggtctcaatctcttgacctcatgatccacccacctcagcctcccaaagtgctgggattacaggcatgagccaccgcgcctggcctcctttcttgattctaaagttccagtcttaaacgatacggctcttcactgcatcagccttgggtgcccagtgcaatctgggtgggtcctggggatggctgtgtggtgagcaggaaggctggggctctggttctgggttggtctggctgctctccatggaggagcagggatttagggaaccacagaaatgtgcagagctctgccaaagtcttcatagcccgagtcagctgggtggggccagagttagcgtgggcacacagaggatcaaacaaatggaagggaaaatttggggaggcagcagccaggtactgccaggtaattggagataggccttccagataccagcgaccagtgaagttgaaatctcccgtagggggttggatagaatggagcagcagttaggccccctagtgtctgctcagccacctggggcagcagaatgttgtcaaacttcttcattccataccacaatcaaatggagggacccaaatctgaaaagatggtaagaggaagtgatctgaattggaggaggaggatttagattagcttttgaggaaacttcctcatgcctgtgaggttcttcagggggcgactgaaggagatcagagctctcaaaggatggggcagaaaaattcaatttcagcttgaggaagaagcctatgatcagaatcagaggaagggattgggtttggacaaatcatatacactgttggcttgaaaacgttggtgtgtgcttcctgtcttgagctgtctgctaatggtacctactttttcggcatcagaacaagttgtactcctgcacaaagagatcagagaacttgttagcaatgggggagagtggctatcccattgcagaaacaagaatgcctgttagagctgaaagtagggccaggtgtctactccctgctttgctcctgagcaccttggtctatgacttgagcggcttagatttttcctttcctcattagggaggctaacttcttcttgtctggggaaagtgctgtgagtttccatatttgaaaaccagagagaaggagtcgaagtggttttagtccgtgctgccagccactggtgtggttgacagcatgatgtttctaatgaagcagaagtttgaggggatagggtaaggtaaggggtgtggattttttaggacttgaggccctcagccagagggacaagctgaacccccagtgtgtttccttccctcctaaaggcacttggtttctacaattcttttttttttttttttttttttttttgagatgaagttttactcttgttgcccaggctcgggtgcaatggcacgatcttggctcactacaatctccacctcccgggttcaagtgattctcctgcctcagcctcccgagtagctgggataataggcatgcaccaccatgcccggctaattttgtatttttagtagagacagagtttctccgcgttggtcaggctggtctcaaactcctgacctcgtgatccacccggcttggcctcccaaagtgctgggattacaggcatgagcccctgcacccaggttacaattctttatttatgtattagattgaagactgacaggagggaacacaggaggccaaactcttcatatcctctgccatccctctttgtcttacctattgtcgtataagcaactcatgtcaaaaatgaataagcaaagaaaaaaagttacttgaaattctgctatccagagttaccatctgcactttggtgcatattttcagcaggctttatcttcagcccttcattagagcattgtcgtcttgatgagtgccggtaccagtgcttgagataaggttcctccttttaatatattgtgtttgcacatggctttatttcccttaggcacctgtcttgcctggtcctaagggcagtgtttcctgctgcagtctctgtaaatcggggttgggatgatggggcagtcatgcaaaagttgtgtgtgtgtgtgtgtgtgtgtgtgtgtgtgtgtgtgtgtgtttgtgtctatgagaaagggtaagcacatgctttgcagtggctctgggcaatgataggactcactgtggtttcttgttctcaggcctgggctgtagagacagggaagtaccaggaaggggtggatgaccctgacccagctaaatggaaggcccagctgcgctgtgctctcaataagagcagagaattcaacctgatgtatgatggcaccaaggaggtgcccatgaacccagtgaagatatatcaagtgtgtgacatccctcagccccagggctcgatcattaacccaggtgaggccccaggtgctggggagaaggtgggcagcatgccagattctgggctgcactcttaagagatagtcaacttgaaaacagcctgatttacacagtttaagatggataaagcaagaaagcctttctctgggaaggacccagaaaacaaaagatgcagactcagcaaaatcttgcttacttaggggaatgttttttaacctggttacttaaagcattagaaagtggaggggtatacagttctactgtaaaagtagcctcttttgggattcaagaggccaggtagttttgaaggagaagggattaaagcttaaaaggtttgcgttctaaacctggcccttatcactttactacttgtgggacttgaatcaagtcattttacctcttgtaagcctcagtttcttcaactctaaaatatgggatctcagctttcctatttacttcaaaagctagtgtgagaatcaattaacatgatctgtaaaaaaaaattaacatgatctgttaaaaaaattttttaattgacaaataataattgtacatattcgttgggtatatagtgatgttttggtacatataatagtgacaagatcagggtaataagttctttatacatattgggtgactgatcgtttaattcataggatactttgactaagagaatatctcctgatccctccaattaactgcatacttaacaagtactaacagccagataatttagatatgtgctccagtgaatctagggaggtccttccatgagagaagtgttcattcccttgattctcactctttttagctaggacattgagggtgtgtactgaacctgaggagcctctgggctagcagtccctagcttgaatggtgggtcagctgcaggggtggcagtgcaacctgaatggctcacctgcgagcttgtgtatcttgggtaggatccacagggtctgctccctgggatgagaaggataatgatgtggatgaagaagatgaggaagatgagctggatcagtcgcagcaccatgttcccatccaggacaccttccccttcctgaacatcaatggtgagtggggatgatgggtggtacagagacatatggaggatgtaaggagttttgaccttgggactgtcaatacattggccaccactgccctgaaagcaggatcagtccctgcagccagactgctggactgttagcaagtgggagtcagaggtgaggaactccctgttggctcagttatcccagtagagttgggtgggttccaggcaatagaacatctttggaagcttatgtgctaattcaaagaaataaaaaatttgaattcattcttaacccaacatacaaatatatcatcagttacacattttgccaatttccttcaggccaagtacagtgtcattttttcgagttacgggcaaactcttctaatatttcccttggtataaattctgtgtcacttccttcacaaggactactctgcctaggctgtatcacgggaaacttgtgatgtctgtagctgatagtacttggctctgataggatttatctgcaagagacttttcttttatgggcttttgaatccagcttcctaggaaaattgagttgggagcttgagaattcaccgtgtgacagagcaggtactgaatctcccactgcgttttctgaggatacttgaacacacgttgaattgctctttctgcagcatctttacttcatttgtccactgaaatgctcctacgcaaatgacttgcatccagccaagcagtttttcattgtctttttagtaccacctggctgcaatgggtcaaaatgagataacttgtgccacctataaaacttaggataacaagatgatttatttagtattttcaggtactctaccgtaggtgatgcctctacctttgagaatcaggaaatgacacttgtctgtccactggccctccttcatttatatctttgcaaccaagtgtgggtaaagagaagtttcatagagatcttgcaggtcaatattgccacatgttcaatgtcactaatcattagagaaatacaaatcgaaaccacaatgaaataccatctcacaccagtcagaatggctgttattgaagtcaaaaaataacagatgctgatgaagttatggaaaaaagggaacacttatatcctgctggtgggaatgtaaattagtccagccactgtggaaagcagtttggtgatttctcaaagaacttgaaacagaatcaccttttggcccagcaatcctattattgggtatatacccaaaagaatataaactgttctaccatagggacacatgtacccatatgttcattgcagtacttattcacaatagcaaagacatggaatcaaattaaatgcccatcaatggtggactggataaagaaaacgtggtacatatataccatggaatactatgcagccataaaaaagagtaagatcatgtcttttgcagcaacatggatgtagctggagggcattatcctaagtgaactaaaacacaggaacagaaaaccaaatactacgtgttcccactcataagtgggagctaaacattgagtacacatggacacaaagaagggaacaatagacactggggcctccttgaggacggagggtgggaggaggatgaggataaaaaaactacctattgggtactacgcttattaactaggtgacgaaataatctgtataccaaaccccgggacatgtaattcacctatataacaaacctgcacatgtatccctgaaactaaaataaaagtaaacacaaacaaaaaattgccacacgttacattcccgcttagtgaaattgaacatctagaaatgtgggatcctttctcaaatgtctggctgactcattctgttattctcaccccctaaaaggatgcagtttatttccaggatcctgatttcctatttctgttgatcttttattaaagctaatatttgtgtgtccttatgttttgagctgcctttaatccttttttggaaagttgtagaatagatactaaaaacaaaaaagtaaaatgggaacataaatttaaccagttcccataaatttaaccagagtgccattgcactccagtctgggtgacagaatgagacatgatctaaaaaaaagggtcaaagaaacattaatctttgtgatttcagagctgttggggcagaggatgaagaattgttgaagaatagatgcctaagaggtgaggctaggaggagaaatctgtagactttggagcaagtcaactttgacagtagcagggaaatactcttttttctttttttaaaccttttaattggatccttttgaataaataatactttcacatggtttacattcataatggtacaaaaaggtaaatcagtggaaaggttttccttctatcctgtccctgaacctttcatttctttccctggaggagtcagatccttctaggttcttgagtatccttccagacattttatgcatgtaaaagtatttgtttgttgttaaaggtatttctatgcattaacacttactcgaagctaatcagctaatttagctgagttcgttttatggaagacaaccagcttctatttaattgctggggccaaattttacagtatggaatgtcttactccttgtaatttaacctccagagaaaactcacatgtctatgttaatcttcagcaaacaaaggtttttaaaactatgaatttgtgggagaaataatatgactaggaagcaggagcaggggaaccttatttcttattgcgttagttatgggaatcactgatgggctggaagatcacactgggtcagggttcagtgtttggttcttgtctactgaccttgtgagttctcagagcatcagcaagtgatgtgcacgtgtggtacccctgtctgctcaccatatgcttttgttttaggttctcccatggcgccagccagtgtgggcaattgcagtgtgggcaactgcagcccggaggcagtgtggcccaaaactgaacccctggagatggaagtaccccaggcacctatacagcccttctatagctctccagaactgtggatcagctctctcccaagtaagtgagactttatctttcttgctcggtcttctgcttctattatagactctttcctgtcctgctttctaacttcatttctttgccatgtattgaaaaactacctgtctcagaggcatcctctgtttctgtttcctggctagcccatgagtcaccagggaagaagtaaagaaacactggcccagctgggtgtggtggcttacacctgtaatcccagccctttggaaggctgaggtgggaggagtgcttgaggccaggagtttgagaatagccttggcaacatagtgagactctctacaaaaaaatttttaaagaattagctgggcatggcagtgcatgcccatggtccctgttacttgggaggctgaggtgggaggatcacttgaatgcagaaggttgaggctgcagtgagccctgatcatgccattgcactccagtctgggtgacagaatgagacatgatctaaaacaacaacaacaacaaaaacattggctgacacttacttgcccatagggatgctctgattggttacagctccagctccaggttattcaggtcttaggtgggtaggagtcccagatttatcagtcacgcagggggatttagtgacaaggccagttgtggaacagggaggttaatggccatggatttggtagaggaggctcttggattttgagaggctttaggacctacagaaaaaaacctctttctgaatttggtacgaatttatctcaatgacgaatcaatgtcattgcttgggtctccctttcacactacatatggtaggcatgtgagtgctattaataaaattttgtccaagaggctaagtagctttgataggggctattgggttcaatggagatttgctgagtaaaaattaactttgatgtgaactgtgtccttttatggtatattattagagcagatccccagtgtgtgtgttcacatgtcattttcagaaaaattgtttggtattgcttcttcttcctcaagtttctttaaacaataagctaaaaatgatacacaaacaagataccttagtttttagctccttccaatgaccattggtgtgaagactcagtcagtatagcgtggggacaccaggaccactttacttgatgcaattgtagcctttggggtgtggtgattgaacagaaatagttgagatggactttgaactgtttgctttcaggcagccttttgagtgaatattccagggatatgttgatgtctccctttattgcaggaaggataactatggcagtggccttcctgaatgctggttgaaaggtggcttgatcttaatggacttgcatgagtcacagggatgaacaggcagagcagtgaagcaggactctcactgtcatctctaaccttgcagtgactgacctggacatcaagtttcagtaccgtgggaaggagtacgggcagaccatgaccgtgagcaaccctcagggctgccgactcttctatggggacctgggtcccatgcctgaccaggaggagctctttggtcccgtcagcctggagcaggtcaaattcccaggtcctgagcatattaccaatgagaagcagaagctgttcactagcaagctgctggacgtcatggacagaggactgatcctggaggtcagcggtcatgccatttatgccatcaggctgtgccagtgcaaggtgtactggtctgggccatgtgccccatcacttgttgctcccaacctgattgagagacaaaagaaggtcaagctattttgtctggaaacattccttagcggtaagtcatttctcagaaagttgatcgtgggaatcactctctggaagtacattccttccactatccctgtctttcaccttcctgctttcctggcatggcaaagatcttaaaaaatttagtctggaggaggtcaagggagaacagaactttggttctaaaaattggaggtgacctaggcaacaaagaagggagtttcactccaaagctatgtacttggaagctatttttaagttggttgtggctccttcaatggcagaagagggagacagccctgtcattacacctcaaatgttaccagcgtgtctttaactttggaaggtaatcctgtttgttatgttcagaatagcacatattcttttgggaattatctgagtggtgaattcaagcaggcagttttagggaaagcaccgtgatgtcaattttttacaatgtggtttgaactgcaagtcatgatcaatgatgtccaagagaaccctctgtaatttgtactgttcaatatatttgtgctattcagtatggttgtcacaagccatatgtggctattgagcatgtaaatatgactaatgtgacccaggaactgtttaattaatttaaaactagtgagcacatgtggctagtggctattgtaatggacagcataaaagatggtatttgttgagtggatgtggaatgacccagtataccaaacttgctcttccactttctgcagatctcattgcccaccagaaaggacagatagagaagcagccaccgtttgagatctacttatgctttggggaagaatggccagatgggaaaccattggaaaggaaactcatcttggttcaggtgagaagataaggctgtgtcaacaactcttcatctttttgccaatgcttaagcccccaggtctgggttgagccctcatcaagcatccatcagcccatgtaggtttcagtctcatcagatggggtaacagactcaggtttgtgcagtaggactcatgctggaaaaggcagggtccttaaaatgggtgattgatttagtggagatcttatctttcattctcttactaaccttagagtcttgctgaaacctcacaggatatgaccctttccaggttttcttcacacacaaatacacacacacacacacacacacacaatgtaaattgcacttttttttttttttggagacatggtcttgctgtgtcgcccaggctgcagtgcagtggcaccatctcagcccactgtggcctcaacctcccaggttcaagtgatcctcccacctcagcctcccaagtagctgtgacaacaggcacaggctaccatgcctggcctaattttatttttagcagagatgaggtctcactatgttgctcatgctggtctggaactcgtgggcttaagtgatcctcctgtctcagcctcccaaaatgctgggattatgggtgtaagccacgatacctggccctttccagcctttcttagaaaaaccttttgagttacttttaggaatataaatttattctaggaagtggcagcaaggccacttgggctttgcccctggagttgtgtagcaaggcaagcaatagatgatattttgtaaaaagtcttgcaaagtaagcagtcatttatttaggcctgtgatgtaatgttacatctaggttctttaccttcatttgaaccaacttccacagtgagccttggcagaaggatggtccagagagatgaaggcatatcctatatttagacatcagaatggggtcttcctcagggcctctttggtctgtccttcaatcttgggtccattgtgctatttaaaaataccttttcctcagaggatacacctgtgttctgtgtcctgaacaggtcattccagtagtggctcggatgatctacgagatgttttctggtgatttcacacgatcctttgatagtggcagtgtccgcctgcagatctcaaccccagacatcaaggataacatcgttgctcagctgaagcagctgtaccgcatccttcaaacccaggagagctggcagcccatgcagcccacccccagcatgcaactgccccctgccctgcctccccagtaattgtgaatgccatcttcttccttctcttttttataatattgtacatatggatttttttattgtttagatttaaccagcttttaaatctctcttttctctaacagtgttagaagtttgtgattctccaaatatgcctagatttaaagctgatttaatttatggaaaaatcacccttcagactttgcttttctttttcaaatctcctaatggtagtatgatatagcatagtagaaggagatttggcctgggagtttggacaccaaagttctagctgcagctttgcttccaatgtgaccttgaacaagtcctttaacctctgggcttcagatttattgcttataaagtgaagagattggagtagtgcctgaaattgcatccagctttagaacggactcaatgaccttcttctacttgtacaaggctaaactgcctggaacagaatccttctgcattgttcttgtaccacatttttccttggttttgttaaagtttcctcaagcact

SEQ ID NO: 36209 - DNA, 12553 bp, Homo sapiens
aacaaattggtaatcggtggttaaataaatatgcccaaagtcccacagctagaaagtagcagggctggaatttgaacccagtccaataaaacctcaaaaccggtgcactttctaccgtatcctgaggcttctttactttggggccctggttagccttagcagcctagttttctacatccttcatgccagttgaatgaaactactgacatgctccacattcttctttctcccatgcttttgttcattcagttacctcctcctaaaatgtctgcatttacccagataatcttccaatggaaatccatggttcaagtgccacctcttcaggaaagccatctgacttcaatcaggttaataatctctcataaccctttctggtacatctgttaaggctctgtgtatttcctggagttcatggtttacttttaagtgtcaatctttcccttctaagtctgtgtgtcttattattgatgaatctacacagggcctaacacttaacaggtgatcaataaaccagggcattttgacttgacccaggaggagtaggggagcctggaaaaacccaggagagaagcctgggaaaggaaagaaagaggctaggctgagctggaggtggggtggggagatagcaagggggtgtccaccccattcccccaaccttcacccactccactcccactccaccactctatgctcacatccaggaagccagagagctccgtctgcagcagctctttcagctccttcttgctcagcttgtacttgtccccctctttgcccgagtgggcgtggaacacgttgatgagggtctccatcgccgtctccagctcagagcccattgcagcagtgcacctacccacccccatcatggaagtgagctgaggaccaggcccggagtacctggggtctaggtgaggggaaccctcaggactggccctggctgacagctcaaatagctgtgggattagagccctactgcaattgatctttccctgagattttacaatgtgagggaaaccccaagagacctaagtgcaggcctgttctctgtgtccctcagtctgtaccccagccagagggaatcagggttggggcatggagagagagcagttggagctgggctggctccagaggcctgtggtagatgtctgcagtggctgcccaggcagggattgaggagggtggggcaggcaggggtggtcacaggactgggccatgcttcctctggctctatttttaccctggaccttgcctgtctagcatagccaagctctgctgttgagggtggtgggctggggtgtccactacagccttccttctgctgcccacccctagcaaggagtcagtctggtaccctcggtcagcctggtagaggggatggcagccccagtgggtggcgtacgccttctgggggagggaggtctcactgactctgagtttcctgtcagcagctgggggccccttttggtccttcaactctgttctctcctgaacatgtcattttggcttctttgggatatgctcccattgcctctgcaaaattatcccttccatctggtgggtggcagaaggggagagaggaatgtctgagccttttccttggagccagagttcccagggagtgggagaggagacctgcaggcgttgtccctgcaactgctcactcctggttgattcggggatagtgggagcaaggggaatggggctgctgtgtgttgggggagagaaagggctgaaagcatgcggtcctttgagttcaaggggctgggagagagtaggagaagaaaggagaaaggagtggtctgttgagagagaagactgccaagccggggggcctctttcccttggccctgggacagtctggccttccacaaccccagagggggcagctcaggtgtctcggatcagatgtccccatccttccccaggcctagggggctggacaatggcccctgatcgaatgacatcccagttcttcaatggggcccttgtgagtgtcatctgaactccggacctgagaagcagttgtcacagagacatgggggagatggaacccaagctgtggctgatgaggggataaggggtgcttgagggaggggtgctggtagcttgattacctgctccatgccagaggggcagctggaggtcacctggagccctaaagcagcctgggattttacgtggtggcagttctgagaggacttgggggcaggggagatggggaaacaaagaggtaagaatggggggaaagaggagtcaagaggtctgggccaaaaatgggaggaggagaaaggggaggtcctgtggaggtcgagttgggaaggggcacagcaccctacatctctgcttccccatatcatgggagctttgccctgccacccccagactcccccgggacctgagctcttggcaaggcagggtgggggtggcagagactaaggctggcaggagaggtgggggcagaaacagctgttgtatctgctctcttcttaccccacaggaggcgaggcaggggagggctgggacccttcccaacacctgggagacagagggggccttggcagggacttgagggctccctgtgggagggccaggcggtcaggaagctcatggtgggttccccactggcttcctcctttgctgagctgccagctctctctccgaccttcagttcatttgtctctcatcaccaccttccaaaccctgtctcccccaaatcccaaactgccctcaccctgactgactcctcccagatcctcagtgctccacagtgctatggtccccagcctcttggagcccttctgaagacccctctccctgaagctggcaggccagggactagcccagtggggcagggtactcacggttggcctgggcctgaggtgggagcaggttctggacagatggccaaggttgcaaatgtggctgctggagctgtgtgtggagacctgtcttcaacagtccctcccccgctgacccccccaccgactccaccccttcacagacgaacaccctgtggggcaaggggccaggagcagacagaggcgccctctgtctcctgggctggaacaggcggcccttgtctctttcccagccttgcttgccccgttcctttctctccaggcagcagtggatggtgcaggggaaagaggtgggaaggaggtcctgggagggacactggatgtcttaccccaagctgggccttgcagtacctgtggctggctgtgctggttgagcccggtaaggggggaattctgctgagggggtcttagtctgtggctcctccatggggcctcactgagaggaccctcagtgagaaacttagtcttgggagtctgagaacccacagagggatttcaatccaggactcttctctgggggtctcaacctggatccccctctgtgtgtggggcctcagcctggggttctctgagggatcttggtctgtagcatcctttgtgggatctcattccaaggggcctctgtgtgtgtctcagattgggcctctcagtgttgagctcccttgattggttgcctccctcttcccccctcagcatacacactcctgattagacatgggtatggtggcagcagcccccagtattgagaggactaggaccctgggacccctgccgaacgagatctgtccaggcagctcctctccctgaccaagtgggggcgctcgtgtggctggcagggagcccgggtccagacctgagggctcagggcaagcggcctgattgggctgtctctggtcttcagaatcgaccacggaaatttgacacctccgggcttggaagcagctctctcctccttccccgctgcttataaacctcagccctgaggctccagctcactctaccccatctccttgccgggtgagtctcatggctgaccctggagggaggctggagatcattttttcttcctgggctcccaggtccctcccccagagccagctcagacaggaattcaggaaggagctttggatgatcgagcaacagcgcgtgcaggagtgtgtgacggggtggacagaaaagagaatgcctcttccagccccacccgccgcaccccagggggttgtgagtgcctgtactaaacccgtcctggagcagggagtcagagacgccccgttccaggacccttgtcaccgggagacaggagcggggaggatctgtggggtcctgggttcagcactctgccctgctgccgctgaggagaggtaagggtggagcggggcagagaaaatgggtctgttcagacggagccagctctgaccacaggggacatttgccagaccctgtgcttctctgctgggaggagcggttagagtgtgtgtgggcggatgcgagtggccggagaccagggcccaacataaacaagctttggagacaaacaaccttatgacctgtgagtctgggtgagacaagaagggattcttgagacagacacgccacagaggggccaccagacttgaaggactccaagaaggaccttcaactgaagacctcctctcaagtagaggggtctccagatcgagggatcaccacagaggggtccctaagccacagacatttaaaaaggatcccggattgtgagacctacagaagagggggtttctggagctgaatctcctgcccccaccaaaactgagatgccgttgcctggtctgctgccccaagctcaacccctgtcctctccctctttccccatatgccccctccaggctgagactgatgtgataacaccaaggcagggaccttctgaaccattcctgcatcttggggctccctgactctccctctctgctccttctctcttccacaggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggtaggcagaagtctgggactgagattttgtgagatgatgattatgggacactgtgtttaggacgtgatggtgccgagtacggtgaggtgaccacaagaaagggtgtgggtggctgcatgtgtcaatggttgcaggttttcttttgttttttcgagacaaagtctcactctgttgcccaggccggagtgcagtggtgtgatcttggctcactgcaacctccatctccggggttcaagtgattctcctgcctcagcctcctgagtagctgggattacaggtgtgtgccaccacgccgagcctatttctgtatttttagtagagacagggtttcaccaggttggccaggctggtctcgaactcctgacctcaggtgatccacccgcctcggcctcccaaagtgctgtggttacaggcgcaagccactgcgcctgacccggttgtgagttttcttgcctggtgtgtacatgtgtgtgtttgtgtgtccatgcatataattaggtaagcaaagatactatgtgccagtgggagtatggtcttgtgtcagaagatgctgttgggttcttgtgtatgctctgtgcctttctggtctaatttccccaagacaggactggacccagagctggcttccaggagattcacagactgtcagagctggaaggaggccaagagaaaacacagtccgcattcctcacttcacatatatggaaactgaggcctagcagtggaaaggggcttatcaaaaatgaaaacacagccaaattcatggagtcatagacctcagtgtagggggtctgtgggtgcatctgtgaagactccctacccgctatgggcatccccttactagggtgtaagagtcattccttctctcgcactcacaggctggagtcaggtcttaaatttcatcgactctggcctcgaagaggcctggtcattctggctgttgacagtttgttttacatcctttctgaaaatccacaggcacgttgaagtgtgtgaatatggactccttgaacacagtgagtctctgaaactcatggtctttcatctgcaaaatcccctacaacttccaacttctcagacttttttttgagacagggtttctcactctgttgcccaggccactgtgcgatcacagctcattgcatccttgaccttccgggctcaggcaatcctcctgccccagcctcacaagtagctgggaccacaggcgcatgccacactgcctggctaattttttctttttttgtgacagagtctcactctgtcaccgaggctggagtgcaatggtgcgatcttggctcactgcaacctctgcctcctgggttcaagtggttctcttacctcagcctcatgagtagctgggattacaggcaaccgccaccatgcctggataatttttgtatttttagtagagacggggtttcactatgttggccaggctggtttcgaactcctgatctcaggtgatccacctgcctcggcctctcaaagtgctggaattacaggcgtgagccaccgcgcctggcctaatttttaagttacttgtagagatgtggtctctctgtgtttcccaagctggtctcaaactctaggcctcaagtgatcctcctgcattggccttccaaagtgttgggattacagtcatgagccactgtgcccagccagacgtttcctttttcatcttttttactggaaacttcaggttctctcctgaagggacagcattccttatatccttgtcaagcagtgattgtggttttttttttttttttcctaaattcaacttcctctgggcctggaaatggaggaagtgacctctctgctttccattatctctagattttagtttcttcttctttctaagacttcccagcgccttggaagatcatctgccacctgccattcttcttattgcgctccttacagctcttcagctcctggctcactgttttcttctcatcactgcttctgttgttattctcagtggcttcagcatccgcacagacaattcatccaacatctgggcctttcaattttctcaactcctcatttccaaaaagatttgtcttcttacatctcagcatcccactcctctgttcatgctttagactgtgtcattaacaaaataacgcacaacttccaaaatcttgatttcaagtttccctttatctgctgacctcctcctgtcattccagttctgttcccctctctagcttctccacttcagcacttccctgactcctcaggtaccttcagtctctcgaccctctcacttttgcatcttccatcaacatccctcgggtcctcattgcccttcctcctcacctcaggttctaaggcttctaattgtaatcactgccttaaccccgttgattctgtctctctctgttctcaacccagttaatccaccatttcacctatagtaacttgccagttaaatccactgttctgcacctgcacttggatagctgaatctggctggagaaaaatgcatagctttgttgacttgtctcactttaaatctataaccacagaccccaaaagggacccttggcaatacctggcggttctgtgtttccctggttgattcatttaccagttctttcagataattatttcacaatttgtcttctctcctcaaagctcagtacatctttccacgttctcccttttcctgagaagtttactcactgagaagttcaggacttcgagaccagcctggccaacatagtgaaaccccatctctactaaaaatatatttaaaaaattagctgggcatggttgtgtgcgcctgtaatcccagctacttgggaggctgaagcaggaaaattgcttgaacccaggaggcagaggttgcagggagctgagattgcaccactgcactccagcctgggcaacagagggagactgtctcaaaggaaaaaaaaaaaaaaggaaacgaaaataggagcaatcaggaaacttgtatgtgctccctccccgaaatcagcagtcttctgttatgcaaatgatacgtcactgcccctaaggccaacccttcactggtgccctggatcccatcccctctcacccactgcactccagtctgggtgaccgacagagcgagactccgtctcaaaaaaaaagactttcctcttgaaattactcctctctttcttgtgtcctcaaattttccttctccactgtatcgttcttaccagcttacaactgatacctctttttttttttttgagacagagtctcactttgttgcccaggctagagtgcaatggcgtgattacagttcactgcagcctctacctcctacgctcaagtgatccttccacctcagccttctgagtagctgggactacaggcatgtgccaccatgtctggctaattttttaatttttttgtagagacagggcctctgtacgtgtgcgtgcatgtaattaggtaagcaaagatactgtgtgccagtgggagtatgggcttgtatcagatgatgctgttgggttcttgtgtatgttctgtgcttttctggtctaatttccccaagacaggactggacccagagctggcttccaggagattcacagaccatcacagctggaaggaggccaagagaaaacacagtccccattcctcacttcacatatatggaaactgaggcctaatttttaaatgtttttgtagaggcagggcctcattatattgcccatgctggtcttgaactcctaggcttaagtgatcctcctgccctggcctcccaaagtgttgggattacaggcatgagccactatgcccagcccaatcctttattgatggaaatttttcttatgtccatttcttccttcttgcaaatatctgtttgtatacctacatactggtggaaaaataacaacataaggtaaatgtttggcagtagaaatattaggttaagtggcatgttcatttttaatttgtttttgagaaaggatcttgctctttcacccaggctggagtgcagtggcatgatctcgggtcactgcaacctctgcctcccaggttcaagcgattttcctggctcagcctccctgagtagctgggactacaggcttgtgccaccacgcctggctaatttttgtatttttagtagagacgaggtttcgccatgttggccaggctggtctcgcactcctgacttcagatgatctgcctgcctcggcctcccaaagtgctgggattacaggggtgagccaccgagaccagctttcatttttaatttttgtgattaccaatttgcctcctaaaaaagttgtaccagtttatatggctacccacacttcatgcgatgcctgtgtacttgtccaaactgggtgttattgagcttttactttttgctaatctatgatgtgaaaatgatatctttttctgatttacgcttatataattctgagtgaaatggaacttcaattttttttttttttaatttttttgagacgaggtctcactctgtcacccaggctgggctggagtgcagtggtgtgatctcggctcactgcaacctccacctcttgggttcgagcgattcttgaaccgtgcatcaccatgcctggctgatttttgcatttttagtagagatggggtttctttctttctttctttctttttttttttgagcagcagcaagatttattgcaaagagcgaaagaacaaagcttccacagtgtgagagacccgagcgggttgcccgagatggggtttcatcacgttggccaggctggtcttgaacgcctgacctcgagttatccacccgccttggcctcccaaagttctgggattacaggcatgagccaccatgcccagccagtaacattttataatgttaaaaagaatcctgtaggccgggcgtggtggctcatgcctgtaatcccagaccttttggaggctgaggtgggtggatcacctgaggtcaggagtttgagactagcctggcaaacatggtgaaaccccatctctactaaaaatagaaaaattagcaaggcgtggtggtgggtgcctataatcccagctcctcgggaggctgaggcaggagaattgcttgaacccagaaggtgggggttgcagtgagctgagatcatactactgcacgccagcctgggcgacagagtaagactccatctcaaaaaaaaaaaaaaatcctgtagatagtttaattgggatcatataaaagatatattttagggaaaatcaacatttttagctgattgagcctttctctttaagaaaaatatatgtttattccattttctatttattcaaggttttttttaatatccctgtggtataatatgaaatatatagttgtcattttgtatccatgggaattgttcccagaacccccttggatgccaaaatccttggatgctcaattacctttttttgtccttttcttgtagagatgggtgtctcacaatgttgccctggctggtcttgaactcctgggctcaagcgatcctctcaccttggcctccccaaagtgctgagattgcaggtgtgagccaccatgcctggcctcaaatcccttatataaaatcagatagtacttgcatataacctatgcacatcctcctgtatactttaaattacaagtaactctaggttacttgtaatacataatgcagtgcctactcatcacttcattcacatggattcaacttagtacttagcatggggcaaaatttaagttttgctttttggaactttgtggatttttttcttcaaatatttttggttctaggttggttgaatccagggctgtggaacccactgatactggtatggtatttggtatttggcctttgttttgtttctgtcacagctctttttttttttttttttagatagtctcactctgtcacccaggctggagggcagtggcttgatctcggctcactacagcctctgcctcccacactcaagcgattcttctgattcagcctcccaagtagttgggactacgggtgtgcactatcacaccgagctaatttttgtatttttttttctttttttgagacagagtcccactctgtagcccagactggagtgcaatggcgcgatctctgctcaccacaacctccgcctcccaggttcaagcaattctcctgtctcagcctaccgagtagctgggattacaggctcccaccaccatatctggctaatttttgtatttttagtagaggcagggtttcaccatgttggccaggctggtctcaaactcctgacctcaagtgatccgcccacctcagcctcccaaagcgttgagattacaggcgtgagccaccgcacccttcctgcttcttctttcttaatacttatttatttctctttactgattgaatgcacccccaatataatgttacagtagccatccttgccttccactggcagtgcttatagtattttataattaaacgtggttgtaacttaaaaaaaagtcttttttagttcttctgtgaatcagctttgttccctttagagattcagtgagtcttctctgtctgcatccaaatgttggttcaaaccttgagcctcacaccctgcctgaggcacccttctctggtttgatgttgaactattgttcaacagtcaactttttggttgtgcttgtttatctggcaacaggtccttcgatcaggacatccagtttactgttgccattgatttcacaggcctatgagagataccctgtcaagggcccctaaaaacccagatactccatgcccttgccattcccctgatctagtgacccagctggataaatgaaaagacacaagggttgtgcaaatgagcagctaagtactgggagcttctccagctttctgagaaagaggagggtggccccagaaggctctgactgggtccaaccctgcagcatctccctgagatgctggcattccttgggccgatcccacagcagctgcagtggtgtgctggtgagagaagattgtgtggatttctttccagctttgtattcagcgacaacctgtttgtggtttgtaagcagccatcgtggaagtatttacacaacggcaagcactaggactcaggcccccccacctttctctgctggtgctccttggagaggcaccccgtggcggtgcagttttggggctgcagcctccttctttagagaaggggcaggtgccactgctctctgagggaagggccttgagagaatagcagctgacagttcttccctccctactttctcaagaaccccagtttctaactctacccttccctttggtgtctcctcaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttg

SEQ ID NO: 36210 - DNA, 7238 bp, Homo sapiens
ggaatatattcactaaggattctatctgcttactgctacagacctatgtgttaaggaattcttctcctcctccttgcgtagaagttgatcagcactgtggtcagactgcatttatcttgtcattgccagaagaaatcttggacagaatgtaacagtacgtctctctctgattgcgatggaaggtgataaactgatactcctttattaaagttacatcgcactcaccacagaaaaccattctttaaagtgaatagaaaccaagcccttgtgaacacttctattgaacatgactcatggagaagagcttggctctgatgtgcaccaggattctattgttttaacttacctagaaggattactaatgcatcaggcagcagggggatcaggtactgccgttgacaaaaagtctgctgggcataatgaagaggatcagaactttaacatttctggcagtgcatttcccacctgtcaaagtaatggtccagttctcaatacacatacatatcaggggtctggcatgctgcacctcaaaaaagccagactgttgcagtcttctgaggactggaatgcagcaaagcggaagaggctgtctgattctatcatgaatttaaacgtaaagaaggaagctttgctagctggcatggttgacagtgtgcctaaaggcaaacaggatagcacattactggcctctttgcttcagtcattcagctctaggctgcagactgttgctctgtcacaacaaatcaggcagagcctcaaggagcaaggatatgccctcagtcatgattctttaaaagtggagaaggatttaaggtgctatggtgttgcatcaagtcacttaaaaactttgttgaagaaaagtaaagttaaagatcaaaagcctgatacgaatcttcctgatgtgactaaaaacctcatcagagataggtttgcagagtctcctcatcatgttggacaaagtggaacaaaggtcatgagtgaaccgttgtcatgtgctgcaagattacaggctgttgcaagcatggtggaaaaaagggctagtcctgccacctcacctaaacctagtgttgcttgtagccagttagcattacttctgtcaagcgaagcccatttgcagcagtattctcgagaacacgctttaaaaacgcaaaatgcaaatcaagcagcaagtgaaagacttgctgctatggccagattgcaagaaaatggccagaaggatgttggcagttaccagctcccaaaaggaatgtcaagccatcttaatggtcaggcaagaacatcatcaagcaaactgatggctagcaaaagtagtgctacagtgtttcaaaatccaatgggtatcattccttcttcccctaaaaatgcaggttataagaactcactggaaagaaacaatataaaacaagctgctaacaatagtttgcttttacatcttcttaaaagccagactatacctaagccaatgaatggacacagtcacagtgagagaggaagcatttttgaggaaagtagtacacctacaactattgatgaatattcagataacaatcctagttttacagatgacagcagtggtgatgaaagttcttattccaactgtgttcccatagacttgtcttgcaaacaccgaactgaaaaatcagaatctgaccaacctgtttccctggataacttcactcaatccttgctaaacacttgggatccaaaagtcccagatgtagatatcaaagaagatcaagatacctcaaagaattctaagctaaactcacaccagaaagtaacacttcttcaattgctacttggccataagaatgaagaaaatgtagaaaaaaacaccagccctcagggagtacacaatgatgtgagcaagttcaatacacaaaattatgcaaggacttctgtgatagaaagccccagtacaaatcggactactccagtgagcactccacctttacttacatcaagcaaagcagggtctcccatcaatctctctcaacactctctggtcatcaaatggaattccccaccatatgtctgcagtactcagtctgaaaagctaacaaatactgcatctaaccactcaatggaccttacaaaaagcaaagacccaccaggagagaaaccagcccaaaatgaaggtgcacagaactctgcaacgtttagtgccagtaagctgttacaaaatttagcacaatgtggaatgcagtcatccatgtcagtggaagagcagagacccagcaaacagctgttaactggaaacacagataaaccgataggtatgattgatagattaaatagccctttgctctcaaataaaacaaatgcagttgaagaaaataaagcatttagtagtcaaccaacaggtcctgaaccagggctttctggttctgaaatagaaaatctgcttgaaagacgtactgtcctccagttgctcctggggaaccccaacaaagggaagagtgaaaaaaaagagaaaactcccttaagagatgaaagtactcaggaacactcagagagagctttaagtgaacaaatactgatggtgaaaataaaatctgagccttgtgatgacttacaaattcctaacacaaatgtgcacttgagccatgatgctaagagtgccccattcttgggtatggctcctgctgtgcagagaagcgcacctgccttaccagtgtccgaagactttaaatcggagcctgtttcacctcaggatttttctttctccaagaatggtctgctaagtcgattgctaagacaaaatcaagatagttacctggcagatgattcagacaggagtcacagaaataatgaaatggcacttctagaatcaaagaatctttgcatggtccctaagaaaaggaagctttatactgagccattagaaaatccatttaaaaagatgaaaaacaacattgttgatgctgcaaacaatcacagtgccccagaagtactgtatgggtccttgcttaaccaggaagagctgaaatttagcagaaatgatcttgaatttaaatatcctgctggtcatggctcagccagcgaaagtgaacacaggagttgggccagagagagcaaaagctttaatgttctgaaacagctgcttctctcagaaaactgtgtgcgagatttgtccccgcacagaagtaactctgtggctgacagtaaaaagaaaggacacaaaaataatgtgaccaacagcaaacctgaatttagcatttcttctttaaatggactgatgtacagttccactcagcccagcagttgcatggataacaggacattttcatacccaggtgtagtaaaaactcctgtgagtcctactttccctgagcacttgggctgtgcagggtctagaccagaatctgggcttttgaatgggtgttccatgcccagtgagaaaggacccattaagtgggttatcactgatgcggagaagaatgagtatgaaaaagactctccaagattgaccaaaaccaacccaatactatattacatgcttcaaaaaggaggcaattctgttaccagtcgagaaacacaagacaaggacatttggagggaggcttcatctgctgaaagtgtctcacaggtcacagccaaagaagagttacttcctactgcagaaacgaaagcttctttctttaatttaagaagcccttacaatagccatatgggaaataatgcttctcgcccacacagcgcaaatggagaagtttatggacttctgggaagcgtgctaacgataaagaaagaatcagaataaaatgtacctgccatccagttttggatctttttaaaactaatgagtatgaacttgagatctgtataaataagagcatgatttgaaaaaaagcatggtataattgaaacttttttcattttgaaaagtattggttactggtgatgttgaaatatgcatactaatttttgcttaacattagatgtcatgaggaaactactgaactagcaattggttgtttaacacttctgtatgcatcagataacaactgtgagtagcctatgaatgaaattcttttataaatattaggcataaattaaaatgtaaaactccattcatagtggattaatgcattttgctgcctttattagggtactttattttgcttttcagaagtcagcctacataacacatttttaaagtctaaactgttaaacaactctttaaaggataattatccaataaaaaaaaacctagtgctgattcacagcttattatccaattcaaaaataaattagaaaaatatatgcttacatttttcacttttgctaaaaagaaaaaaaaaaggtgtttatttttaactcttggaagaggttttgtggttcccaatgtgtctgtcccaccctgatccttttcaatatatatttctttaaaccttgtgctacttagtaaaaattgattacaattgagggaagtttgatagatcctttaaaaaaaaggcagatttccattttttgtattttaactactttactaaattaatactcctccttttacagaattagaaaagttaacatttatctttaggtggtttcctgaaaagttgaatatttaagaaattgtttttaacagaagcaaaatggcttttctttggacagttttcaccatctcttgtaaaagttaattctcaccattcctgtggtacctgcgagtgttatgaccaggattccttaaacctgaactcagaccacttgcattagaaccatctggagcacttgttttaaaatgcagattcataggcagcatctcagatctacagaacaagaatctctgctaagtggacctggaatcttccatctgcatcttaacatgctctctaggtgtttcttgtgtttgagaaccatgacttatgactttcctcagaacatgagactgtaaaacaaaaacaaaaaactatgtgatgcctctattttccccaatacagtcacacatcagctcaaaatttgcaatattgtagttcatatattaccgttatgtctttggaaatcgggttcagaacactttttatgacaaaaattgggtggaggggataactttcatatctggctcaacatctcaggaaaatctgtgattatttgtgtgttctaatgagtaacatctacttagttagccttagggatggaaaaacagggccacttaccaaactcaggtgattccaggatggtttggaaacttctcctgaatgcatccttaacctttattaaaaccattgtcctaagaacaatgccaacaaagcttacaacatttagtttaaacccaagaagggcactaaactcagattgactaaataaaaagtacaaagggcacatatacgtgacagaattgtacacaatcactccattggatcttttactttaaagtagtgatgaaaagtacatgttgatactgtcttagaagaaattaatatattagtgaagccacatggggtttcagttgcgaaacaggtctgtttttatgttcagtttgtacaatccacaattcattcaccagatattttgttcttaattgtgaaccaggttagcaaatgacctatcaaaaattattctataatcactactagttaggatattgatttaaaattgttctacttgaagtggtttctaagatttttatattaaaaataggtgtgatttcctaatatgatctaaaaccctaaatggttatttttcctcagaatgatttgtaaatagctactggaaatattatacagtaataggagtgggtattatgcaacatcatggagaagtgaaggcataggcttattctgacataaaattccactggccagttgaatatattctattccatgtccatactatgacaatcttattgtcaacactatataaataagcttttaaacaagtcatttttcttgatcgttgtggaaggtttggagccttagaggtatgtcagaaaaaatatgttggtattctcccttgggtagggggaaatgacctttttacaagagagtgaaatttaggtcagggaaaagaccaagggccagcattgctacttttgtgtgtgtgtgtgtgggttttgttttgtttttttggttggctggttgttttcgttgttgttaacaaaggaatgagaatatgtaatacttaaataaacatgaccacgaagaatgctgttctgatttactagagaatgttcccaatttgaatttagggtgattttaaagaacagtgagaaagggcatacatccacagattcactttgtttatgcatatgtagatacaaggatgcacatatacacattttcaaggactattttagatatctagacaatttcttctaataaagtcatttgtgaaagggtactacagcttattgacatcagtaaggtagcattcattacctgtttattctctgctgcatcttacagaagagtaaactggtgagagtatatattttatatatatatatatatatatatatataatatgtatatatatatatattgacttgttacatgaagatgttaaaatcggtttttaaaggtgatgtaaatagtgatttccttaatgaaaaatacatattttgtattgttctaatgcaacagaaaagccttttaatctctttggttcctgtatattccatgtataagtgtaaatataatcagacaggtttaaaagttgtgcatgtatgtatacagttgcaagtctggacaaatgtatagaataaaccttttatttaagttgtgattacctgctgcatgaaaagtgcatgggggaccctgtgcatctgtgcatttggcaaaatgtcttaacaaatcagatcagatgttcatcctaacatgacagtattccatttctggacatgacgtctgtggtttaagctttgtgaaagaatgtgctttgattcgaagggtcttaaagaatttttttaatcgtcaaccacttttaaacataaagaattcacacaactactttcatgaattttttaatcccattgcaaacattattccaagagtatcccagtattagcaatactggaatataggcacattaccattcatagtaagaattctggtgtttacacaaccaaatttgatgcgatctgctcagtaatataatttgccatttttattagaaatttaatttcttcatgtgatgtcatgaaactgtacatactgcagtgtgaatttttttgttttgttttttaatcttttagtgtttacttcctgcagtgaatttgaataaatgagaaaaaatgc

SEQ ID NO: 36211 - DNA, 21522 bp, Homo sapiens
ggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggaggtgcgatctcggggcagggccgggaggcgcccgaaagcccggcggtgggagtaggggagcccgggccccccgcagacttcttcccctgggcgtctccgagctggggcccgcaggaggttaaaggtcaacgggcttgggggcgccggcttgggggacgggggaacaggagcaccctggagggccggggcggattaggcaggaggagaaaaggctcttgccgagccctttcccgaggtaaaggctgagtctgtgcagtatccttcctttcaatatttatttttaatttttaaaaatttttttgagactgggtttgcacctgtttcccaggctggggcggagtggcgccagcctaacttctgagctcaagcgattctcccgccccagccttgcaatttagggggtgccaacacgcctggctaattgaaaaaaaaaaaattatctgggctcggtggctcacacctgtaatcccagcactttgggaggtggaggcgggcgaatcgcctgaggccaggagtttgagaccaggctggccaacataacagggtgaaacctcatctctactaaaaatataaaaattagccaagtgtggtggttcatgcctgtaatcccagctacttgggaggctgagtcaggagaattgcttgaacccgggagtagaggttgcagtgagctgagatcaggatgccactgcactccaacttgggcgacatagtgagactacgtctccaaaaaaaaaaaaaaggcaaaaaaacttaaaaaaaaaaaaaagatacagggtgtcactatttacccagggtggtctcgaactcctggcctcaagccatcctcccacgttgacctcccaaagcgctgattactggcatgagccacccacacactctggccacagcggcatgcactgcacagagctgggcccggggatcgggagaaggtgacagtttagatgtcctgaggtcagctctgccgaggcaggaagtcccttggttttcaaggttcacatagaggacaggacatgacatcaggcccaggacgccacccctgttcccctcctgacttggatgtgatctgcagagaagtggaactgggtgaggtctgggcggcttttgcctggtctacatcctcttattctgactttgcagcattcagtacaggagggaaagaggagggggctgggtgccagtgtgcaccccactcacagtgtcctaagcaaagctccccccattcctccaaccagccttcctccctgtgacaggcagtggccatctgcctcttagtcacaggtctgaaccttcttgcctctggctgggatgtggccctgggcttgctcctgtctcaggagatattgtgccccatccactctgaggaggaactcctggccccactggcccaggtgcacagatcgccctggcagttgacctgtcatcagcaagttatctgtcctttctgccaagaatccccgctatgtgtcagggcttgtgctaggcctgggggcacagccgtgcagcacactggtcctggacccttttgggggcctaggagctgagcccggctcttctctccacagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtggtcagtgcggccaggagcaggcagggcgggtgggggggcacggctgctgaacagcatgggacctccagctgccacccacggcatgtatgctggggtgggatggtggggggtcctgccctgccctgccctgggggctgtgccctgtatagggggataggtagcctgatctaccccattgggatgtcattcttcccgtctggctggaaggccccggagccccatgctgcaggttatgtgagggagtgcccgatagtagggcgcctcctcatgccctgacctgcagccccctccccgtatctcctgtgtctgcagtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtgggtaccatcctgcctccattgcacacacccaccttcccgccccaccctgtggtcttcctggtagggactgggtggccttcacagagtggaggccttggatctggggaggccagggaggcctgtgagctgaggtcaggggacccagagcaagggcccagcaaaccacagtcctcccatcctaggtatcccaagggttactttgtccagaacacatattttgactttttcaactacgctggactgcagcggtctgtacttctgtacacgacacccaccacctacatcgatgacatcaccgtcaccaccagcgtggagcaagacagtggtgagggcttctggtaggatcctctcagcggggcccagggtggctctgtttgttccctgtttggaaagctctcccaggaaaaaggtgctcccagcatctctacaccctcacagattcccttccacctatgaagctaaaattcagcctgtgtgagcggatacgggctcccaaaatcacccgtgtggttgacctcgctaggagaagaggggtctggcctaacgtcacacagctcggggtggcaatcctgtcccttctctatggtgctactctcactccatctccccttgctacacatcgtgctcaaggaacaggcagcttcggtggggggggcgccgggcatggtggcttatgcctgtcatccagcactttgcaaggaggccctggtataaggatcacttgaggccagtagttcaagagcagcctgggcaacatagtgaggccatcaccacaaaaaattaaaaaattagccagggatggtgatgtgtgccggtagtcccagctgctgaggcaggagaatcacttgagcctgggatgtcaagggtgcagtgagctatgaccacaccactgcactctggtctgggcaacagacgcagaccctgtctttctttttttcttcttttttttttttgagctggagtctcgctctgtcgccaggctggagtgcgatggcgtgatcttggctcactgcaacctctgcctcccgggttcaagcgattctcctgcctcagcctcccgagtaactgggattataggcacccgccaccacgcccggctaatttttctatttttttttagtagagacagggtttcactctattggcctgactggtcttgaactcctaacctcaggtgatccaccctcctcggcctgccaaaatgcaagggttacaggcgtgagccactgtgcccagctgggataccctgttttttttgtttttgttttttgtttttgagatggagtcttgctctgttgtccaggctggagtgctgtggcgtgttcttggctcactgcaacctccgcctcccgggttcaaacaattctcttgcctcagcctcctgagcagctgggattacaggcgtgtgccaccacgtccagctaatttttgtatttttagtagagatggggtttcaccatgttggccaggctggttcaactcctgacttcgggatccacccgcctcagtctcccaaaatgctgggattacaggaatgagccacagcgctcggtctgtatttaagaaaaatttttgttttaagttttttttctttttaaaaatatatctttttcagggcgggcgcggtggctcatgcctgtaatcccagcactttgggaggccaaggtggggggatcacgaggtcaggagatcgcgaccatcctgactaacatggtgaaactccgtctctactaaaaatgcaaaaaattagccgggcatggtggcaggggcctgtagtcccagcgactcgggaggctgaggcaggagaatggcgtgaacctgggaggcagagcttgcagtgagctgagattgcatcactgcactccagcctaggggacagagcgagactccatgtcaaaaaataaaaataaaaaaatatatatatatctttttctttttctgagatgaggcttgcactgtggcccaggctggagtgcagtggtgagattattgacagccgttgtggggccgcggttctaagtttaaaagaatttaggctgggtgtggtggctaatgcctgtcatcccagcactttgggagtccaaggtggatggatcgctttagctgcaaagtttgagaccagcctgggcaacatactgagaccctatctaagaaaaaaataaataaataaaataaaataaatgaataaaaaagaatttaaaaaagaatcccacagcaaagacaatgcaccatagagcaatttattgccaaggaaaggtattttggaagttaagtttagaacagcctgggtgcactggctcatgcctgtaatcccagcacttttggaggccgagatgggtggatcacttgagctcagaagttcaaaccagcttagccaacattagctggacattgtggtgtgagcctgcaatcccggctactcaggaggttgagatgggagaattgtttgaacccgggaggtggaggttgcagtcagctgagattgcaacactgcactccagcctaggtgacagagtgacacccccatctcaaaaaaaatagtgaagtgcaaaatgcacagttcaccctgagacacagaattcaggacaggctgctcgtaaggatgagacagcaccgattattactggggaaactccctttctgggagtcttccgtgatgaattcctaaggagctgggaagaggtgttactgtaagcacgttctgggccgtcctctggttgcacatgcgtagtagctgtacatgcttgttcacacgtcacgtgtctcagtgccgtggttggcatgtctgagggacacggtcacttccttgactacctatcctgcctcaagatcatagctcactgcagccccgaactcctggctcaagcaatcctcccacttcagcctcccaagtagctggggctgccggggctgcaagcacgcaccaccacgaccggctgattgtttgtatttttagggaagaagtggtttccctatgttacccaggctggtcttgaactcctggtctcaagcgatcctcccaccccagcctcctcaagtgttgggattacaggtgtgaccactgcacctggccaaaatctttttttaaattaaaaaaagcaccgggtgcggtggctcacacctgtaatcccagcactttgggaggccaaggcgggtggatcacctgaggtcaggggttcaagaccagcctggccaatatgacaaaacccatctctactaaaaatataaaaattcgccaagcatggtggtgcacgtctataatcccaggtacttgggaggctgagacaggagaatcacctgaaccccagaggtggaggttgcagtgagccgagatcatgccactgcactccagcctgggggacagagtgagactccgtctcaaaaaaaaaaaataagaaattaaatttaaaaaaagcaacagaaacaaatggctgcctggcagcggtggctgcagggcgctcctgtttgtgtgactcaggtcgtgtccctccctcagccctggtctctcttgtttcttgcagggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtaatggtggtttgggacatgcctaagggaggtcttttgcccccatgtggtgaccctggcttcagcaggagcccaagacaggtggatgggcaggcatggtcctctgagctttctgatgtttctcacccttggtgggaggcccattttcttttttttttttttttttgagatggtctcactctgtcacccaggctggagtgcaatggcctgatcacagctcactgcagccttgaactctcagcctgcagcagtcctcctgccttggcctcctgagtagctgggactacaggcacatgccaccatgtctggctaaataaaaaaaattttgtagcctgggcagagtgactcatgcctgtaatctcagcattttgggaggctgaggtgggtggatcacttgaggccaagagttcaagaccagcctggccaacatggtgaaaccccatctctactaaaaatatgaaaatttgctgggcatggtggcgaacacctgtaattccagccactcgggaggctgaggcaggagaattgcttgaactcaggaggcagaggctgcagtgagctgagatcacaccactgcactccagcctgggggacagactgagactgtctcagaagaaaaacattttttttttatagagatggggtctcagtctgtcagcaggctggtcttcaactcctggactcaagtgatcctcctgccttagcctcccaaagtgtgggaactccaggcatgagccaccttgtcttgtcaaagggaaggccatgttttgaagggcaggttcccagggtcagccagggtagggcagaacctctgattgctgcatctctgcttacaggcccagaggcagctgctggggtgcacgaggggccttcctgctggagggcaggccggatggggctcaggctgtcggggtgctcacacctggtgctttggctgtcataggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacgtgtgttggggctcctgggtccttgtcggggctgcttctggtcaccctccactttcgccttccctgtgtcctgcagttgagggcagctcagggcaatgaggcaaatggctccaaatggagagggggctcatggggtggctctccagggtcctggctctcagaggaagtgcagcttcgacagggacaggggtcacttggctctgctatctcctagatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgtgagtctctgctgtgcacctgctccgcctgcccagcccgggggcgtcaccgtgaccctctgtcccttccctcctggcccgcaggcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagtgagtgctccctccctgccctcggctagagtgggaaggagaccctggcaggtggctggcctcggtgggcatgtgctgttcaagatcggcctcgtgtccagcccaatgggaaggccgtccatacccagatagttcaggggaccaaatatctacccacccaaattgtggttttcttttttgttctttttttttctttttgagatggagtctcactatatggcccaggctggagtgcagtggggtgatctccgctcattacaacctctgcctcctgggttcaagtgattctcctgcctcagtctcctgagtagctaggattacaggcacccatgaaccactgtgctggggctgtttttttttttcaaaatgggttctcactctggttgcccaggttggagtgcagcggtgcagttttggcttactgcagccttgacttcccaggctcaggtgatcctcctgtctcagcctcccaagtagctgggattctagatgtgtgtcatcacgcccagctaatttttgctttattttttattttttggatatgcagtctccctctattgcccaggatggagtgcaggggcatgatctcagctcactgcaacctctgccgctcaggttcaagtgattctccagcctcagcctcccgagtagctgggattacaggcacatgccaccacgcccagctaagttttccttttttcctttttatgagatggagtctcactccgtggccaggctggagtgcagtggcgcaatctcgtctcactgcaaccttcaccttccaggttcaagtgattctcctgcctcagcctcctgaggagttgggattacaggcacacgccaacataccctgctaatttttgtatttttagcagagacggggtttcaccattttggctaggatggtctcgatctcttgaactcatgatccgcctgcctcggcctcctgaagtgctcggattacaggcgtgagctaccacgcctggccaacttttgcatttttcagtagagacggggtttcactatgttgggccaggctggtcttggactactgacctcaggagatccacttacctcggcctcccagagtgctgggattacaggcgtgagccaccgtgcccggctaattagagactgggtttcaccatgtttgccaggctggcgtggaactcctggcctctagtgatcctcctgcctcaccttcccaaagtgctgggattacaggtgtgaaccaccacacctggcccccttttcttccttacaatcgtgcagttctaactcagcgttcagagttggatttttcacttggggtagaagcaggagaggtggtagaaatgcctcttgactcatacagcacaccccaatttcatgcagtgctttgggctgagccaagtctgcagcaggcagaaggctctgagaagttgttgcagcctgggccaaggacaattcagagcttgggggcacaggggtgtgctcagcaggactgggtggacaggccctttgttgcgaaggggaagagtacaggcttccaggagcaggtgtttgaggcttctttgggaggtggccagaggagatgcctgttttctggggcaggatttggagggagccacccaggctggagaggttcagccaggctgtcacaggctttgaagtttcccatctgagagcctggctgttggagagtgtgggtttggaacttgaggctagggggttcttttctgatctgtgccagccacagccttcggataggcagagcaatgatgggggagggcgtaaaagaagaaatgaactgaggaaagagaagaggaaaacaggcttcaacaacagtctaggctgggtgcggtggctcacgcctgtaatcccagcactttgggaggccaaggtgggtggatcacctgaggtcaggagtttgagaccggcgtggccaacagatattgaaaccctgtctctactaaaaataaaacaattagcggaacacagaggtgggcgtctgtaatcccagctacttgggaggctgaggcaggagaattgcttgagcccaggaggtggaggttgcagtgagccaagatcatgtcattgcactccagcctgggctacagagtgagattctgtctctcaaaaaaacaaaaacaaaaacagtctgtactgtggaggcctcgggcaggtgccaggagctctgagcacagacgggtccctctgttgggtttttcttcccttctaagggccatttcttcttatttatttatttattttttgagatggagttttgcacttgttgcccaggctggagtgcaatggcacaatctcggctcaccacaacctctgcctcctgggttcaagtgattctcccgcctcagcctcccgagtagctgggattacaggcatgcgccaccacgcccagctaatttgtatttttagtagatatggggtttctccgtgttggtcaggctggtctcgaactcccaacctcaggttatctgcctgcctcagcctcccaaatagctggggccacaggtgtgtgcggccatgtcaggctaagtttaaatttttttttttttttccgcaagatggagtcttgcttgttgcccaggctggagagcactggtgcaattttggctcactacaacctctacctcctgggttcaggcaattcttctgcctcagcctcatgagtagctgggattccaggcgcatgccaccatgcccagctaggttttttttgtatttttttgtagagatagacttttaccatgttgaccaggctggtctcaaactcttgacctcatgatccacccgcctcggcctcccaaagtgttgggattacaggcgtgagccaccatgcccgcccctaatttttaaatttgttgtagaaacaaggtcttgctatgttgcccaggctggtcttgaactcctggtctctggtaaaactcccaaagtgctgggattctaggcgtgagccgccttgcccggcacttgcaccatttctctgcatgcgtctccactcccactgcccaggacctgtggacttagatttgagtcactgctgagcacctcgcacctagccccatgcctgcctcccagcctgcactccgtttgcttgatgcattaataaatatccctcccaaatctgcatccatccacctcctgtgttcaagagctgtttcagggcgtcaacctcatttttgccagtgtccagcctagtgacctcagctctgtgtacctggaagagtggctgctcctctgggggtataggattcggagatgggggtagaaggagtgatgttagagagctcggtctaggactagaggatcatatgcccttatgtaaaatacatctcaagttagggaagaaagcagcggctccatgcttttttttttttcccctttgtttttgtttgtttgttttgagacagggtcttgctctgtggaccaggctggagtgcagtggcatgatcttggcccactgcagactcctccttctgggttcacgccattcttctgcctcagcctcctgagtagctcagactataggcgccggccaccacgcccggctaattttttgtatttttagtagagacggggtttcaccgtgttaggatggtatcgatctcctgaccttgtgatctgcccgcctcggcctcccaaagtgctgggattacaggcgtgagccactgcgcctggccgctaatttttgtatttgtagtagatagagttggggtttcaccatgttggccaggctgatcttgaactcctgacctcaagtgatccacccacctcggcctcccaaagtgctgggattacaggtgtgaaccatcgtgcctggccccgtgttgtgttctggcggtggaagatgggacagagaggatgggagggtgtctgagccattcctggactgatggaacctgtttcttctgccttttgtggacaggatggtgatcgctcacaccaaatccttggacccctcccggcctgtgacctttgtgagcaactctaactatgcagcagacaagggggtgagcctgggggtccccaccccacttctccctgcctttgcctgggcttgtcctgaagcctggtcatgggaacagccaggaagaaccatgcgctgccagtctgggttttatttcattttcttttttacttaaaaagatagagacagggtcttgccatgttgcccaggctggtctccaactcctgggctcaagcaatcctcctgccttggcctcccaaagggctggggttacaggtgtgggccaccacaccccggccgcagccagtctgttttcacagatggtctttgggttaatgagaattctccccctgcttactcgccaggcagtgtggctttctcaatccaaggaggctgggcatagggagatgggatttgtttgctcagtttggactcagcattttttgcacttcgatttaatagactcataaaacatcaaagatttaagggagcttagagttcatctggcccacacctggctgatgagaatctctaggggaagtttttatgaaatgccagatctctgcattctgaggtcctgatttagtacgtccagggttggaacttgagtttttctttttcttttgtagaggcaaggtcttactctcttgccctggctggagtgcagtggtgcaatcacagctcactgcagccttgaattcctgagcccaagtgatcctcctgcctcagcctcccgagtagctgggactccaggttttcaccactgcgcctagctaattttatatctttttgtagaggtggcatctctctatgttgcccaggctggtctcaaagtcttgagctcaagtgatctcctgccttggcctcccaaagtgctgtgattacaggcatgagttgcagtgcctggctgacattagcattctttatttatttatttatttattttgagatggaatcttgctctgttgcccaggcttgagtgaaatggtgcaatctcagctcgctgcaacctcgtcctcccaggttcaagcaattctgcctcggcctcctgagtagctgggattacaggtgcatgccaccacacccagctaatttttgtattttttagtagagatggggttttgccatgttagccaggctggtctcaaactgctgatctcaggtgatctgcccactttggcctcccaacgtgctgggattacaggcgtgagccaccacacccggccagcatttttactagaaagaaatgtgttcaggacgcattagaaactagccagttggacacagaagcccctgctgctcagctgtaagcaccgctatgctgaagcttggggtggtcctactcggtcgtcaccgccctgctccttggagtgacttttctggccctctgcagtccacagtgctgccttgtgaaagctccctcaagatcctctgtgacagccgggcatggtggcttacacctatcatcccagcactttgggaggccgaggcaggcagattacttgagatcaggagttcaagaccagcccagccaactggtgaaacttcatttctaccaaaaatacaaaaaattagctgggcgtggtggcgcacgcctgtaatcctagctactcgggagactgaggcatgagaagcacctgatggtgggaggcagaggttgcagtgagctgagatcgcaccactaacattctagcctgggcgacagagcgagactctgtctccaaaacaaaacaaaagattttctgtgagaatgactgcatcggcccctcgggtggcagcgcttctccagggcaaggtgaggggaagcccagtgatgggagtgctgcctggagaggagtcagttccagtggtgggggccctgggctttggctgagggctgtgcgttggcagctgctgtgcctctcacagcccttcccagcggcgcacgtcatgagtgtcagtgtggagtcccaggcctacctcctctgggccactttgtgaccatgtttcttgcctatggcagggtaatttcaggatctaaattggtacacttggacgttctcagccccaggaggcagctgttcccgttctaggtttttttttttttttttttttggtagaaatgggggcttgtgatgttgcccaggctggtctcgaactcctgggatcaagtgatcctcccatcttggcctcccaatgtgctgggattacaggcatgagccaccgtgccctgctaattttcttactactattttttgtaatgctgcagtcttgctgtgttgcccaggctggtcttaagccatcctcctgcctcagcctcccagagtgctgggattacatcccccttaccttctctgccagaggagcccccgcagtgtgtgaatgctgagtcatgctgtctactgagtgctgaacgggctctgctgctctggtcctaggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcagggtttcaccaggtaagcagtgttgagctttctgcttgtgtgttctctcagggcagagatgtcactcacctcctccagcctgacctgcgcccactgcactgctcccctcgcttcagctttgggctctcctcccacggccccgtccacgttccctcaccgccaacagccaggcctgtgccccactcacttggtcctcagaggtggcctccttactggctttgtttccagatagcctcctatcacccgtgcccaagtggtctttctaacagatccaaatttgtatttgtttttgagaccggatctctctgtcacccaggctggagtgtggtggtgcgatcactgctcactgcagccttaacctcctgggctcaagtgatcctcccacctcagcctcctgagtagctgggaccataggcacatgccaacacgcctggctaatttttttacttttgtagagatggggtcttgccatgttgcccagactggtcttgaactcctggcctcaagtgatctgcctcaggctcccaaagtgctgggattacaggtgtgagcctctgcaccagccacagttgaaaattttgggagtcctgtcattggctcccccaggcccacaggacaaagccctaacctctggtcaggacactcagtgtcctctgctctctcctgggttttcatccccttctcccctctatcccagccactgatctgtttccactgccctcgcttgctctcctgctcttgcttgagctgtttcttctgcctggaatgcccatgttggcaccataatcaccaactaaaatatcctttttcttaattttcatattttagatatagggtcttgctatgttgtccaggctggtctcaaactcctggactcaattgatcttcctgccttggcctccaaaagtgctggaattacaggcatgatccactgtgctagcctttttttctttttctttttttcagggtcttgttgtgttgcccaggctggagtgcagtggtgtcatcatagctcactgcagccttgaactaaagggctgaagtaattcttccacctcagcctcctgagtagctgggacgacaggcatgaaccaccatgtgcagcctatttttaaatttttttgtaaagatggagtctatcaggctggtctagaactcctggccttacgtgattgtcctgcctcagactcccaaagtgctgggaatccaggcatgagacaccatgcccagcctgtcgtcatttttttaatctatctcatttttttgtcctcctcaccaaagatatgttggtttgtcttgtgaggttttttttttcctgtggattcctgaaccccatccagcccctcattcccaccccagccagctcacacttgtttgtcacagctcctggttgacacacagggaacagccacccacagtggactgcgctgttctgtttgcacccttaaatttatcgtgcttacagaatgccacttctgcaaactagtcaagtaggggaagtggctcttggatatatttgcttgcgcatcctctttgaaaaggtaaccagctctgaattctttttttttttttgacacagagtttcgctctcgttgcctaggctggagtgcagtggcgcgatctcggctcactgcaatgtccacctccctggttcaagcgattctcatgcctcagcctcccgagtagctgggattacaggcatgcgccaccacgcccacctcattttgtatttttagtagagatgaggtttcaccatgttggtcaggctggtcttgaactcctgacctcaagtgatccgcccgccttggcctcccaaagtgctgggattacaggcatgagccaccgtgccaagccctagctctgaattcttaagaaactcttgagagggtctaggtcagtgctgatagaacctctgcagtgctgggcatggtggctcacacctggaatgctggcactttgggaggccaaggtcagaggatctcttgagcccaggagtttgagaccagtctgtgcaacatagaccccatctctacaaaaaatttaaaattagttgggcatggttatgagtgcttgtagtccaagccacttgggaggctgaggtgggaggattgtttgagcccagtaggtcaaggctgcattcagctatgattgcaccactgtactcccacctgggtgacagagtgagaccttgtttcaaaaaataaaaaaaaacaaacttgcaatgatggaaatgttctatatttgcactgtctgaaatggtacacactagctacacatggctactgaggtcttgatatatgactaggataactgaattgatttagtttaattaaataaatttttttgagacagcctcactctgttgcccaggctggagtgcagtggcataatcacagctcactgctcaacctcctgggctcaagcgatcctccctccttagccccaagtagcttgaactgcaggcgtgcgccaccacacctggctaatattttgactttttgtagagactgggtctcactgtgttgcctagactagtcttgaaatcctgggctgaagtgatcctcctgtctcgacctccaaaagtgctggcattacagacctgaggtaccatgcccagcctggtttggttgagtttaatttaatttaatttttatatatatatatatatttattagagacagggtctcactgtgtcacccaaactggagtgcagtggtgtgaacacagctcactgtcgctttgatctctggggctcaagcagtcctccaacctcagcctcccaagtagctgggaccacagatgtgtgccactaggcttggctaatttttgtactttttgtagagatggggtcttgctatgttgcccaggctggtcttgaacacctgggctcaagcagtcctcccacctcagcctcccaaattgctgggatgacagacatgagccactgcacctgactgaaagacatatttttgcctgtagtgtagtttagccttaagactgtaccagcagatagaggtggaaaagtaatgtgaaacgaatgtcaaattacgtttataaataaagcagctgctcattaaggttgtttttttttttaaacctccttttttattctgggttacatcattccctggctgtctttaccccagcatcagtgagtcctgcagtcactatagccccctgtgaagacagatattttggtcaccatcaagtggatctttatttttatctaacatttacaattctgccagttctgactcttacattctctttgccttgaatcctaggatccacctctgatgttcactgaagagtaccagaaaagtctgctagagcagtaccatctgggtctggatcaaaaacgcagaaaatacgtggttggagagctcatttggaattttgccgatttcatgactgaacagtgtaagtggcagtttggctcatgggataacgtacccgtcctcattttttcaggttgcctttccaattctggccatttcaattgtaagaatattggaaacaaagttggggaagctggtttaatccatgtaggttgcgttgagaattttctaggaaaagtaagttgtgtttaggaagtaggaaagcaatcaggcccccgcctcccaaatacggtcaaaaagcaaacaggagagtcagctatagtgaatcggaaatggctggcttgccttttccttgtctattttgtagccaaggaggaacgaaaaacgggacctcatcatggatttacttttgggatacactcattattccatagaagggtacaaagcctgagaaacttaaggtatttcagtctgttgtatattacttgcgaaaagcaggcttatcaaatacaggtgagtttcaacgcatcttgaatttggcagcatttacaagtcttcaggccaggtgtagtggctcacgcctgtaatcccagcactttgggaggtcagggtgggaggatcgcttgaggccaggagttcaagaccagcctgttcagcatagcaagaccccatctctacaaaaaataaacagattagctaggcgtggtggtgtgtgcctgtagtctcagctgcttgggaggctgaggcaggcggataacctgagcacaggagttggaggctgcagtgaactatgattgcaccactgcacaagagcctggacaacagagtgagacttgtctttaaaacacaagattggtcttcaaagagaataacatctgcggtgtcttgtgaggatggatgaggggctgccaagttcgcaatgaatgtgtcccatttcttcttagtttatggacttaccataaactgaagatagcagtttggtgggttggagaagcatgtggtaatggtgggaattataatacattacttacagggaaagacaggcctttgaaaggtaaagcgtaagagtgagaatggaatacggatgaatgaatgaacaagatgaggtgagaaggaagaggtaaagggaaaaggagaacaggaagctgtcctctgcgtggcacctgtgataaatggtttctggggacatccctgatggcagttttgtggagaggtgcgaggctttatgcggtaagaaatgagctgcaggctgggcgcagtggctcaagcctgtgatcccagcactttgggaggccaaggtggacagatcacctgaggtcaggagtttgagaccagcatggccaacatggagaaaccccatctctactaaaaatacaaaattagccgggtgtggtagcgcatgcctgtaatgccagccacttgggagactgaggcatgagaatctgttgaacctgggagatggaggttgcaatgagctaagatcacagcactgtactccagcttgagcaatagagtgagactcttttttttttttgagacggagttttgctcgtttcccaggctggagtgcagtggcgctatctcagcctactgcaacctccacctcccaggttcaagcaattctcctgcctcagcctcccgattaactgggattgcaggcatgcgccaccacacccggctaattttgtatttttagtagagacggggtttctccatgttggtcaggctgggcttgaactaccgacctcaggtgatccgcacatctgggcctcccaaagtgctgggattacaggcatgagccaccatggccagctgaaactcggtcttaaaaagaaaaaagaaatgagctgcatcacgttgggcaagtcacctaagcttttcataagcctgtccagtggggataatgccacctccttgttggtgtcgtaagggctgcatttgatgaagtacttggcgatgcctgtgttcacttatggaagaaacagtcttgaaccttttggtggggaaagccccctttccatttaacatttccatttagtggtggtcttactggggacagagaatgtcctgagagcacagccctgacaggtcgttgccagctgtgctcctccaccaggctcagctcaggcctaatgaccaccagtggtgggtgctgccaagctggacgtcagccccggcggactttgaactccatgagtaggtcccacgcagggacctgtggctggtcaggaccctggctcccactaggcgctatctcttcagaaaggcccaaggcttttcaagggtaactgtcccagatacccctagccctctgcctacccagttaccagacagctgggtacccagcatgtaaaccttagtttgcaaataaaagataaacttttagtgctttttttttttttggagatggagtctcactctgtcgcccaggctggagtgcagtggcacaatctcagctcactgcaacctctgcgtcctgggttcaagcgattctcctgccccagcctcctgagtagctgggaccacaggcacccaccaccatgcctgtataatttttgtatttttagtagagatgaggtttcaccatattgtccaggctggtcttaatctcctgaccttgtgatccgcctgctttgtcctcccagagtgctgggattacaggcatgagccaatgtgcccagccagtttttgtatttttaatagaggcgggtttcctcatgttggccaggctgatcttgaactcctgacctcaggtgatccacctgcctcagcctcccaaagcactgggattacaggcgttggccaccacacctggccactgttttgggtttttttcccctaacagactagaaaactagaaattaacacaccagggaacctgggtgtttgggcagagcagtggtatttaaatatttcaacccataaattgtcacttcagagcaagcatcctgaaactgtaagaggacatttggctgagcatggtggcttgtgcttataatcccagcactttagggaggctaaggagggcagattgcttgagcccagtagtttgagaccagcctggacaacataatgagaccttgtctttactaaaaaataaaaataaaagattaccgggcatggtggtgctggagaggctgaggcaggaggattgcctgagcccaggaggttgaggctgcagtgagctatgattgtgtcaccgcattccagcctgggcaacagggagaaaaaagaaaaaaaaagacatttctatttagtgcctaccttagctccagactggttctaacttgacccatcagaagacatctgaatcgctttgtgtcttttttttttttttgtagcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcctgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtggctactg

SEQ ID NO: 36212 - DNA, 239255 bp, Homo sapiens
aagagaagagagggagaaggcacactgaggaatgccaaggactgccagcagcaccagaagctaggagagaggcacagaacagactcctagcttctcctaggctccctctgagcctccaggaagaaccaatcccggtgacatcttgattttggacttctggcatcagaactgtgagagaataaatttctgttatttttaagccatcaaatttgggataatttgcaatattgtatttctttcctagagctgctgtaacaaaagttaatatatgtcaaacctgggaggtttgtgtgtattttctgtatttctctccatattttaaatacccgaggaagaggtttgcaggtgcaaaccttcagtaaaatgccctttaatgtctctcagctgcttttggctccagatatacgggtacacttgatagtggaaactgaagtcagttctctgttccattttctcctttgcctaactctggccatttaccaaagagttgctagcgtcttggcttttggtgttctctatagcatgttcaaaagttctgacatcaagcccagaatcaacattttccagaatgattatgtaactgtagtaggtctgttgcctgatgaattggggcaggtcaatacgccaagacaccaggttgcagaaaagaaagcagtttaattgtacagctgttgaacaaggagacgggaggaaatctcaaatctatctccctgaggagtctggggctagggtgtttaggggttttagagtggtccaaagtgtggagattgttgattggtggaagagtgcagggtggtgtcgggacagggggatgaagaaactgtattctcttgcggattccattcctctataggggccttcaaactgggtggtgtcagctatttccctggaattcggaatttggaaaacatcttaagcaagtcttaaaagtcttatgactctaatgtcacagatcttatctttggggacagcagggatgcaaatgggcagtatctggagctacatagcttttggttgcaaggaagtgggtcaaagtatagtctgactaatgcttaattataactatatttctgcccaggattcttgttaactctgtgaggatggcttcaattgcaaagtcttttattatttctttgttatttgtgcaaagcaatgaagtgtcatttaatgtattttgtagcagttaatggataaaaagagttagatggtgggcctctggaaataagtattagcttttcaaatgaataattatggaagtaatcactttttattagtcttttttttttactgtaatttgcatttttctggaatataaatttgacttgcaatgggaactcctactaaacagaggtagtaccttacaaacatgggtggaacctaaggaagggcaagaacagcaaggccttgtgcatggtagaacctggagctttgtgcaaaatcagaaagtctttctttcaatcagcttcctctgctaactcgccatgccaatgacccaagatggcacagcatgcctagtgaggtacgatttttaaaaattgattgagaggtgtctgtgttcttaggcggaggcaatacctaagccaggaggaaggatttgtttttatgagagggctctcttgaatgctcctacttagttgtgcaaatgcaaagtttgcaccctttctcttgaggaaaggacttcctaggactgaagaacagagattctgtccatttttccttagaattgaagtccagtagctcatcagggtcaaccaaagtggttctgtcctctggcagaacaggataccacagcttccaaaagggatggcacccggagggaagagtgagtttaagctggcagctagaactaaacacaaaatggcaacagttggattctctgaggcccagctctcctggcattgagttgaatatgtgaatgcaagtcaaaaaagttctgatcttggaggccaagcattagactctgggctgaggaagacaggcaaatatccattagcctgcacaagactggcactgaatgttgaggctgtgtggcagggatcagactcatactgctgtgagctcatgagatttccagttccttcctttttgaggtttgatagggtcaattcttctgcaccaagaaagcccctgagagttttggacaattaagtgggaaggcctcactgggcaggtcctggaaaagaacatgtgacgacttgagtaaaatattggaaaacaaaagatgtaagaccatattgttccctgaggtggagaggtgtgtcttataggacacgcatatgccctttcagttcaagaatctaccactgagtggaaattcccaagtgcatgaatctaattagcttgaccaggtcagatgcccaattctgttccatgcagctgggacctcctaagcagggaggccaattggcagagttgagtaggcaggcattgacagaaaggttatcctacatgcaacacagaattttttttttaattacagttcaaccactagcttagcaaaatatatctccagagtacaaaatgctaccttcacagattcaaacaaccattatctaataacataggctaaaaaagagacagtcagtgttgctcagaacaacacagacaactccagaaggacatgagtttaaacgctgtcaactgaactgaatcacttgggaaaaattaatcaatctgaacctcaactctcccatctgtaaagtgaccacaataatacctacttaataaaagagttctaaatattatttatctttgggtttttttagagacaaggtcttactctgtcttccaagctggagtgcggtagcacaaccatagctcactgcagcctcgaactcctgggctcaagcagtcctcccacctcagcctcccaagtaactggggctataggtgtgcaccatgcttagctgatttaaaaaattatttcagagatgaggtctttcagtgttgctcaggctggtctctaattcctagccttaggtgatcctcctgcctcagactccagagtagctgggattacaggcatgcctaacaggttgtgaatattaaatacagtaacatctacaaaatgccttgtccctggcctacagcctattctcaggaaaaggtcaatgttcttttatttatttgtttattttttgagatggagtcttgctctgtcacccaggctagagtgcagtggcacaatctcagctcactgcaacctctgcctcctgggttcaagtgattctcctgtctcagcctcccaagtagctgggataacaggtgtgtgccaccacacctggctaatttttgtatttttagtagagatggagtttctccatgttggccaggttggtcttgaactcctgacctcaagtgatccacctgcctcagctttccaaagtgctgggattacaggtgtgagccaccgcgtctggccttcagtgctatttttaactatactaacaagagttagcagtgttcttccaaggtgtctaatatactccagggtattgttctctgaaatttgtaagcgctttcagactctttgggaaaatgtactatactggaaagaaattttatttgtgttgtgtttctggtttactgactaagttgtagaggtaagacaagggagggctgtaatatttttctggctgttcgactgttctaaaatggggagtgaattagtcagaacttttacagttgcaagtgaaagaaatccaactggcttaaacaaaaaaaaaaaaaaaaaaaaaaaaaaaaaaggagatttactaactcatgactaactcatgtaaatgaaaaagcccaggggtatcgtgactcccagattatttggactcaggtacacataagtcaaaaccagaaagcttttggtcatgctttctcctgcatggatgcattgttagacaagctctcctgcagttgtagcaaatattccagaaggaactccaggctctcattctattcactgaaaagagatcatctctttcttaatagtttcagcaaaaaactggaggaagtttctcattggcccaagttgagtcacatgcccatctctgaaccaatcatgaggtcaggagataaattagccagggctgggtcatgtatttatcattagagcttggggctggggtaagggtcagctccacctcaactacatggaggggtagtagggagtctcaaagcttgattgggacacttttaccaatagaaagagggtgggaatggtatgccagagaggcattaaacaaacagtccctgcagaaggaactgcagctgtaggagaaaagttaaaacaaaatgactattctctgattgttttgctgctacaaaatgattttgtatctacctcatggtagccactgaaatttattttctaattccattttaaaaaattatgtaaatctgtttgagaatgtattctaggatgacaaaaatgaggccaactacatgaagattaacttatcagaagctgcaaataaattgattattttacataagagtagtttcattctagctggatgatttttgtatgcatgaccactaccctaaccatcctattataacaaaggaaattgccatctgccactttgcttgtatgaaatatttctggaggtggcttgccaacttcagccagaattataaaactaatgagtttttagctaccatatgcacagagtgtaataatagcaggttctaggcaaatgttgtctacttgcttctggaagtgctttccctccatgataggagcagatgcccaagcctctattaagaattctgttttcttcataaatctgtacagtgacatggagtcctcatattctcatgaagtgagttttatatggaaaacatggccctcattaccctgtttcttatggggttttcagcctctgttttgtggagactggcccttattatgtcaggatagagtaccagatgccttttaggaaatttggccagtttgaaatttctaataggtcttctgctcttttgatgctttactgatttatgtgaaggcaaacaagattttaatttcctaatactacttgctatttatattaaaatgtctatttgtacctacaccagtgctttatgctataacagtcagaataggttagattatgtggttgtaacaaaggcccctgaatgtcagtggtttacaataaagccttatttctcattctcactacatgtttcaccattttccatagattaacatgcaatttgtttccttggggctctagttcatgggactccaccaggggaaatccattaatactcacaggagaatattaggggggtggtgagagagtattatatcgatttataatttaggatgcttaaaaaaaaacaaacctaataccagaaaatctagctctgtctactgatagttcctagaagcaactacagcccatgacaataagcacacctagatgttggtttctaaattccattcagcaatgatgaaagaaatcagggctccttggaaaaatggctgattctcagtttaggtcagggaaagattgtttcagaaaataaagacacattaaggaactgaaaatgatgtgtgtatgcactcaacgattgatggacatttggattgttttcactttttttgctattataagtaataatgtatgaacatccattcataaataatgtataaacgttagggtttttttttgtggacatacattttcagttctcttgtatgtatagagtggaaaatctgggtcgcagtaactctgtgtttaagtttttaaagaactacaagactgttttccaaagcagtcatgccattgcaccttcctaccagcagtgtacaaaggttccaacttctccacatccttgctgacacttgcctttttccttttttttccccttatagtcatcctggtgggtggctatctcattgtggttttgagtccctgatgactaatgatgttaggcatctttagtatgcttattggccatttgtgtgtcttctttggggaaatgtttgtgcagatcctttgcctgtttttaaattgggttttctttacattgttgaattgtaagagttattatatattctgcatacaagacccttattatacatatgatttgcaagtattttctcccaatttgtgggttgcttctcactttctcactgatgtcctttgaagcagaaaagtttttaattgtgatgatacccagtgtattttttttatcattacctgtgcttttagggtcatatttagtgcctgccttgagatatttgattcattttgagttaatttttatatatgatgtgaggtaggggtctataataaattcattcctttgtatatgaatatccagttgttccagaaacattttttaaagactattctttcctcattgaattgtcatgaaacccttgttgaaaaaatcaattaactgtaaatgtgaggatttatttctgaattatcaattatatttcattgatatacacatatgtctatcactaagccagtatcactgtcttgattgctatagctttatagtgagttttgaaactaagaaatgtgactcttccacagttttgttctttaagattgttttggctcttctgggtctcttgcatttccatataaattttaggatgagtttgtcaaattttgcaaaaattaaaaaagtagctgggatttttatagggattttgttgaatctgtagatcaacttggggaatattgccaccttaatgatattaagacttcagatccatgaacatgggatatctgtccatttatttagtagtttactataatagaaggataaggtttaagaattaggactatacaaagcagtctaaagtttcaatgcaatccctatcaaaataccagtggcatttttcttggagaaaaaaaaaattatgaaatttaaagacccagaataatcaaagcaaccctgagcaaaaagaacaaaactttagcatcacattacctgacttaaattatactacaaagctatagtaacacaaacagcacagggctgacataaaaacatcaaccaatggaacagaatagataactcagaaataagtctacacatgtatagccaactgattttttacaacagtgccaagatcatatattgaggaaaagacagtctgttcaaaaaatggtgctagaaaaactggatagccatatgtggaagaatgaaaccaagtccctatctctcatatatacaaaaatcaaatcaaaatggagtaaagacttaaatctaagacctcaaagtataaaactactagaaaaaaatggggaaatgctccatagcattggtcggggcaaagacttcttgagtaagacctcaaaagcacaggcaacaaaagcaaaaatagacagataagatcacatcaaactaaaaagcttttggacagcaaagaaaaaaatcaacaaagtgaagagacaacacagaatgggaaaacatataactacccatctaacaagcgatgaataaccagaatatacaaggagctcaaacaactcaatagcaaaaaaaaaaaaaaaaattgattttaaaatgtgcactgctgggagtggtggctcatgcctgtaatcccagcactttgggaggctaaggcaagcagatcacctgaggtcagaagttcaagaccaccctggccaacatggcaaaaccccatctctactaaaaatacaaaaattagctgggtatggtggtgagcacctataatcccagctactcaggaggctgaggcaggagaatcgcttgaactcaggaagtggaggttgcagctagctgagatcttgccactgcactccagcctgggcaacagagtaagagtccttccaaaaaaaaaaaaaaaaagtgcaaaatacctgaatagacatttatcaaaagaagacataaaatggccaacaggtatgtgaaagaaaaatgctcaacctcattaatcatcagataaatgcaaatcaaaactacaatgagatatcatctcaccccagttaaaatggcttttagcaaaaagacaaaaaataatggatgctggtgaggattaagagaaagaggaatccttgtacactgttggtgggaatgtaaattagtacaatcactatggcaaacagtatggaggttcctctaaaaactaaaaatagaactaccatatgatccagcaatcccacttctgggtatatagccaaaagaaagtaaatcagaatatcaaagacatatcttaggctgggcacagtggctcatgcctgtaatttcagcactttgggaggcagaggcgtgcagatcatttgaggtcaggagttcgaaatgagcctggctaatatggtgaaactccgtctctactaaaaatacaaaaattagttgggcgtggtggtgcatgcctgtaatcccagttactcaggaggctgatgcaagagaatcacttgaacctgggaagcggaggttgcagtgagccgagattgcaccaccatactccagcctgggcgacagagcgagactccatctcaaataaataaataaataaataaatagactatagttaataatttatattgtatatctcaaaatgactagaagagtagaattggaatgtttctaacacaaagaaatgataaatgcttgaggtgatggatatccaattatcttcatttgatcattacacattatatggttgtatcaaaatttcacatgtcccccataaatatgtaaactattatgtagccataaagatttaaaaagaccactttgggaggcagaggggggtggatcacttgagcccaggcattcaagactagcctgagcaacatggcaaaaccctgtctctacaaaatacaaaaaaaattaggcaggcatggtgatgtgcgcctttggttctagctcctgggcaggctgagatgggaggatggcttgagcctggggatgtcaacactgcagggagctgtgatcgtcccactccagcctcggcaacagagcaagaccctgtctcaaaaataaataaataaataaataaaaaagaattaggaaatagtaggttttgcttaattacaaatttaccctgaaatcccaaagacttaacaccacaaaggtttctttctaatttgtgatgcatgtctagtgggactggggttgtcttcccacatagccattcacagacccaggataagggagtctacagcattttatagctggcttgtaggttgccatgagaaaagaagggagaattgaaggatcatgcatcagcatttaaaagcttcactcaaaagggacatatgtattttttgtcaacagctaattggccagaaccagtcacacaatcctgactgactataagaggcctgggaaatgttgaggaacgcatgggtatttggtgagcagtaaatgtgtcctccaaaaaattcatatgctgacgccctaaccccccatgtgactgtatttggatatggtgacttgaaggaggtaataatggttaaataaggcccaataagggtagggccctaaccggataggactagtgctcttataaaaagagacagagaccccagaaatgtttttttccatgtgtacagaggaaaggtcatgtgaggacacagtgagaaggtggctgtctccaaatcaggaggaaaggtcctaacaaaaaccaaccctactggcactttgatcttggtttccagcccctagaactgtgagaaaataaatgtgtgttgtttaagtcactcgttaaggcagcctgagctgagaaatatgcatcagccacgaagaggaagggaagactagaaaaatagatcggaccatattgtagaatgctttaaattaatccatgtttaatttttaggcaatggaaagctttggatttttaaaaaatagcttataaagcaatgcatcatcttctttcctccaaggtgttcatgaagtttcggtgaggtgcagggcagtaccacaataggcactcctttaaatgtttgattcataaggattattgaagtcatacgccgagcatccagctctgaccccaaatctagttctttttcatttttttgttccttacgctgtcctttcagggtagttccccagatgaaaagtgggccaccgttaccagaagaaaagcaaatggacagtgtctaagtaatgataacagatattcattacacttcctggtaaaagaaaataaaggataactatgacaaaaccagaaatgtgctctctgctcccagaaatgtggaatgctgtgtgccactcaagtccattacttattcctagagattattaacatataagccccaatttttctctgtggaaatttgtttcttaaattttttgtagagacagggactcaccaacttgcccaacctggtctcaaactcctgggctcaagcgatcctcccaccttggcttcccaaagtgctgggattacagacgtgagcctggcctctctgtggaaattgtaaaaatatataattttatttaaatatgtgggtaggatgaggaggttttgtttatttgtttaggatagggtttttagggggtgagaggggcaatgaaggaggcttggtttctccttctcccacatcactacctgtattacaaatcaccttcccaacttaatgactcaaaaaaaaaaacaaacactatcttcatagttgtatgggtgaggggaaacttggctggctagttgagcagttctaagtctgcagtcctctaaaggcttgcttgacgatcaaggatctacttccaaggtgtcacactcacataattggcaagttggtgctggttgttggtgggaggcgatagtcctccccatgtgggtctctctatgaggctgcttgagtgtccccacatgatggcttactctcagagcaagctaccaaaggcagcaaggcagaaaccgtaacatcctttatgactttgtctggaaatcatacactgtcacttctgccatattatgtttgtcacacagacagctctcattccttgtgggagctgacttcgaaaaggcatgaatatcaagaggcaaatcaccagggctcatcttgaaggctggctgccatgctgctcccttcatattgatgatgtagtacacatctttgggaggctgaagaatggtccctaaaagatagcagggcctaattcccagaacctgtaaatgttatcttacatggaaatgttatcttatatggaaaaagggtctttgcagatttaactaaattaaggatattgaaatggaaatattattctgagttgtccaggtatgccctaaatgcaatcagagtctttcaaaaagagtacaatggacagaatgtttgtgtcctcccaaaattcctatgttgaaaccctaacccccaaagcgataatgttgggagctagagactttgggaagtaattaggtcatgaggttagagcactcatgaattaaattagtgcccttaaaaaaggaccccagaggccaggagtggtggctcacacctgtaatcccagcactttgggaagccgaggtgggcagatcacttgaggtcaggagtttgagactagcctggccaacatggcaaaaccctatttctactaaaaatacaaaaattagccagatgtggtggcacgtgcctttaattccagctactcaggaggctgaggcatgagaatttcttgaacccaggagatggaggttgcaggaagccaagatggcaccactgcactccagcctgggtgataaagcaagaccctgtctcaaaaaaaaaaaaaaggtggggggagggaccccagaaagctctcttgactctttctgccatgtgaaaatacaagacattggcagtctgcaacccaaaagagggccctcaccagaatgtgaccatgctgtcaccctaatgctggactcccagcctccagaactatgagaaatacatttctgttgcttataagccacccagcctatggtattttgttatagcagcctgaactaagacagagagagacagagggagactcgattcacacagaagagaaggcaatgtgaccacagaggcagagattagagtgatgcagccacaagccaaggaatgccagcagcctccataatttgaaagaggcaaggaatgaactctcctggagactacagagggtgtgcagccctgccaacaccttgcttttggcctagtgaagctgatttcaaacttctggtctccagaactgaaagaaaacaattttatggggttttgttttgttttaataattggagactgtttattttacttttgatatggttaggagcaaggcctttagagtcaaatcgtcctggatttgaatctatcattgtgatcttgggcatattcttgcaccttatttttctccaaaatggggctagaaaacaatacctacctcaaaggtaaagctttaaaaaattgtgggttttttggcaaaatacacaaaatataaaatttactatgtgctatggtttgaatgtttgtgttccctccaaaatttaggttgaaacttaatgtctaatgcaagggtattaagaggtagggcctttaggaggtgattagttaatgaggactcctctgtcatgaatgggattaaggctcctacaaaagaacttcacacagtatttgccccctttttgcacttttgcctctccacatgaggacactaacatgagggttagtccccccagaggatgcagcaacaaggtgccatcttggaagcagagagcagcccttgccagacatcaaacctgctggcaccttgatcttggacttcccagcccccaaaactgcgagaaataaatttccattgtttataaattacccagtctcaggtattgtgttatagcagcataaatgaactaagacaccaactttttaagtgtatagtacagtagtgttaagtacattttcattgttgtacaaccagtctcttccagaactcttttcatctggcaaaactgaaactttatacccattaaacgacattctattcccctccatctctagcctatgggcaaccaccattctactttccgtctctatgaatttgactactctgttttttttttgttgttgttatttgttgttgttgttgttgtttgtttgtttgttatgcgatggagtctccctctgtcaccaggctggagtgcagtgatgcaatctcagctcactgcaacctctgcctctgggtttaagcaattctcctgcctcaacctcccgagtagctggaactacaggcatgtgccaccacacctggctaatttttttgtatttttagtatagacagggtttcaccatgttagccaggatggtcttgatctcctgaccttgtgatctgcccgcctccgcctcccaaagtgctgggattacaggcatgaaccaccatgcccggccttactctgttgttttaatacaccaagtttgtagcaatttgttatagcagccataggaaactaatacggtattcttccccatctttgtccatgttcatacaactttaaatattcataaatgtacacaaacaattttagtcacacatatatatgcagaaatttttgttattgctttataaaaataagaccatattacacgtactcttctttgttctctcttttcactcaacttgtttattgaattttgttcagaataatcatttcactctgactttgggcaaacctgtttcaaagtacctttataagctttcattagatgttaatgtctgaagcatgttcagagtgctttctctgccatctgacagtggtgtcctctcaattatccaagccctcatgatcagctttgggagttgtgttcctccctcctgctgtctgcttttcatacccttctccattcattagcgcctccaccagaggggggcaaggaaatggaaaagaggtgaaatacgactcccaaactgacaaagagatcaatggaacaggagggtccagaaaccagttctcaaaatggtcatttttccttatgttagggatgctggaagaaacttcagtaataatacctcccaagttacctgtggatttgagagggagaatggtatctactgtctactcttgatttgtaagttcgtttgtcccatttttattataatcattgcaaaaagcaatcccttcataaatgttggaagaattcattcaatcaacaaacacttattaagcatctataatgtggcagcaatcatgccaggctctgaatgaatgaataactcaggtttttgtttctttccctaacaagtgggactcctgttctgtggcactgctgttggaaggtaggaggtaacagtgaaaaagtagggaggataaatgcatcagtttggtatcagtttcctagggctgccgtaaaaaagtgctacacactgagtggcttaaaataacagaaatgtgtcgccttatacttctgtgggttagaagtctgaaatcaaggcagggctgcattccctctgaatcttataggaaaattcttccttggctcttccagcttctgatggttcgctggctgtctttggcatgccttgtcttgcaactgcataactccaatctctgcctttgttgttacatgacgttttccctgtgtatctttgtctttacatggctgtcttttaagaacatcagttatattggattgggggcccacagtactccagtatgagctcatcttaactaattacaactataatggccctacttctaaataaggtcatattctaaggtactaggggttacgactccaacatatgttttagggggtgaggagggacacaattcaacccataatagtttctacttgtcaaatagacaagtcaaataagaccttggaattctggatttcattaatctcgtaagttgttattctctgtttttttgttttgttttgtttttgagacggagtcttgctctgtcgcccaggctggagtgcagtggcatgatctcggctcactgcaagctccacctcccgggttcatgccattctcctgcctcagcctcccgagtagctgggactacaggcgcccaccaccacacccggctaattttttgtatttttagtagagacagggtttcaccgtattagccaggatggtctcaatctcctgacctcgtgatctgcccgcctcggcctcccaaagtgctgggattacaggcgtgagccactgcacccggcccttgtttttttaaggcagcatagtggttagtgtgcaactctggagccagaattagtttgaatactatctttacctcttattaacaggtatgaccttgggcaagttaactaattcctagtgcctcagtttgctgtctgtaaaatggagataataacagaatttacagaattgttataaggattaagtgaactaatgccaggaaagtccttagaacaacgcctggcacaaagagaatcttgatatgtgttagctaattttatgaaaaatgaggaaccatgagttgattattcttgtaatcaattcccactagaaaggggtggtggtgcgcatattgttaaagggaataaagcgttccaccgcgtgcatgtacccgctggggcctccttctaagaggaaccgaacttccgaggagtgggcagctgctcactgcctatgctactaaattgcctttcttggcctctgacagactataaagtcaagagacttccaaagcccccagagaaatatttcttcttttggacaaccaacctctgaaaaacaattgattgaaatgttttcaaggaaaatatatcactattagggaagcctatatatataatttaaatttcctttggttccttttggatttcaacttaaaatgacctgtaggctctatcagagtaagagcaatacatcaccgtgcctgtcttggacattcttaaagcagatttgctctgcctagtgtgacctaactccagccacagcagagcctgaatgcagacttgattccctcagatcgctgaggaaaaagagcatcacaactgacaagacttggagaagagcactctgttctgtatttgtgttggaaactaaacacaataagccatcctctttcctatgaaactgaatgttagtgtctttatgtaggtggagtggaaggtgaggtggagaggatactgaaagagttgagagagagagtgggcacggcggctcacgcctgtaatcccagcattttgggaggctgaggtgggcagatcacttgagcccaggcatttgagactagcctgggcaacatagcaagtgcccgcctctacaaaaactacaaaaattagccaggtgtggtgttgccaacctgtagtcccagctactcgggagactaagatgggaggattgcttgaacccaggagttagaggttacaatgggccatgatcatatgactatacaccagcctgggagacagagcaaggccccgtctcaaaaaaaaaaagaaaagagttgaaagagaacatgattgcaggcggagtcaggcttcagttgctgaatcaaggcccattgtcttgactcacttaaacatcacagaattctttagctggaagaccttgaggggttactaattcaggagttgaagcaaagtatagaaagtaatttgttagaaataataaaagtgcagcttatgactgattgattaattactaaattccaggggattctaagttcttatcatacattggtcctcaaagtatggttcttccaagaccagcaacttcgcatcacctgggaacttaatagaaatgcaaatttttcagcctcactgcagacttaactgaatcagaaattgtagggtggggcctggcaaccaatgattaacaagccctcaaggcgactctgatgcccactccagtttgagaaccactgttaaaattgtatcaatttaacacacctggcattcaggtgtgctttatcaagggagtacgaatgggtgaagttgtatacaactagtgcctggggactggggcacagagagccatgcatgcgcacatgtcattctcagatgtcccattaggataaagacagacagttagtgaccttatctagaccccattgtagagattaagaagctgaggtgcagaagggttacgtgactcacccaagccgtatggatactaagaggcagagaagacactaggtcccaccttgcccagctcagaattttcttttgtcttttttcttgagacaggatctcactctgttgcccaggctggagtgcagtggcttgataaagctcactgcagccttgagctcctgggctcaagcaatcttccttcctcagcctcccgagtagctgaaactacaggcatgtgccaccatgcccggctaatttttttttttcattaaaaattttctaaaactattcaccagagtctgaaagaagatgatggctgctagaggtgagctccacactcctcaagaaagatatggctggagtttgagaccagcctggtcaacataacaagacctcttctctaaaaaaaaaattttttttaaattgctgggcatggtggcatgtgcctgtagtcccagctacttgggaggctgaggtgggaggatcatttgagcccaggagtttgaggctacagtgagccatgatcatgccatagcattctagcatgggtgacagaactagaccttatctctaaaaaaatataagcctcaaactccaggggtcaagtgatcctcccacctcagcctcccaactaactgggactacaggtgcatgccatcatgcccagctaatgtttttttacatgtttttgtagaaagtaattcttactatgttgccctcccgcctcagcctcccaaagtgttgggattataggaatgagccaccgggcccaaactaaaataaatttttttttttaaaaaaaagatataggcctggcatggtggctcatagctgtaatcctggcactttgggaggtcgaggtgagaggactgcttgagcccaggaattcaagatccacctgggcaatactgtgaaacactgtctctacaaaaaatacataaattagctgggcacggtggtgcatgcctgtagtcccagctacctggcaggctgaggttgggaggatcacccgagcccaggaggtcgaggctgcagtgagccatgattgtcatgccactgtactccagcctgggcaaaagaccctgtctcaaaaaaaaaaagaaaagaaaagaaaagaaaaagaaagatatggcctgatatagagccctgtagtctagcggagccagacttggaattcacccattagcaaaaccttttggagataaaaatattttttctaaaaaaaaatttttttagaaaaggctttataacttttcactttggtaagaaggacaattttacaaagtaatgtctactctggccataatttcataaaggagatgacttttttcatagcaaagatgtagatcagatatgaaattaggataaaacaagttttttcatgttaaatacattttgcttgttttttttaaaaaaaaacaaaacgctttttgctgttttcctcttatttcttcatgtgcacagagcactaaaactaaaatgctgtgtacaatcataggaagctcaaatatcttgctaaagacccctgattaacaggggctctgactgcctgccttaccccaaatgcaagctctcatcactaagtaggcatttaataaatgtcctttgatgataaaaattatgaggacagagtgggtttataattttttttacagttaagaaattacatgctagaggtagaaaggacttaaatttcttttccgaagtcacacaaccagttttaaaaggagccggtgctggaactgaagtcttctatctcctggttccaaatccttttcccttagactccactgacattgataaaggacgtctaaaatgatgtcccttatttccttagggggaacatgtttatttacccaggcaaaggtataatgaaatcaaacatcaaggacctattaccagatataaagataacatcaactgaacagatgttgggaaaattgggggtgtcaggttaaagttgcaaaaaggcagcataacagggagtgaagcttgggggcggtgggggaggtgaaggagggggcggcaaggggtgagggtgggggcaggggagccaggaatgtttctctatgataaaacagctgctggagtggccaggctgagcttatgcagatgttaattgatttctggaggtccggaaaggcttgttagacaagctttaaaacgagaggaggccaggcatggtggctcacgcctgtaatcccagcactttgggaggtaggtggatcacctgaagtcaggagttcgagaccagcctggccaaaatggtgaaaccctgtctctaccaaagtacaaaaaattagctgggcgtagtggtgcatgcctgtaattccagctactcgggtgactgaggcaggagaatcgcttgaacccaggaggcagcggttgcagtgagccgagattgcaccactgcactccagcctgggtgacagagtgagactctgtcttgaaaaaaaaaaaaagaggccgggcacagtggctcacgcctgtaatcccagcactttgggaggccgaggcgggtggatcacgaggtcaggagttcgagaccagtctgaccaacatggtgaaactccatctctactaaaaatacaaaaattagcctggcgtggtggggtgcgcctgtaatcccagctattcagggggctgaggcaggagaaccacttgaacccgggaggcggatgctgcagtgaaccaacatcgcgccattgcactccagcctgggcgacagcgcaagactctaatctcaaaaaaaaaaagcatccatttaactcagatatcactagatacatttatgactgagtgtagtctgtgcaaaatagcattgaacaattacacttttgtatgcacctcaatgaagtatctttgtatattatatttctggtgtattaaataagtatagggtaagccatgcatcttaggtgagttcaactacacaagaaaagaaagaggaagtgaacttaccgtgacaaacggtttgatataattcgtggtgaaaaccaaaaggcttcctacaacccaaaccggttatagaaagggagccagtaaaagtaagtaataaaacaatgcttgtttaaatttttgtcgcatgaaaggctctacagcaatgtaaactgtgttacaggcactaacattcttgtaggattcgaggtctctgaattgttgagcatctgtcttcagagtgctttttagtatctaagaatgtaacatggggcaggaagcagagaaatcaaccaaaagtaaggttttcatgtgcccaaaggatgtcaccgcaaagatcataggagataatgtggacatatctgaagaagtgccttctgggctggctgcttatgactgctgtccctggcacatccggctgtatatacctgctggctgaagttactctctcagcctcctggatatattcagcttcaaatgcagcttcccttctccctcctggtaacagtcagagaagcctagatcctgttatcagttcctagatttcttctcaacatttcacggcattctctcaatgaattaaccttgccctaatttaattagccggcaaattctcccttgtaaattgtcctagtttagtttagtctctaggtggttcagatataaggatgttgcaatacaatgcaaaaaagtcagagtccgaagtgtccgtgaacattaagactgggtgtttgtttgtgtgtttgttttgtttgactttgtttttgcacagggcattgtttttgtttactgtggtgcttagcccattggatgtattaattggatatactagtcagagatttttctgattacgtctgaaatcgaaattcttttctttcgcaaatacttgcctagatgtggtcttggtggggagcagccccagccagggctattacacttaaagggaagatactgaccatggctgggtgtggtggtatgtgcctgtagtcccagctactcaggaggattgcttgagcccaggagttcattctctcctatagccgcattctagcctaggcaacatagtgaaacccttgtctcctataaaaaaaaaaaataataaaaaaagaacgtgaaggtgtgagtggcattataaccttatttctctttcagaggggccgctataatacacaccttggttgccacattccagttcagctctattcatctaaaaataatcagttgcttggctgatcatggtactataatgacattcaaattcagaacagtaatacaactttttaacataaggaaaatgtaaataaacataaatgaagacatgacactgtattttgatttacctgattagctaataggaggtacaaaacaggcattcccatacactgcctgtgcctacaagctcctggaaattttgagaatgtgtatcagtattgtcattagtttgctagggctgcggtaacaaagtttcatggattgggtagctgaaatgacaaaaatttattttctttcaattctggaggctagaagtccaagaccaaggtgtaggcaaggttagtttctttcaagatctctcttcttggcttgtagatgaccgttttctctctgtcttcatatggtcttcacttcgtacatattctgtgtccaaatttcctcttcttataaggactccaggcatattggattagggctcacctaatgacctcactgtaactcattataattacctccttaaagatcatatcttcaaatacagtcacattatgagatatgggaattaggacttcaacaaatagacttacaaaaggacacattactgcgtcagattttgtaaactatactaaagaaataaatataatttcttaggttataggagtatatattactttcttataacctgcttttcttacccaatatatatttgaacatttctgtgtatatttaaacacttacaatataaattttcatcgctatctagcattctatcacatagatacctaataatttatttagcagtcctaacttaaacttaattttttgaataagaaaaacattcatatggttcaaaatcaaaacaatataaaaagataaatacttccatcccacccctgttccatataagtaaccccttttattagtttcttgtgtattcttccaatgtttccttatgcaaataaaagcaaatgcaaatacatgctcttatttcccctactttcttacacaaagggaacacactatttacgctgtgctgcaccttactttttctaaaaagcaacatatttctgaagcttctccattatcagtacataaagagcttccccattctctcctatagccagaaaatatacaattgtgtagctgaaccatggtttacttaaccagtgtcttctatacaaggttgtctctaatttttcttctgttgcaaacagaggggcaaagaataaactcatacatgtcatttcctacaagtacagatgtattgctaagataaattcctagaagtggaattgttgagtcaaagtgcatttattattttgatagacactgctaaaatgctctgcactgggcttgcatcattttgcagtcccacctgcagggaacagtaactaatttttcacagcttccccaagagaatgagttgtaaactttgggatggttgtcaatatcaaatgcctcatttttgaatgtttaagttgcttctacttttgttacatttagcagcactaggattaatatccttagagctacacctttgctcattttaattatagccttaaaataaatttcttaaagttgattatgttgttctgggagtacatgcatttttagggcttttgatctgtactattttgaggattcttgaagtctcaggggtttttaagcacggagaggagaactctccactcttataatgtaattaatgctctaagtttatatagctaataaataaaactcagaaaatcagtttccttgagcatttaaacattgtttctaaacataattaattaaaatccttcaatgatttaaaatttaattacaaatttaatttgaaggattatttagaattcttcaaatgccttaaacaacagtgagaataaaacttatacttacaatttaaaaatagcaacaccatgaattcaatttattttataaaaagtctattcttataccttcctaaggttgcagtaatactaatttctatactttcccaggattacattaattttactaaagccaaaagtaaaaaaagaaaaagaaaaaagaagactaaatcagactaatttaggttagagagcctgggttgttaatttagttgaaataggcttgtatctttgaaagtgattcaaacctggctgggcgcagtggctcacacctgtaatcccagcactttgggaggctgaggcaggcagatcacttgaggtcaggagttcgagaccagcctgaccaacatggtgaaactccatctctactaaaaatacaaaaaattagttggccgtggtggcagacagctgtaatcccagctacttgggaggctgaggtctgagaagagaatcacttggacgtgggaggtggaggttgcagtgagccgagatcatgccactgtactccagcctgggtgacaaaaagaaagtgattcaatcctgtatcattgactagtctagactcccctcccttttaaaaatagattttatttttagagcccttttaggatcacagcaaaatcaaacagaaagtataaagagttcctatatccccccatctccaaacatgcccaacctcccctactgtcaacatcccacaccacagtggtacatctgttacaacagatgagccaacattgatgtatcatgatcacccaaagtccattgtttgtattagggttccctcttggtgttgtacattctatgggtttgaacaaatttatggtgacatatatccactgttatactgccctaaaaattctctgtgatctgcttaatcatccctccttcctgctaatgcacttactgatcttttaaatgtctccctcgttttgacttttccagaatgtcacgtagttggaatcatacagtgtgtagccttttcaatttgccttctttcacttagtaatatgtattttagtttcatccatgtcttttcatggcttgataactcatttatttttagttctgaagaatattcccttgtaggatgtcccactatttatccattcatctactgaaggacatcttggttgcttccaaatttgggcaattatgaataaagtttctataaacatccatgtgcaggttttttgtagacatagatttcaattcatttgggtaaataccaaggagcatgattgctagactgtatggtaagagtatgtttaattttataagaaactgccaaactgtttcaaagtagttgtaccattttgccttcccaccagcaatgaatgaacattcctgttgctccacatccttgtcagcacttggtgttgtcagtgttttgaattttgcccattctcataggtgtgtagtggtatctcattgttgtttcagtttgcaattccctaatgacatatgatgttgaacatcttttcatatgcttatttgccatctgtagatcttctttggtgagataggtccctttttatagttaggttttcctcacgtcaaggggacttttcatgtccagtccacacttttacatagattttagtttctagcaagctggtctcttttcctaaaataatgcattctttttatttgcttggtcagcattacataaaccagtatcatgtccccattaaatattgacctggtcttctagcactgttggaacccgtatatgccttactaggccctagaagtgataggccccttaaaggtttcatctccatgcagacaaggggtagagattgtattgcccagcctccctctttagaacatttggctaatccatcacctttctacctctcctctctcatccatcctaaagttggtagggttcttactgtttttcattataatttggctatctcaccatttcacaactttctcttttctttcttaatcaaatagagacaaacgcatgccatattttattaaatgtaagatgctattgattgtcagctgcttcattattttatgtgcctctaggaaagaacaaaaactaattaaactatgacacaatgtcttactgataatcttacatagttgaggaatcagttaaaatagcctctcattgctctgaaatttctttctgtgagggatttggccatttttcccatcttcagttgtatttcttgacatgtaataagaatctttttgcatgtatctcagtaacaaaatataacatagtttcatttactgcagtagctttctttctcaggtcccataaagcacttagttgttgcattggaaaaaaatatgggagatatgttgacattcctctaaagatgaagatttgcttcactaatagcaaatgtacattccactgctctgttttattgcctttctgtgtatataatatttcatttcaatcccaaacttacagaggaaacctttatttttagacatttcaaatagtggtttaactcagtctgtaaaataacaaacaacaaagcagattactcagcttaagtgaagagaatggacagctgttaccaagtgtgaacatgccgctctccacccaacagcaataaaaaggccatctactgtagaaccacctgaatttcagaggtgttaaaatatgaaaagcagctgtcttggcctggtgctgtggctcacacctgtaatcccaacactttgggaggccaaggtgggaggatcgcttgagcccaggagttggagaccagcctgggcaacatggcaaaacctcatttgtacaaaaaaatacaaaaattagatgggtgtagtggcatgcacctgtagtcccagctattcagaaggttgaagtgagaggatcgcttgagcctgggtagtcaaggctgcagtaagctcagattgtgccactgcactccagccctggtaacagagcaagaccctgttgggggaaaaaaaaaaaaaagctgtcttagaatcaataagtgtgtaccttatcatttctataatttaactgtcatatatttaatagacgatagatggaacacctatgaatgacaacattctcctatttttagagacagggtcttactctgtctcccaggctggtgtgcagtcatatgatcatggcccactgtgacctctaactcccgggctcaagcaatcctctcacctcagcctcccaaagtgctggtattacaggcatgagccaccacacctgcctattaaaaatacatttaaagaatatagcatattccattgcactcacccttatttaacatcataatttccttttgttttttatttacttaaaatctttttttttcttttttttttgagacggagtctcactctatcacccaggctggggtgcagtggcacgctctgaccgcaacctccgaatcccgggttcaagtgattctcctgcctcagcctcccgagtagctgggattacaggcaccggccaccacgcccagctaatttttgtattttagtagaaatggggtttcaccatgttagccaggctggtctcaaactcctgaccgtaactgatctacccacttcagcctcccaaagtgttgggattacaggcgtgaaccaccatgcccagcccataatttcctttttatataaaatacgtagatttttcctttttggagtggcttacagactcacagattttcagatatgtatatcatttcaattagccataactaccttttttttttttttggatgctcaaatgacacaaaatgacacaagttgaccaggcctgcctttaagctggctcttttgtcctttcaacattactctgacattttaaaaacatctttgcttcctgaaaacattaagatattctaagtctacctttatttttctccctatcataggacatggcattagctacttttagtggttactagaatttaagaccaaatctgggcacgcactggggttccaacttagatcgttccattttagtatcagtgtagccaggacgatagcactgctaggtgccaatttaatggcagagctggaaaaggcatttctcttgaaaatcttgagttcatgtcaatttctgcatgtgtaatggagaaatattctaatcgatctctaaatccctttaaattctgatctaatcacaagttttaaatttgttttctatacaaaatgcttacttaaatgtttaacatttcacttatccataattttatcatcttttcttttttttttctgagacagagtctctctctgttacccaggctggagtacagtggcgtgatttcagctcactgcaagctctgccccccaccggttcaagcgattctcctgcctcagcctcccaagtagttgggactacaggtgtgcgccaccacgcccggcaaatttttgtatttttttagtagagatagggtttcgccatgttggccaggctggtcttgaaatcctgacctcaggtgatccaccagctacagcctcccaaagtgctgagattacagtcatgagccactgcacacggcccatcttttcttttataattcttatatgtctcattgattaccaacctgtagtaactttaataacactgtcaaatttcctctgatatattctgtataaattaacattctcaatgctcatgctcctagcagcattatttacagtagccaaaatgtgttagccacccaagtgcccatcaatgaatgaatggataaacaaaatgtggtttatacatgtaatggaatattatccagccttaaaaaggaaggaaattttgacatattctacaatgcggatgaatctgaaggacatgatacattacataagccagtcacaaaaagacaaatacaatgttattccacttacatagagtgcctagagtagtcaaattcatacagacaaaaagtagatggtggttgctaggggctggggataaagggtatggagagctgttgtttaatgagtatagagttttagttttacgagatgaattctgaagactatttacacaaaatatgaatatacttaacactactgaactatacattttgtataccataaaaatggccaagatggtaaattttatattgtgaggtattttttaaaccacaattaaacattttttaaaaattatgctctcaccaagagggcatggggatccttatttctcctaaaattacatttgcagtagaaaaaacaactagctttatttttttaattttaaagaaattaattggaagaattaacaatacttaacaatatattaatatagtgtatgttcccccaccactgagagagaatccattgtttacatcaaatttccaaaaacatatggaccctaaaagatgctaaaaaccattcttctacagaaatggaaattttcaaaaaggactttggaaattagatcaatattttgtccaataaaactatgagaatgatatttatatgtgccagaattaagatttgaaataacttaaaatattgttaagtagataaatataaagttctgtttttttgttttgttttgttttgtttgagatggagtcttcctctgtcactcaggctggagtgcagtggtgcaatctcggctcactgcaacttctgcctccccgattcaagccattatcctgcctcagcctcccaagtagctgggactaccggcgcacaccaccatgcccagctaatttttgtatttttagtagacacagggtttcgctgtattggccaggctggtcttgaactcctgacctcgtgttctgcccgcctcagcctcccaaagtgctgggattacaggcataagccactgctgcgcctggcagggaaattcttttttttttttgagttggaatttcactctcgttgctcacgctggagtgcaatggcgcgatcccggctcaccgcaacctccacctcccaggttcaagcaattctcctgcctcagcctcccgagtagctgggattacaggcatgcaccaccacgtccggctaattttgtatttttaatagagatggggtttctccatgttgaggctgatctcgaactcctgacctcaggtgatccgccctcctcggcctcccaaagtgctgggattacaggcgtgagccaccgcgcccggcctgagccgggaaattcttatacccaaaaattatttgttatttgtctgaaattcaaatttaacttggcatcctgtatttcatctgtcaactgtgtgttttaggcatagtaagaactcaataaacattaacaaaatccagtaacagtccccaactcgtttctacatgagcccctcttccctgtgcaaggcaaattgcctagatagatagatagataatagatatgattgatgatagatagatagatagatagatagatagatagatagatagatagatgatagctgataaatggtcttaggctaagttcatagtcatagtggtgtctagacccacagagctgaggttctcactgccctctccagttggtcacatcgagctgtagtaaagacctgcagagaccgtgcgtgaagagatatgacttcagggtgatggaacagctccctttaaggaacagaaaactttaagtgaaagaatccctgagatttcttcagagttgtaccagagcattagatgggaaccaggtggaacagttccttagaagcagctttcagcacaatatgaggaaaattctcaatggttagagcagtctatagagccagtaaatgaaaacctaaatagtagtgagcttcttgccaattgaggctggatgatcacctatcaaatgtgtcatgaatgggatttcctagttgagtggctggatacatgacacagctgtcctcaaaaatgctctgaagtgaggtcaggcagggttcatgttgatagtatggctcttaataaatggcagctctctagtaatttcaaagatgcttcataacgattgatgacaaaatattaagtgtaaatctgtaaataatgagatggcatttcaatagtaattaacaagcattgataaaatgaatttaaaattaatctcaaacatactctatgaatgtaaaaacttttgtgatgaacttagggtaaggaagacagataatataaaaatgggatttgaggccgggtgcggtggctcacatctgtaatcccagcactttgggaggctgaggtgggtggatcacctgaggtcaggagtttgagaccatcctggctaacatggtaaaaccccctctctactaaaaatacaaaaaacttagctgggcatgttagcatgcacctgaattcccagctactcaggaggctgaggcaggagaatggtttgaacccgggaggtggaggttgcagtgagctgagattgcgccactgcactccagcctgggctacagagagagactctgtctcaaaaaaaaaaaaaaaaaagaagggatctgagccaagtgcctaatttgacttgtcaggagcaatttttaaatgatttagattaataaaaataatacaaactaaaatctgattgattctaatatatttctgttgctaattaagacttaaaaggacctgatatgaatctcccaaataatttgtaaaaatacagatggggtctcactatattgcccagtgtagtgctattcacaagtactatcatggcacactatagccttgaactcctgggcttgatcctcccacatccttctcatgagcaaatggtattacaggcatgcaccaccatccccaggttccaaataattttgactttgatccaattttatttagcttgcctgaattttaaattcctaagcttaggcctaccttaatggatcccaatacattgcggcaagactgtaaaatgtgggctgcgcaagtcattctaacagttcaaagaaaggaaccatggcttccagatagtcatatgataaagataattccaaaccattgttgttgcacagaccaaaattttaaactcctttaagtaatgatatcacgcaactgaaatttaacaacacaggatgggggggtagaaaaaacaagcacttgaaggatgaagcaaagcacactttaaataatgtaatataactgtggaatgctgacaaatagtatcttgatgggaggggaaagtggaaacgccacaatttctatttctaccgtgttttccaaagacacaatttgcttatgtttatgtgtaaacagggctttattttctaatagtattggttatgatttaatcaggggaaaaaactcttgcttggcctcaccatccagtctctcacatttatgctagaggttccctgttttccagaaaagggaattcttgagtcattggccattattgtaagccatgtcaaaggtgtgccctctgctcagcagttactaatgatctattgtgggaaagcttctttttttaccttacacttgctctgttgaaaatatcaacaaaatctgagtttatttgcttaccagtattccgtatgacaaagacatgaaaacatcaaacattatattccttgatttctactttgcagaaacctttcagtaaattaggctctgaaattttcagattctatttcgaatttgtaatatgaccctcctccataattgaaaagtttttccccagcaaaagggaccactggatttactactttgactgtgccccatcccaaacacacacttataggaagatccactggctgagggagccctcgaacttcagactgattctgggctttaggactcaaggctcagaggctcagacagactctgcactttgtggtttgtttctgatttttttttttttttaaccaggtctcactctgtcacccaggacagagtgtggtgatgtgatcacggctcactgcagcctccatctcccaggcttaggtgatcctcttgcctcagcttccccaaaagtgctgggattacaggtgcatgccaccatagccagctaatttttaaattatttgtagagatagggtctccatatgtttcccaggctggtctgtaattcctgggctcaagcaatcctttcaccttggccttgcaaagtgctgggattataggcatgagccactgcacctgatgctcttggggagttttgagttcagaatgaccttggcatgattttatgggctagcctagaaaactgatctggcagatacacatgcacattcctaatataacactacttttaaaataaattacttccaagctgcaaacaacttagttacagatggctctttggaaaacaatcctttcccttttttgaaaaacaaattttgggtacatggttctttcattagaaacttattggatggacaggacttgagttttacttttaataattcatgttatatattaccaaaaatgtgattctggtgatgtcaaagtcatgctttgttcatttgaatctattaaataaagtacttatatgggaaataaaacttactttaaaattgatcaacaggtaaatagataggaaaggtcttaaataatcatcagtaaagaactaaaacaagcaaacatttgcttttctagattggaggataaatttatcagagtcagaatttcctcaccatgcagagtttaaaggccgtttataattattcctcatctccatcctttagtcaatcaggcctcttttctaacacatctttggatgcttgtctaacttcccactctcatcactgccaacccaaccaccaactctatctagtcccagctgctcttacaacctgctaattgaatagttttaatggctcttttatacatctatccaaatccactccaatcctctactttgtcacattcattcctggatttttttccttgcagttttgaatgggctaatatttctattgaaaattattctactcatccataagacgcaaatattttacattatttttccaattgagatatagtggccatgttgaaccactgctgtttcttaaatgatgcctctgagcagaaaagcttcatgctataattaattgcgctgacacatttatagaatattaaatgcgcttacacatttatatcacacattaaatatgcatgtcaaatacatttataatgtatttccagctggccagcccatgtttctttaccgttatcattttttttctctgttcttgcttacctctggtaactatagaacgtagatgatactttccttagtaaatgcttggatttaaactatgattaagaggagaaagaccatctcccctatgcaagttgttcatgtaaacatttattgaccatctactctaggccagaaaccagggtaggtactgaggatacaaaaatggacacatcatgtctatccacaggaaactttgtctggtgcagttgtttcataatttagtgttcttataagaatcatataagggtactagccaaaaatgcagattctggaacccctagttaccccacattttaattttagaagtttggagtagagcccaagcatctgcattttagcaagtcctccaagtgattctttattgttttttgtttgtttggttttgtttttgagacagagtctcactctgtcaccccagctggagtgcagtggtatgatcttggctccctacaacttctgcctcccgggttcaagccattctcttgcctcggcctcctgaatagctgagattacaaacgtgcaccaccacgcccagctaatttttgtacttttagtagatacagggtttcaccatgttggccaggctggtctcgaactcctgacctcaagtgatctgcccacctccgcctctcatagtgctgggattgcaggcgtgagccactgtgcctgacctgatgctccaagtgattctgatgcaggtagtcccttgataacactttgaaaacatcacattgaatactattgaatgttttatatttgtgcctatagttctgtactgttatcttttggggggtattttcgggtttttttgtaaaaagctatataaaagaaaatattatttaaccagtttccttttcctcaaatgcttttttctctctcatttttaaataagaaatcttttcatattcagagattatctgtcaagtataagaaaatttaatgtatgagcgcttttctaaaaacctagaagtttatcatatattttccttatttttttcaccaccattagaccataacacaaaacataacactgttgcaataatattattactttacaaaagtttagatttcaaagtttgctactgagtattttttttctttgtactttccccacacttagggttctcctgcttccaggaggaaagaaacatttcgtttttctagtccaactaaaggcccaaattatgacttacgtgaaatgtagcttctagctatatgctcattactttgaaaaagactatgaaagtaagtttaagcaaagcaaaacataaaataaccttactaagtttttagagctatattcatataggcatagttacttttgtaactaatgcttaagtttgatggaatagtcctcccaatctgtcttcaactttctttgcaaactcactgtgaagtctctcatagaaccaggctgacaatggcctccagactgctgccttcagataccataccatttttttgtatttcccttgcaaactgcttagtttttagagcccattgaagggatgcccaagctcaccattcttctgcactgacttctctgtaacctctgtccatgtagctgggaaggggttgcgagagcggacatagaaaaaacatatagatatatggcaaaccaagtaaccatgtcaattttttgagaacatttttaaaaaatccccatgagtttgatgttttctaattaccaggagacaattatccacattacacttaaataaaatgaaaaggtctcaccatttctggctacaagtcctggtgtggtggctcacgcctgtaatcccaacactttgggaggctgaggcgggcagatcacctgaggtcaggagtttgagaccagcctggccaacatggtgaaactccatctctattaaaaatacaaaactgtgctgggcatggtggtgggcacctatattcaaagctactcaggaggctgaggcagtagaatcacttgaacccgggaggtagaggttgcagtgagccaagatcataccactgcactccagcctggtaggcagagtgagactccatctcaaaaaaaaaaaaccagctacaatgtccctcccttccttccttccttcctttcctccttccttccttcctttttctttctttctttttttttttttttgatacagagtctcactctgttactcaggctggagtgcactggtgcaatctcagcccactgcagcctccaccttccaggttcaagtgagtctcccacctcccaggtgagtcccagcctcccaagtagctgggactacaggcacacacgaacattgcaagacggggttttgccatgttggccaggctggcctcgaactcctgacctcaggtgatctgccagcctcgacctcccaaagtgttgggattacaggcgtgagccactgcttctggcctacaatgccttttagctcattgggatctcaacagaaaatcttataaatgtaatcattttaggtgtttatccacatgctccaccaaaatgagatgtaagaagacaatattttacaaaatgaacagtgttgatgatttagtaacaatatacttaatttcaggaacaaaagacaaggacatacttcattatttcccagtagaaaataatatatattcaaatatagagcttatccatggtggattatgtttttttttttttttttttttgagacagagtcttgctctgtcacctagctggagtgcagtggcgccatctgggctgactgcaagctccgcctcccaggttcacgccattctcctgcctcagcctccggagtagctgggactacaggcgcccaccaccatgcccggctaattttttgtagttttagtagagacggggtttcaccgtgttagccaggatggtctcaatctcctgacctcgtgatccgcccgcctccgccttccaaagtgctgggattacaggcgtgagccaccgcgcccggccggattatgttttatacaagtactgtattcttcttagtgtctgacatcttgtcaggaaaagggtgttttcagttgtgaagagtgtttcacatctttaaggttgagggcttgaaggatttcactagttgaatctttactgacagcaagtatacgaaaatgcatatcagagaaattttgctgctgacttcaacttgccagccacagacattctgcattttgaactgattgaggaaagggctgtgttagaaaaggagcagtgaatgagcagagcagtgattcgtgtagtgattgccaagaaccttgtgtttcaatcctccctcttttttctaatataaccaaatgaatttttctcttaatgaaaaataattacaatggcttttacttttttttttttttttttttccctgagacggagtctcgctctgtcgcccaggctggagtgcagtggcgcgatctgggctcactgcaagctccgcctcccaggttcacgccattctcctgcctcagcctccggagtagctgggactacaggcgcccgctaccacgcccggctaattttttgtatttttagtagagatggagtttcaccgtgttagccaggatggtctcgatctcctgacctcgtgatccgcccgcctcggcctcccaaagtgctgggattacaggcgtgagccaccgcgcccagcccacagtggcttttacttttaatttttattcaaattttatttcactgaactttttctcaacccccaaagctttactttgtttcataataaatggtagggaagttaaagatacataataaatgatcgaccttgctcatgtatgggaaaaaacatcacaggatttcataagatttctttacattcctctcttcttcagtcaatttatttctgaaggtgtggaagatggaattacaggccccattgaagactgtttatagttatttgggttgtacagtccacaaatggcacaattatatgtagaaaccctgattgctgaggctcatttttctacacttcctaagtgttgtgttcacagattaatgtgaataaggcttaaagaaatatatttcttcaatggcgagccccaactatgcccttcatgtactggtgtgtaagccatttgcttttagcctaaaagggaaaatttttttgaactaggcatgctaagacaagggcaatcccattattaaaacaaaaatgaccgggtgcagtggctcacacctgtaatcccagcactttgggaggccaaggcaggtgatcacctgaggtcaggagtttgagatcagcctggccaacgtggtgaaaccctgtcttcactataaatacaaaaattagctgggcatgaggtggcgggtgcctgtaatcccaagctacttgggaggctgaggcatgagaattgcttgaactcaggaggcagaggttggcaatgagccgtgattgtgccactgcattccagcctgggcaacaagagagaaaccctgtctcaaaaaaaaaaaaaaaaaaaaaaaaaaaaaaaatgccaggcgctgtggctcacgcctataatcccagcactttgggaggctgaggcgggcggatcacgaggtcaggagatcaaggccatcctggctaacacggtgaaaccccgtctctactaaagaaaaaatataaaaaattagccgggcgtggtggcgggcgcttgtagtcccagctacttgggaggctgaggcaggagaatggcgtgaacctgggaggcggagcttgcagtgagccgagatcgcgccactggactccagcctgggctacagaacgggactccatctcaaaaaaaaaaaaaacgaaaaactaagtgataacagaaaacaaacaaaaaaaattaacagtcactatggagacatatttatgtcatctaagaaacaacggctttggtgaggtttatgaagtcctaggaggagtgattttcactcctcctagagtagactttcattctctcccagtattgatatttctaagtgtggctgttggcctcatgtatttgatttatgtcagcatatggttgagctcacagattgctttcttttaccaaatgtgtggttaccaatactgtataagtctgtacctgagcagaagtttttaaagagctaatttcaacaagatttcttgcagtgatttacaccagctttattgttaaccaaggaaaattagcaggttttacaccataatcatttaatagattctgtaactaaaaactaaaatgtacatatgttaaagtatattgatctattaggcagctaattccaaatctgagaataatagcatggaaacatgatcaagtaacaacattttccagaataatcctctcttgtgaacaggttcaagacccttcttatgaatgactagaacagtcatcaagatgttggaatttgaagcatgtacagatggccacaactcttaaactatctctaaccttttggccatgacaccttaaagtccagtggttcagactgatttcttttgttaccaatacttcttctttattttttttattttttatttttttggatggagtctcactctgtcacccaggctggagtgcagtggcatgatctcagctcactgcaacctccgccttccaggttcaagccattctcctgtctcagcctcccgagtagctgggactacaggcacgtgcaaccatgcccggctaatttttttttatttttagtagagatggggtttcactgtgttagccacgatggtcttgatctcctgacctcgtgatccgcccgcctcggcctcccaaagtgctgggattataggcgtgagccaccgcgcctggctctgttaccaataacttctaaatccaaatgccctttggagggttgccacttgtattatgaaaataataatcgtcagtcccggtggctcacaccagtaattccagctctttaggaggccaaggcctgtggatcacttgagcccaggagttcaagaccagcttgggcaacatggcaaaaccccgtctgacaaaaagtacaaaaaaattagccaacatggtggtgtgcacctgtagtctcagttaccccagtggctgaggtaggaggatcacctgggcccgggaggtcaaagctgcagtgagccaagattgcactactgtactctagcctaggcaacagagtgagactctttctccaaaataataaatgtgtgttcatctatttagggcaaaaattttcaaaatgtattctgaggtaaaagggattctgtggtcaaattagattgggaaatgctgaattaaatctggacctctcaaagccttgaagatgctactatgcatcttccaggagatgcatagtagcatctcctcaatttattacatcaaagaatcagagtttttaagctcatcacagtttacaggacacatttaggaaagtatattggccttgctgggtaaaccctttcttatgcctcggtagaaagactgctaatataggtcaatgacaaaaagaggagttcttaggaagacagtgggaccagggattttagttttcagtggcagaagtaagatgatttaaaactcaatttccctttgcttcctcccaaggccctctcctggctgatgtgagatgcctgaaaatggccttcattgaggaagaaaatgaattcagggtgtggctcaggagaaaggggtgggtatctctggccagttctgattctgacttgagagagactcctgggcgcaaccaatcctactgccccagtccctgtagtagctgggactgtaggcacacactaccatgcccggctaactttattttcatttttttagaggggggggtggtgggtctcaccatgttgcccaggttggtcttgaactcttggcctcaagtgaaacttccaccttggcctctcaaagtgttgggattaaaggcatgagccaccactcctggctaagattgcttcttagtagggttcttgagccataagggcagatcctgattttatgggacttgaaagttacccaatttggagttagggggaacttgttgaaaagaagaacataaattttttttttttttaagatggagtctcagtgtgtcacccaggctagagtgcagtggcgtgatctcgactcattgcaacctccacctcctgggttcaagtgattctcctgcctcagcctccctagtgctggaattataggcccgcaccaccacgcccagctaatttttgtattttagtagagatggggtttcaccatattggccaggctagtcttgaactcctgacctcaagtgatccacctgcctctcccacaaagtactgggattacaggtgtgagccaccacgcccagccagaagaacacaaaattaagggcaaaagtgactatttaaaataaggaaagaaatcacaataaattagattttaaaaactgataaataccattaaaaatcacaaagaaaaacattataaattttataaactgcctgacatgttcctaaatttttaaaactattttttgctgcacgctttttgtttgcctctttataaagatttcacattttgaaagaacattttacatagaatagaaagataatccaggctttcctctagcaagtttgtttgaaatttgttttgtttgttttttaaattggtaatctggaaaagtttctttcagcatcataagttggaaatgtcatgtaaaattttaggattattgtcaaactttggaaaacttttacctagattctctcatgtatctgatttgagagcatttcagattttcttgtgagtgactaatgcaactcctccttgaattgaagacactcatttaacagtttgtcatcaatgtcctagtgtagtggcttgacagtaagctttatgttgaggcctgtacactcacatcatggtgccaggtgagttagcaccatgggcagcaggagttttcctgaaaatgattcctatacctccatggttggcactaactcaactataaacaaaagtgactgtgtacctcctaaacagatcccactgaatttccccttagcttcatctcccaaaaacccttgccactccagcaacactcactttatgttgtgagggtggagaagttcgaatggaaaagaaaagtcatattaattattgcagctaaaagatcttaattgtgcaaatttgacaaaaatatatgaccttgtgaacatattgccagggtctcttcctcactgaatggagatgtctgatagatctctttccatgttttagctggcacatgccttctgcccttttttcttttcttttcttttgagacagggtctcgctctgtcgcccaggctggagtgcagtggcatgatcttggctcactgctttctgaccttttgattttcttcttgcttggaattcaaatacaatgctggaggtggagcagccatcttgtgaccacaaaatgacaacatgagggcaaaaaccatatacaaagggaaaggcacagaaagatggaaggcgcccagctgatgtcatggcctatcttcagacttcttggtacatgaaaaatatctgtcatatttcctgttatttgctaatgaatgcaatcacaaattgaaatgcttcccatgatagtgattttgaattaatgatataggtaacagaatttcttttgccaccctgtgggactttgaacattttaaaaattggttggcctatgcaataaaaaatgcatgttgttttctcaagtctttcccatacttcttatgaacattttaaaatcaggaaatatttgaaatattaaaattgtactatcataatcccagcactttggcaggccaaggagggcagatcacgaggtcaggagttcgagaccagcctggccaacacagtgaaacccgtctctactaaaagtgtaaaaacttaacagggcatggtggtgggcgcctgtaatcccagctattcaggaggctgaggcaggagaatcgcttgaatccaggaggtggagcctgcagtgagccgagattgtgccattgcactctagtctgggcgacagagcaagactccatctcaaaaaaaaaaaaaaaaaaattgtactatcaatatttgagttgatctttcaatgttatttaaattccctctctatattctggttacatggatatttcacttcagatgtgatattgatttaagatgattttcatggttgacttataattcttatatgtttactttgtccttttgtaaaatgaaaataattattggttcttattaagcacaaaggatgtaaatgagtctgttgtaatgtctttgtatgccatggataatgtatcaaacgattctcctatgaggtattttgcttgaatcttttttttttttttttagacagaatcttgctttgtcgcctaggctggagtgcagtggcctgatctcggctcactgcaacctccacctccctgggttcaagtgattctcctgcctcagcctcccaagtagttgggaccacgtgccaccacgtcctactaattttcttttttttttttttttttttgagacagagtcttgcactgttgctgggctggagtgcaatggcacaatcttggctcactgcaacctctgcctccccaggttcacgtgattctcctgcctcagcctcccaagtagctgggaatacaggtgcacaccaccacacccggctaatttttttgtatttttagtagagacagggtttcactatgttggccagacttgtctcgaactcctgaccttgtgatccacctgccttggcctcccaaagtgctgggattacaggcgtgaaccaccgtgcttggcctaatttttgtgtttttagtagagatggggtttcaccatgttggccaggctggtcttgaacacctgaccttaggtcatccacccgccttggcctcccaaagtgctgggattacagacatgagccactgtgcccagcctgcttaggtctcaatgcccatattaggatcctgtagaataagattttaagtgtgtacaggattattgcttaagctaagagactttggattgttttcagggtgctactttagaattgatcatatttttgctaaaagcttaccaggtattcttcacctagatctgacataagggatgagtgaatttcacttgacccttgaaccatgctcatgtgttccttacaatttagttatatctatttttatatttcatgttatgcatgtggattcctgctccttgcccctcccatgactttgtaattcagtccagagttcataatctgtcatacaatctcccttccctcaacatgaagtttctttttattgtagaatataccactctgttcttttattggtatataattaaatctctacttatagtaagtttcttattcatccattcattcattcaataaatatttaatgaatgcctctatataacaaagagagttctaggcagtggagatgtagtataaataagggtaacaaggttcttgttctcgtgaagctgacattctagcagacgcaggcagacaataaacaatattttaaaactagtaatggatctagggaatggtggagagctggcttcctaaaaaatcatgtttggaggaactcaaaagccagtagctcaaaaactatctcacacttgactgaagtgattttgtgcccccttcttaaaattctgtctaacacttcagctcatggcatctgacattcttcccttaaagactgtaagtgctcattaatagctagagttagaagtaagtttaggaaggacttgtgaaactgtcatagacttttaatggtattgagtcatagaatgttaaaactggaaggcagatagtttagaaatattctttgggagtcacctgagttatcaggccaaacagttaagaccttggaccctgaaggagtgaagcatcaggtgtacgtattccagcgaggatgtctattttctaggataatgctaaattgaggaagctcctaggagtggatgccaaaatgcaagggagactcctagagatgggtggattgatggaagaaagtaatgaagatgaactttgctgtttctattagaattactcttacctggaccaaccaaaaaaaataaaaagaagtgcctggatttaaagactttattcttttctttttctttttctttttcttttttttttttttttttttttttttgagacagagtctcaccctgtcacccaggctggagtgcaatggcatgatctcggctcactgcagcctctgcctcccaggttcaaacgattcttctgcctcagcctcccgagtagctgggattacaggcaaccgccaccacgcccagccaatttttgtatttttagtagagatggggtttcaccatgttggccaggctggcctcaaactcctgacctcgtgatccacccgtctcggcctcccaaagtactgagattacaaggatgagccaccgtgcccagcctaaagagtattcttttatcattcatctttcatcaattatataagaaactaatatggaagttactatgaaaagtgattacaaagtgattatttaagcccacacaacttacaaagtatgatgaggtgttctgcccacattcctttgcagtttcagttcagagtgacttttagtgctgggcttctcctagccaatgggaaatggatgagaaataaagtccgcttcttaattgagtcactgtgggcattatgggcaggataattcttggtcagataggactgtcccacacattgtaggatatttagcatctctggctcctagacactaaatgacaagggcttttactcccatcattgtgacgaaaatttccccaaacatccctccaagggaggggactgtctcatctccctgactgagaatcactggtaatcaggaagagattcttaaatgtgtcgcttccatgtggcatggtgtgtgtgaggctagatgtttgtgttcattgctacaggagcacagagggagaggtatctcactgaatctggtgtttcctataggcatttcgatgaggattattcctatcaaaataatccaacaatgccattcctactcaaaatattttaaagcctcccctctgggtttacttttagagcctgagtcatattcttttgaatttgttcaacggaggaaagtttcttcctttggaagcatcccaaagtcacttgtagccaagccttgtgagtaagatgagtgaacaagctggacaatattatttttagttaaaagcagtttcacagaacataaaattatgagccagcacttagtagttagtgaattatgaaaagcacttagttcaggttttaataagatataccacttcgttcattatttttcaaactcttattatcacgagattgttagcactctgttaggtactgcagatgtagaaatgaaaaacaatttctgccattaaggaattcactatctagggagagagcaagacagaaagataagtaaaccaataagtgcaataaaaatgtaaaagcgtatgctagaaggggtatatttgtgctgctatgggagtacaaaggaaggacactagcccaatctaacagcaaagaatatggacagtttgccgcaggaagttggtgctttatctgagttttgaatgtacagtgctaattggcttgaaggaggaatggaagatattctaggcagaagcagcagcatatccaaagatacaaaggattgaaagtgtagtgcactctgcaagcttcaagttcttttttgtctggagcagatggtatctagtaggagataacactggtgagataggcagtgtcatatgtcaatatcctttttatttgccataccaaggaatttggactctgtattgaagatgaagggtagccatgaaggactcaaagggtagaaatctgatgatacttgcatttttacatcatcctagaaacagagtggaaaatgaactggaggaggataaaaccagagacagcagttaagatgctaggaaacatgggagaaatgatgaggtcccaaataaagaggtaaggatggggattaaatggagagggatgattcaagacatttaaaaacataaagtaacagtgattaaaacatagttataggccgggctcggtggctcacgcctgtaatcccagcactttgggaggccaaggcgggcagatcatgaggtcaggagatcgagaccatcctggctaacatggtgaaatcccatctctactaaaaaatgcaaaaaattagctgggcatggtggcgggcacctgtagtcccagcttcttgggagtctgaggcaggagaatggcctgatcctgggaggcggagcttgtagtgagccgagatcgtgccactgcactccagcctgggtgacagagcaagactccatctcaaacaaacaaacaaacaaacaaccataattataaatggtgaaaagagatcctttctgataaatggatcaggatagagttcagaaaccaacattgaataggaattatacatacagtaaggatgacattttaatttagtaggaaatgaatggaattttttttagagatgttggttagaaagatatactagttttctttctttttttttttttttttgagacggagttttgctcttgttgcccaggctggagtgcaatggcgtgatctctgctcaccgcaacctccaactcccaggctcaagtgattctcctgcctcagcctccctagtagctgggactacaggcatgagccaccacacccagctaattttgtatttttagtggagacggggtttctccatgttggtcaggctggtctcaaactcccgaattcaggtgatctgcctgccttggcctcccaaaatgctgggatcacaggcgtgaggcaccacgcctggcactagttttctaattatcaaattatcaaaaacttgatggcttaaacaatataaatttcttttcttattgttcagtaggtcaaaaacctgacatagatcttactgggctaaaatcaaggtgtcagcagggctttctgctttttggattctctaggtgagaacctagttccctgccttttctagcttctagaagccaccctcgttccttggcttttggccctttcttcagtctccaaagcctgtaacattgcacgtctctgaccattcttctgtagtcacatcgccctctgaccacagctaggaaagtttctccactttgaaggacccgtgtgattagattggacccacccagacaatctgggataatcttctcatctccacaatcctaaccatatctggaaaatctcttatgctatgtaaggtaacatatccacaggtctttggtttatggcatggacaactctgtggagccattattctgcctactacaggtgaaaaaaatgttaatttagagtcctacttcatgacataaatgaagaataaattactgatggattaaagatctaaacatcaaaactaacaaagtatgaaaaaatgtagtaggatatctttaaataaggaagactttcctggataggataagaaacccaatggtcatcaattaaactattgacagacttggcccaatatttaaattatttaaagcatccatacaatgaaagacaagcaaaaagttacaaagttaacaggcaagcaccagactagaagacaatatttgcaacatatacatatataatagacagataatatccatagtatataaagagtatcaaaaaatcaatgaagaataaaaccaaccagataggaaagtagacaaaggataaaacagatgatttagaaaagaaaaaataaaagtaactaataaacagagagtaagaaagctaaacctctttcactatcagggagtattaggaatttctacatatgtggtaaatctttaaagaaaagcaaggaaatgataagatatattcaggatatatcttatccagtttagagttatctgtggatggagaggaacacccacagctttaacattattgggagctttaacattattgacaaattttctgtttctcaaacttagtagtaaattcatagatgttcatttttatttttaaatgtcattaatgtacatatattacacttattcttttttgtatatgtaatgtatcatgatttttaatatggaaaaacaggtttttaaacttcattttcagacaacttatttgaaacaacttcaaacttacagaaaaattgcaagaattatacaaataacccccataaactgtttgtcctgagaccctattcaagtttgtccagcgtcacaataatgttctttctttctttctttctttctttctttcttttttttttttttttggagtcagggttttgacctgtcacccaggctggagtacagtggcataatcatagctctctgcatccttgacctcctgggctcgagcaaaccttcctgcctcaacctctggatgagctgggactacagggatgtccccaccatacctggctaattttttaattttttgttgtgatagggtctcactgtgttgtccaggctggtctcatactcctgggctcaagcaatcttcccgcctcagcccctcaaagtgttgggattactggtgtgagctactgtgcctggcctcagtatattctttttgctataaagcaaaaggatacattccatgttttgtacccagttatcatgtctctctagtctcccaccctgaaatagttcttcagtatttccttgttttccatggccttgtagaatgtctctcagtttagacttatctgaagtgtgcttttgatttgacttagatcctgctggaacatcatagaagtgaagctaatttcttactgcattctaataagtagcccacaatgtcagtatgtcccatttctggtggtattaatttgatcagttgattaagatggtatatgccaggtttctgagaaattattcttctattcctttgtaattaataagaatttgggggaaagtactttgagaccgtgtaaaattctcttcctcattctactttcacccactaaattagcatccattgaggctttttctcaatttttattatgctgattgccaaaaagtgattttctaattccatctacatttgttagcacagacagtgtgatttccatatggccctattcccagagatagtcatcactagcattcctttttgatagtctgatggggatttttctctacatgctcaggtataggagtgaaaagccactggttggatcgacccagagtaggttcagtaagtgatctttcaaaggagtaaacaagttaattgtcttggcaagagtaggatcgaagagatggattgtggggcgtagctggataaggaaggaagtaaagccagaggcagctgacagattaggaggagatggagagagagaaggactgccgtagtttgaatgctctaccccttcgaatctcacattgaaatttgatccctaatgttggaggtgggacctaatgggaggtgtttgggtcatgagagtggatccttcaagaagagattaaagtttagagaggaataggttattgctctattaggtcccttaagagctggctattaaaaagagccaggtgcctctccctctccttgcttcctttcttgccacgtgatctctgcacacaacagttccccttcgctttccaccatgggtggaagcagcctgaggctcttaccagaagcagatgctgacaccatgcttcttgtatggactgcagaaccaggagccaaataaaccttttctttataaattacccaccctcaggcattcctttagagcaacacaaaatggactgagatgaggacgtagaaactctttgatgctaatatgttagaagggaagctttaggatgtacaaaaaaattagatcacttaggtcctggcttggttttttactttggatttctcagatgcttcagagtctttatatggacacctcattgatgaagcacatggaatgattcataccaatcgaagttaagaaacaagtttcactgtttcacttgtgagtgtgacaattttggggtcttggtgatggtgttttacaactaccaactttgaagttttgtttcaagatcattaaagaaacattgaattttgtttcagctactgtttctctcaatgagacattaattcttccagcttctgttgaaagatcagaacaaatggcaaacctttattgtttttgttcattatacaaacagaaactttcttgtgctcaaagctttttacagaatgaatctgttctaactttaactcctcaaccattattatcagagttaatcatattttaaagccccaagtctctgaactttttaacatttgcattagacctatagttttacttctcatgaaaagtcatcttctccagctttgaacattatgctaaagtaaaaaaaaaaaaaaaaaaaagcatcctcttaacattatttgtatgcccatatagtcctaacatgtcaagtgactcatttgcagaatttacatgactgaaaatgtagtctcaaatcagtgtctcagtaacagtcactcattttaaagccaatgcagaaaaacctcctggactactgaaactttgtaacatcagcacaaagcttcacacagagcaaatacaaactacttcagaactctggaaagagtcattctaacctatggcactgaagatgcactgaattatccaatgcaataaaaagtatatataaaatttaatagtcatcagtgtaaaaggccataatacttgaagtagttaaaacatgttgtagtcttctcggttctgacagttcctcttttgtttccaggaatcataaggagaaaacaattggtctccttactttgtagcactcccatgttgctaatctgtgatttcaattatccatactcaagaagagagatatcaatatgggtaaaacaactgataatatgctaagtcttcccttcctatcagattaggacctgaattttgatgacaaatactgcctattgagacgcagggacccggggggcaattttttttttttagacaaagtctcgctctcgctctcgctctgtcatccaggccagagccagagtgcagtggccccgagtagctgggattatagacgtccacccccatgcctggctaattttttttttttttttttttttgagacagagtctcactctatcacccaggctggagtgcagtcgtgagatctcagctcactgcaacttctggcccccaggttccagtgattcttgtgcttcagcctccagagtagctggcattacagccacatgccaccacacccagctagttttttttatttttagtagaaatggggtttcaccatattggccaggcttgtcttgaactcctgacctcaagtgatccaccagccttggcctctcaaagtgttgggattgcaggtgtgagccaccatgcccggcctaatttttgtgtttttagtagagacggggttttatcatgttggccaggctggtcttgaacccctgacctcaagtgatcacccggccttggcctcccaaagtgctgggattacaggtatgagccactgcacccggctgctcctgctccttaatgtctcctttacttactccttatttgtgaataatgaaattgataaatagaacaaatactgtctgcttgattgtcagaccaaaaactacttcctttttctcttcttcgcttactccttctcttctcataaaaggaatataaggagctaactgcttaaatgtcagactcatagcaataaagagcctatcatgtttcaaaacctctgaaagctctctagaggacaaatagggggcattggggaatccacaccttctctaacttttttcttctcttagccaagattccaattcatgtctgtctgattctcttaactgctagattatgaaaaattaggtctttgaaatgagaatgagaaagaaaaaaatgtcatcatgtatatttatttcatttgggaataaaagggtgccctgtaatttagaataagagacagggatgactcattacaactatgaggattattaaggaaatgaataaatcaatcacaccactccaactgtacttgtcatcacagtagcattgccaatttccctatacagttggtaattgttattccatgtcttcttacatggaatataaggtccattctggtgtaacaagaaatattagaatagtcttcaaacccatcattagatgaggctataaaaagcactaactagagcaggtgcaagctacctcagaaccctggaaagagtcattcaaaattatagcaccaaaaatgcactgaattatccaatgtaataaaaagtatatataaaatttaatagtcatctgtgtaagaggccatatacttgaaaattaagactgttttgataatgttaagttaaattgatatcccaaaccaggaaaatggtagaatgcctaaactaacatttaaatttcttctgtttaataagtctataactgcttaacaaaaagaataagagcaatatatattacagcagctttgtttgactctatttagacaagtaaaatcttacgcttccctgtagttttccttataaagctgactgattctcagttcatttcagctaatgttttgcttgatatgtcttcgttgctttggttgtcaggcttggagttacttttccactgctgtttttgcctgctctctagctgaggttaccattgttgttatgaggtgtcttcaccccagcctatctgtcttatactgagtcaatgaagagggaagatggaggacaagaaagggtgagaagccaaagagcttcccttaagctcctgtctgtaactgaaagctccatgacattccatccagaaatcaagaagcatatctgtggaaactgaaaggaataaaggcctatgcagaacagttgagagcacagacttggcctcaagcagacctgggttccaatcctggtttcttcccttgatatctgcgtgaccttggacaagctccctaatccctctaaacctgagttttactgcttaaaaaaatgagaagaacaatattatctatcttatagagtttattgacaggagcatattagataatgcatttaaacactctgtatagaacctagcatatagtaagcattcaaaaatgcaaggccaggtgcagtggctcatgcctgtaatcccagcactttgggaggccaaggcgggtggatcacctgaggtcgggagatctcaggggaccagcctggccaacatggagaaaccccgtctctactaaaaaatacaaaattagccaggtgtggtggtgcatgcctgtaatcccagctacttggggggctgaggtaggagaatcgcttaaacccgggaggcagaggttgcggtgagccaagatcacgccatttcactccagcctgggcaacaagagcgaaactccatctcaaaagaaaaaaaaatgctagttagtaaagtatggatgctattaatataaaagctttttgttcaaaaatgcactatagtcttggtaggacatgctcccatatccttttgggggccttattcagtaaggaccttgagtctaaacattgctgtacttctatcactttgttagttgaaaagagacaggttctaaacaaaatggtaaagtatatctttgatgaccagttctgttcctaatttggtttctctttccaataaccatgcccttccctcctctcaagacacttaggattctgtatgccgaggtctctcacaagggctttctgtcttgaggtagcagtacttgttctgtttgaggaacagctttaagaagcccaatgaggtggctaatgcctgtaatcccagcactttgggaggctgacgcaggtggatcccttgagcctagtagttcgagaccagcctggccaatgtggcaaaaaaaccatctctacaaaaaatttaaaaattagccaggcatggtggtgtgtgcctgtagtaccagctactctggagactgatatgggaggatcctttgagcctaggaggtcaaggctgcagtgagctgtgatcgggccacggcactccagcctgggtgacagagtgagaccctgtctcaaaaaagaaaagaaaaaagaaaagaggagtcaggcatactggctcatgcctgtaatcccagcactttgggaggcagaggcagacacatcacttgaggtcaggagttcaagaccagcctggccaacatggcaaaaccccatctctaccaaaaatacaaaaattaactgggcatggtggcaggcacctgtaatcccagccactcaggagggtgaggcaggaaaattgcttgaacccgggaggtggaggttgcagtgagccgagattgtgccactgcactccagcctgggtgacagagggagactgttttaaaaaaaaaaaattaaaaaaaaaataggccgatgaggtgaagcagagagtgagcaaggcagagaatgctcagagaggaggctgaagatctagaacagaggccaagtcattgtggacgctgagggcaatgtagggcaggaatgcaggagtggaagcagggagactatgaagttattgttttagctcagtaagagatgacggtagcctagagtggtagccatgaagaaaaggagcaatggtaatattagaatatgcttttaatgcgtagcagatcagaacttaattatgtggatgtgggaagtgtggaatcagacaattcctaggatttcagcctcagcaactactaactaatggggccatttacagagatgggaaaactggggaaagaacaggtttgggggcaaaaatcaagagttccgttttggatatgtgagttattagacagcccaagagaagccatgctagccgaggttggagctcagagagtggtcagggctggagacatgtattctgaactaatctgcatagagatggtttttaaacccacacagtgtgctgctcaacactggtcccaattagaatcacctggactgctttaaaacccttgatatcccggccgggcacagtggctcacacctgtgatcccaacacttcgggaggctgaggcggccggatcacctgaggttgggagttcaagaccagcctgaccaacatggagaaaccctgtgtctactaaaaatacaaaaaaatttagcagggcatggtgacccatgcttgtaatcccagctactcaggaggctgaggcaggagaatcgcttgaacccaggaggtggaggttgcagtgagcagaggtcgcgccattgcactctagcctgggcaacaagagtgaaactccgtctcaaaaacaaaaacaaaaacaaaaacaaaaaaaaaaccttgatatcctgactccagccccaaagattctgatacaaaaggggcctggatttggtatttctttttaaaaagtttctcaggtgattctaatgtgcagtcaaggttgagaaccagggtccatgggaggtagttgtggccatcaaggtgggaggatagtgtcccagaggtcaaataaagacagaggtttaagaagaagggagcaatcagctgaatcaaatactgctaggagggctagttagataaagactgagaggtaactgttaattaggaatgatgaagtgtgttacagatagaatgggagataacaaatggtgctccagtttttcttcattgtgtatgtacagttgtcccttggtatccataggggattggtttaaggaccaccttcccataccaaaattcatggatactcaagtcccttatataaaatggtgtcatatttacatacttaaaaactttaaatcatctctagattacttatgatacctagtacaatgtaaatgctctgtaaatagttgctatacagtattgtttagggaataatgacaaaaaagaaaagtctgtacatgttcagcatagaatgcaaccactactatttcttttttttttcaaatgtttttaatctttagttgattaaatccatggatatagataccatgaatacggagggctgagtgtactttttttgaaacaatctcactctgtagttcaggctggagtgcagtggcacaatcatagctcactgcagccttgacctcctgggctcaagcaatcctctcacatcagcctcccaagtagatgggactacaggcttgcaccaccgcacctggggctgattttatccattttgtatagagacggggccttgccgtgttgcccaggctggtctcaaactcctagcctcaagcaatcctcccaacatgttgggattataggcatgagctacttcacccagccttgattgtacttactgagtgaagttgggagtcataaggcattttataaataaaaatcatttaaaatgttaagggtaatattactaaaagttatattctaaatctcccttaaaaaaaaagatggtgaatctaaataataagtagctacagaaaatttggggaattgagaaaaggaaaaaaaatgttatccaaaagactattgtgtgaacacaatcaccattacttagtcattgactagctttcatttagtgaattcctactttgcagcaggctctgtgctaaggatatagaaatgaatatgacaaaagtatttgccctcaaggaactcagggcttagtggaggaggaggacatgcaaaaaataattctaaaacaaagtgataagtgatataataaagattatactagtatgccatgggagcaaggagatagagagcttaatattgcatgttaaataataattatgaagagtaccttggcaaattaaaaaattgctccgttttaatgttagtgataaaaacaagaaggagaattagtgtaccccatgattacaatcatataacaatgtgattccccaaaggttctctagccaaggagaggcttgagctgcatcttgaatggtgagtcaagcaaataagattaggaaaagggtgggggaaagaataggtaggagtaggaaattccaagctggaggaaggcaaaggaagtgaaacagagtgtataacctgtttggtcactgtaataactttcgtgtggctgcagtgtgggattcccatgagagagtaaccagatataaaactgggaaaacaggcaggtgacaacaagattaaaaagatgaaaaagaatcacatagtgctagaaagactagttggaaagcttttggaataatccaggaggaaaaataataaaagtttgaactaaggcaatggaagaaggacggatggatggacagatgaatgaatgggaggagatggattcaacaggctgtttaagagacaccgtagtcttagggagtggcaagggatggaggtatgggaaatggggagctgggggtgacaagaatgactctcagttctcttgtttggataactaactgggttcttgtcttggttcttattcctggtcatttctacccaagatagtgaatataggatgaagacatttgagaaaactgtggaacatccaaggggagatgcatagggtcaattctgaacctcctggagctcaggagaaagatgtgggctgaagaaacaaattaaagagtcatcattgggccagatgtgatggctcacacctataataccaggctttgggaagccgagcggggaggatgccttgagcccaggagtttgagaacagcctgggcaacatagtgagaccctgcctctgccaaaaaaagaaaaaaaaattagctgggcatgctggtgcacacttgtagtcctagctactctggaagctgaggtgggaggatccctggagcccaggagtttggggctgcagtcagatgtgatgaaaccagtgcactacagcctgggcaacaggagtttggggctgcactgagatgtgatgacaccactgcactacagcctgggcaacagagtgagatcctgtctagctctgtacatatgtgatccgtatgagtcacaagagtagatgagattgggcaagaaagttgcatatatatcatttgtgtgttttcctttttagttatgttattctaactggtatatttccttagttataataatagtgagcatacaagtttctgtttcctttttcaccctacatcataccaaaagcttttgtcatgttgcaccagagttttcaaagtagtcacaactggctgaataaaactatactaacaggatatgctatagttataattgactttgactctgtgataaacatttttattcatagtatttccccatattttgaatttttttcttaggaaagattctcagaaataggaatatatgtatgttatacagttaaagtggactatacatatatccaaatcactttccaaaatgtttgtaccagtttatcaacaaggtatgagaatactagagtattagtctgttttctcactgctataaagaaatacctgagactgggtaatttatacagaaaagaggtttaattggcccacagttctgcaggctgtacaggaagcatgatgctgacatctgcgtggcttctggggaggcctcaggtaacttttagttatggtggaaggcgaaggggaagtaggcacatcttacatggccagaataagagcaagagagagaaatgggggaaggtggcacttttaaacaaccaggtctcatgagaacccactcactatcacaagaacagcacggaggagaaaattcacccccatgatccaatcacctcccaccaggccccacctccaatactgaggattacaatcctacatgagatttgggtggggacacagattcaaaccatatcaactagtttaagtagatacttcccataattttgtattgtgtgtgtggtgtgtctatatttttattgtatttgttaaacattttattgaagtataactacatgtaccaaagtgtacaaatctaaatgtatatagcttgatgaatttccacaaagtaaacgtactttgtaacctgaacctaaactaagaaacagaacattaccagtcactcagaagcctccctcctatcctctcaagggtaaccactgtcctgatttttaacccatagaatgatttgcctgtttttaaactttatataaatggaatcacatagtatgtaatctttcatgtctatcttcctttgcccaacattatttttgtacagttcatctacatcattgtgtttagttgtgatttgttaattctcatttctgcatagtattgtattatgtgaatattctataatttatttattctaatgagtacttagatagtttctagtttggggctattacaaacagtgctgctttatgaacattcttgtacatgtgcttttgatgaatatatgtaacgcatttttgttgggtatatacctaggaatgaaattgatggatcacagatatggacatttcagctttagtggttactgctaccaggtaccaatatccacttccaccagtgtgtgggagttcccagtgttgcacatatttactgacatttcatatttttcattttagcctgtctgttgagtggtatctcatttgccttaattgttttgctgttgttgactaaagatatttagcatttttttttgcatttggttattcttttttgtgaagcaactgttcaagtttttgtttgtttctactatattatctatcttttccttaaaggttttattttgctttttacatattctgaatacaagtcctttgtcaaatatatgtattgcaactatctttttccgctctgtgtttgccttcactgtctttttttttttttttttggagatgagggcagtgtaagagtctcctattttgcccagactgatcttgaactttcaatcttcctgcctctgcctcctcagtagctaggactacctacaggtgcataccactgcacccagcatcctttcactgtcttttcttttttttttccagacagggtctcactgtgtcatccaggctgaagtgcagtggcgtgatctcagttcactgtagctttgacctccctccacctgccttggcctcccaaagtgctgggattacaggcatgagccactgcacccggtctcttcactgtcttaaagcaagttttttgatgattagaagttctttatcttaatattgtttaacctatcaaaaatatcccatatggttagcacatttcatgtcctgtataagaaacctttgcctaacttaagatcataaaaatatttttagattttttaagagctttatttgttttaattttcatatttacagctacaattcatttggaatatatttttgtgtttggtgtgaggtaagggtcaaagtacgtattttcccctctggatatccatttgacccagcctcatttattgaaaagattattctttaccccacttcactgagtattaatattctaagtttttctttttagtttaattgatgaaaagtagtacttcattgtttaatttaaatttcttgactatttgggtggtttgacatttgtccattgtgttaatcaagacaggataggctatgctgtaatagcaaataaagcaccaaacaacgtaggtttatttctctacatgcaaagtctggtgccaacttatggggcagctacgctccctgcagtgattggaagatccagggcactttcaccttgtgacttcgcatcattatctggtctctatagtacctaccagaggagaagacagagtgtgatggtggcgcaatgactcttaagtcttttgtctggaagagacacaccagatgtctgcttacattccactgtctatacccaataacgtggccctatctcactgaaaggagacttgaaggtatactttacccatgtgcccaggaagaagaggaaaactgatacagtgaggtagtggttctgcaacactcccatagttagctaatttattttcaattttgtgaattgttgtatctattgacatttatctttttgtgtatctcatgtttatattaaatcaaaataacctttaagctttgaattctattttaatgtaataatgctttttctaatttattacaagcttgcttactacatatttacctatccttttctttgtagtctttttgtcttattttatttagaagtatttttttataagcagtaaagtattggattttaatttttaacacaatctgggaggctttttctattaatagggaatctacatttaataactaaacttatcatggttagtctcactgctgccatgtttttatgcctttcttttcatgtgtgcatgctgtttcttttcagttttgtcatttgctctgcagacttagttttgtttgctcttattttctactgtgattttcaaagatggccattcctctgattctgctagtgggttcctgaaagctttccacaaatactttaaaaatctacctttgcttaattgaatcaataaaaagccaaacaatagcttttaactatctgcggaaaagaaggcaccaaacgttttgtttttcttctagcccctgttaatccttctttttcttggtcttcattaatttaatctggggtaataaactcagtcatttgaaaaaatacagcgttttttttccccataaagtacttgctattcctataaaacgtttggaaaatattgaaaagtacaaaggctaacaacaaaaatctgccattattttaccacagaaagacaaccactcttaatactttggtatattttcaactgggcctggtggtgcatgcctgtaattccaattatgtggaaaaatccttgacccaggaattcaaggccagcctgggaaagatagtgagaactggtaataaaaatattttgatatatttcctttcattctttttgttatacacattttatatgattgagactatattgtatatatatattttatgctgctttattcactgagatgctcttataagcaaactattgcttttggttattataaaatcttcacaaacattttaatggccttatcatattttataagatagatgagccataatttattaccatatgcttaatattgtacatttacgttattttcaattttattgttactataaataatgttgaatagaattatctttgtgtacaaagagaaaaagcacagacacattttttctaatttaagattgtttcttccagatagattcccagaatgaaattagtggatcaaaaaacaaatttttttttttttttgagaaagggtctcactctgttgcccaggctggagtgcagtggcgagatctcggctcactgcaacctctgcctcccaggttcaagcgattctcctgcctcagcctcccaagtagctgggattacaggcatgcgccaccacacccggctttttgtatttgttgcagagacgaggtttcaccatgttggccaggctggtcttaaactccttacctcaagtgatccacctgcctctgcttcccaaagtgctaggattacaggcatgagccactgcaccctgagcacacacttccagaataactctcatcattataaataaaatctcaatgtaactatattgttgtgatagttctattaacattttagacttagcatcatcttatctcccattattggtgtttatattatcttgtatctatagctaaagtctgttttagacaccagttctttccaacccctatcttccaaactatgaattctttttatgattcagtgattcatggttcattgaattatgacaaatccatgggagaatgttcctaatttgcccccaaagtcctgggattacaggcatgagccacagcgccctgaatacacacttctaatcagcacctggatcatgaaacaaaaaaatcacttgcagctcagaatccccgctcttacttcatggtggcattttgactgtttatttttttatttttttattttttttggaagaggaggaagaaattctcatcaatattttacattcccatattgtttcaaagtttctaaattcatatgaggttatatatgtctcctttgccatgtatcgaattaagaaagatttggcatttagtttttattttctgggaatgcattaagtaattctgaaaatctttaaactatggagtgggaaagatattgtcgaagatcaaagatatttgatattttttacgaaaagaaacttccatttcttttgcctacaaaaaaatttatgctgcagaaacaatgtccagggtaagattttgggcatttttgtttttccctcttaatgtgataaatttatattttggtttaatcagtaaaatttaggataagtaaagtgtaacactagattataattataaattataatttatatatttttaaattacttttcaaagttgcctgctttgttaagaggtacactattgattcaaaatttgtaatatgagcactgtttgcttgttgtactttgtttttgtaaacatttcataataccatgtccttggaggatagcttctagtgcactttgggggaggggatattattgttctgaagttggttacaattatttaacctcaggtgaaataaatctagtaattccagtttttgtttgagaatctagtaattccagtttttgttgtgtatggaccaagggttttctttttttcaaatggattgacaaatctgagagaaaacatttccatcactggagggagcagaggaagtgtaatctagcctattatatacaaaagcttggaactatctcttcaggatttggaaaccaaaactttcaagcagtggttttgtgaattgtgcaatgaagatagaaccaacttaatgaaatgagaattcttcataatctaatgtaatggagccatttgtctaagcaactaatcaaaaaaactattgagggggcgtgttgagattgcagggtaggcatcttaagagctctgatctatattcatacctttggacaaagaaggaaacaaaaatttggaggtgagtccaggcagaggaggccttgttgacatttcaattcactctgataagaaggaagaaggcccaatactcctcatttcaacatttgtaatgtaataattcatacatgtaagagtagatctaatatatacatgtagtttaaagagaaagaataagacaaacatacctccgtactcccacccagcttaacaagtggtgcttttagcagtgtttttgaagtccctctgagttcccatgatcacatgtgcccttttccttgaaggaggtaaccactctgatcttggcttctcatttccatttttttccttgtagtttaatgtattcctgaacaatatatgatttagttttgaatgattttgaatatttgagaaggaatcaaactgactttgttcttctgtaacttgctctttttaatgagcattatatttgtgagcattttaattgttgtgtagtatcccactgtacaaatatacatatctctaatttatccattctcttgttgacggacatttgggtaatttccaggttttgactactacaaacagtagtgccgcggacattcttgttcttatctcctggtgcatagcagcaagaattcctctaggatacattctttggaacggaactgccaggtcagagaatcttcgtctttcacagatactaccttacgaaatatctttttgcttacttcaaaagggcttgggttgccagatttagcaaattaaaatgcaggatgctcagataatttgaatttcaaatcaataaaaaacattttaggataaatatggcctacacaatattcatagtttaatctgaaaaccctaacaaggtcagtgaactttatcaaaccacaaacattgggcaatgaaggatgagtgtgaaggggtggtggggcatttggcctattcttcccctgctagatggccagcccagatgtttatgagcaggttagctcaggggactccagtgcttattaaccagctgtgtaggtagttggttggctccacaactgtatgccaggcaggtgctagatgttgggtattaacacaactgtaaccattacagagaagggtccttgctctccctaggctttcagccaagagggggaaatagagaacagagaacagtacagcaatgacaaatgtacgatgggagcagtggtgtgctggtgaatgcttaataattggctctgatggggagaagcagctctaacttgtagcttttgctgacctaggagttataactactctcaccatggctgacttcaagctacaattgtaacatgtaacattactgaatgtggagttgggaagccatgtacataatcttctcccaggacattatgaacaggctccagtatcccactgtatgggagtactcagaaagtatacctcatccagtctccggactcatttcttttttttgagatggggtctccctctgttgcccaggctggagtgcagtggtgcaatctcggctcactgcaacctccgcctcctgggttcaagcaattctcctgcctcagcctcctgagtagctgggattacaggtgtgcgccaccatgcctggctaatttttgtatttttagtagagatggggcttcaccatgttggtcaggctggtctcgaactcctgaccttgtgatccacccgcctcggcctcccaaaatgctgggattacaggcgtgagccacagcccccagcctctgggctaatttcttgttggtttgggggaaaggggcttaggtggctcagacattaattttttcccttgaatttagaagttaagagtataaaatgcattttagtatgtctataatattggatgctttgtaaatatttttactatggtatagaaatagaaaatagtctattaaacatagttataaattatgatcatcctatagatcggggctcagaccttcaccttttgcatctgaccttccatcaggagacccttgaagacttctcctgcattgccctatcacctgaaacccagctcattgatcgtcatcattcattaattccacaacattgacagagcccttggtctgtactagaggcttaaggccctgtcctcatggagcactcagaacgttctctctagtctcttcctgattctttctaggcaggtttactaccttttacttgctcagttcatttctgtgttctcaagctggctttccctctgggaatattcctccatggaagattgccagaaagcttccaatgatctcttcttgctcttgagatttcttcttccctacagagtggcacgtgtctctttctgtctgaatctgaactcttctgacttttctatattttttcctattgtgtaatctatcactctagccatctaatctttttcttttttttagatagaggtggggtctcactctgttgcccaggctagtctagaactcctaggctcaagtgatcctcctgccttaacctcccaaagtgctgggattacaggcgtgaggcaccgtgcccagtcttgatctatttttttatcggacattttttgaatgcccatatactagcaaatttcaaggtgtggaggagcttctccttgccatttaaaagttttcatttatttgacataatcattttataaaattatgtatttgcacaacttatgtccagaggccttctttatgcttcaattacttcaattacttaaaacgtatttattgaactttttctgaatataaaaagaaatacatgatttgttttacaaaatttggaaaagcatacataaagaaataataactatgtgatctcacagcccaaggctagttattattaactttttggggcacatccttccagttttttttctttttaagagatggggtctcatcatgtcgcccaggctagtcttgaactcttgtgttcaagtgatcctcccaccttggcctcctgagtacttccagtgtttttgatgcatacttaggaataaatccagatcatatccattttttcacttactatagtgtgaaaatgttatcttctctggtattctttgaagacatgattttaaataatggcatgacattccattttcaggctaagctgcagtttgtttaaataactccccattgccagtaaaagccttttttttaaaggttggtgagtgctgtcttatcaaaaaccacatgaagacaggaatcaaacatttaattgtccttctaaggaagtatccacaacaaaaatataactaaagtaagttgatcatgtatatgctgtaatcctctagttatcattaaaaataaacatagccaatctgcattaaatataacatgagttagggtggacgtggtggctcatgcctgtaaccctagcactttaagaggccaaggcaggtgtactgcctgagctcaggagtttgagaccaccctgggcaacatggtgaaaccccatctctactaaaatacaaaaaattagccgggcattgtgataggcatctgcagtcccagctactcaggaggctgaggcatgagacttccttgaatctgggaagcagaggttgcagtgagccaagattgcaccactgcactccagcctgggtgacaattaaaaaaaaaaaaagtactatgaattggcataaggataacttaaaaacttgaagctctggagaaggttgggagaaagataacctaccatcatcaaacctttttggttgggctttgtttaccatttttgagaggaactgagctctgtacagtctcagaattggtaggagctttaaaaatcactcagtgactctaacctctttctcgtagatgaggaaattgaatcaagttacctgctgagactaatactcaggtctcttaacttccttcctgtcccatgttcttttcaccgcaatctgctgactaagcttactcttaaaaatacagaaagagcatacatttatcaacatgtcattacagaaactctgttcctcttatagtgcatgtatttaggtataaaaatcgaatggcaagatcctgggtatgtatccaagggaaaggaaagcctatgtccacagaaagacttgtacatgaatgttcttagcagcattattcgtaacagccaaaaagtgaaaacaatgcaaatgtccatcaatagtttaatggataaacaagtgtggtacactcattcagtgtaatactacttaaaaataaaaacaaactattgataatgcaacaatgtggacgaatctctcaaaaaaataatgtcgagtgaaagaagccagacaaggcctggcacggtggctcaggcctgtaatcccagcactttgggaggccaaggtgggcggatcacctgaggtcaggagattgagaccagcctggccaacatggtgaaaccccatctctactaaaaatacaaagttagctggatgtagtggcacgtgcctgtaattccagctactcaggaggttgaggcaggagaatcatttgaacccgggaggcggaggctgcagtgagccgagatggcactccagcctgggcaaaacagagtaagactctgtctcaaaaacaaaaaacaaaaaacaaaaccaaagccagacaagagtacaaattgactgtatggcctgcatttatctaaaattctatgaaatggaaagctacccatatgacagaaagatctgtggttggagagaatggaagtagtgtggaggaggaaccacaaagaggaaactttggagggtgatagatacattcaccatcttccttgtagaagtggtttcagggaggtatacacatcaaaacttatcaaattgtacactttatttttatttttttgagacagagtctaggagtctcgctctgtcgcccaggctggagtgcaacgttgcgatctaggcttaccgcaacttctgcctcccgggttcaagcgattctcctgcctcagcctcccgagtagctgggacttcaggcgcgtgccgctacacccggctaatttttgtattttaagtagagatggggtttcaccatgttggccaggctggtctcaaactcctgacctcgtgatccgcccacctcggcctcccaaagtgctggggttacaggcgtgagccaccgcacctggccaataattgtacactttaaatatgtgcagtttattttgtcaattatacctcaataaagttgtttgtgagatgtccctcttaagtttgaaaagcagacaagactaaaaactcactgaagtatctaaagcacaaggcaactacaattacttctggagataactgacaatcaaggttcttttctagtatgatagtttatctgaacaaaacattactatgagaaatgcgaagtcataaaaataaaaaatagaaacgacatttttgtccccctggtaatcatgccatttcctcttgtctgtgcagtagcgctatatcataatctttttagtgctctattcaatttggttttctaaagagagaaataaccttgttgtacttttcctgaactagagtgctcttttatgtacaagaagcccaatccctggtgtgagtatacttgtgtgggtctgtagaaagctacactctatctataaattttagcaaatgctgttatttattttgggatttttgtagtcgggactcagcggagacactagaaacaaattataagtttctagaaaccataccttctgcaagatgaacgctgtatagttttcctaaatatgtgattcagtaatcacatttttcatttagattttccacttactgttttaaaacaaagaattgctataccatacagtctacaaaactggtaattttcaatttcctcattaaagattcttcactcttttttagaaaacacgagaaagttttatttcccaactctcccactacccatgtttattttcatagctcttttattcggtcattattcccattctgcagacggggaggcgcacatacgtttttctgcacagtacagaggggcaagaaagaaggaactctcaacttttcagttccattttgagaaacgatcacattgaactcccgagaagcggcagctgagcgagagcagcagcatttctccccgtgttgggtgtgggtcaggagagaggcgcgcttccgcgggagacagggggagtcaggtggcagcggcgctggagcccgagcggcgcggcgggggcgcgcctccctccggccggcgcggggacgctgcccccgcgcacgcgagtccggcaaccccgggctcccgcgccgcgcggcgatccgcgggtgcggcaggggcgccccggcgctctagtctcttccctcgcgcgctcgctccttccccatgcccccaccccccagcccctggcaggtccctcccccaagcctgctcccgcggccgccgctgccgccgccgccgccgccgccgctaccggaggcgcaggagcctcgcgatagtgtttgcacaggcggcgcgtgacgccgccgccgcctgtaactgatgcagaggttaccccaccgcctcagccgccacccacagcccgccgccgccgcctcccgggcgacgccgggggccgacgcactgcagaggtgccggcaggttccgcccgcggaagtgtcctcggccggcgcagcccgcgctccgcccgcgctccgaccccggcccggctggcaccccctcgacgcctccgccgccgcgctcctttcctcctcctctcctctggcgcgcccgctcgctccctcgcttctccccctttccctcctccctgtcccctctccttccctcacctctttcctccccacctcccctcttctcggtttcctcccccatccccttgactctcccctcccagccctcgctctctcgctcgccctcagcgcggcccccgccatgacggaggcgggtgccggtgccgttgccgccgctgccgtcgcagggggggagtcgggttcccagaaagtagcttgatgagtgtccaaagtagcagtggaagtttggaggggccgccatcttggtcccagctctccacgtctccaaccccgggctcggcggcggcggccaggtccctgctgaatcacacgccgccatccgggaggcccagggaaggtaagcaccgccgcgcccgcgcccgctcgcgggcctcctctcccgcgccgcggacccccgcgccccccccccgccccccccgccccggggcttctccgccagaccctggggtgggggatggtggcgaggtggacgcgaggccgcccggctccccggctctggggaggtagtgccctggctgtggatggtggttcgcgggtggcggaggagacggacgagggggtgcgcgctggtggggacggggcgaggcgcatagactcgcctggggttcctgggagccagtcctgcgagggtgggaagcctccccccagacgcgagcccctttctgctccatttgccagtacactcagtactcttaacctcctggcctccggtctctggtgggttttccctcccgctggagccttcgtcctcgagccccctccccttctcccgcgcactcctcccatagaggcggtccccactttgcgagctttgctgcccgggacctggaggatgcccctcgcttgctgggtttctcctttggggagagacgctgaaattatctgggcagactttgatcccctgtgtggccccctagagcaatttaaacgacagactgactcgtgggcaggcttttaaaaccgcccctccagatggttgcaactttctctccttcgccgttgcttcctgcgtgtttgtgcgttatattctctgctgcaagtaggctactgttcttctgtgacagggtcgtgggttttgtgggaaatatctgcgtaaaggttattgcaaacacgcaccaaatcggttacaattgttttctaagttttctggcttcttgcaagcaagtgggctgccaccagatgtagcagttacacagcttgtaaggcaccggcgtgcttttgactaaaatttcaacttgctgtatctaagtatacaacataaaatgaaatttgggagaaaacacatttatggggaatgaataaatgtgcatggaatgtcttttaacgctctttagtctggaaaaagcttagcggtattcatccgcaattggtagacgggctgttcactcctagttgtcgcacacgaggagataggcacattttcaaatgtctggaagttcaaccgtctagtgaatgttttaaagaaatcaagagcttcgatttatgtaggaatcggtgcgagtactttattttgaaaatatctgtcgatatttgctagtcagagccttgacaagtgttaatcaagtgttttgtgccctgaatccagtggttcaggcatagcattctttgtcattttgttcctgtgagcatgtgtgaaagtgacaataggcttaaagattggcatgaatatgctctagaaaattcacggaaagctttgatttatgggatccattaaacatgcggaatacattgacagacgtttccccctttcatcttatcccaacgctgagctttcattgttagaatatagaagtttatttattaaatgactagaaatttagtatatctggtgattcttttgcacttgaaaatttttaaatgaacggtttaaaatgtatttcatagagaagttgatgcttgcttttagcatgcttttacttttgtttgtagtttcattaagatgtttaatgttagtgttatgagtttaaaaagaccattttattgtttcttgtttaaggctatatcatcattcattcattcattcattcattcgtttctcgaatatttattgagccattactgtgagccaggccgtgaactggatactgaggacatagtgttgaattatctcttgatatctgttatcagtattgggaatttgggagacaaaacatctagattgtgagtttctgaggttacttcaacttaaaaacattctgcacttttcctgatgtttgaaaatttggaggggttggaatcatttagcttgaacttccaaataaccataattttttccggcagtttagattacagtgggtttttatgtaacctaaagtagtgagtttctgttaattcatgaaatcataggacaggcttttgtgaaagttacacttcacaccgagtacctgtatagctacagggggatatttctttttgaccaaccagcatgcaagttgaaactattaatcctctctagggttatattcattttgaagcttggcgatgtgttctcagatttcactaacgctaacaggaatatgaagccctgagtgtcaaaatggagatgatttctattgagcgaaatctcagtttttattttaagtgtttagcaccttttccaggtatacatgttagtacattatataaattgatgaagttttagaaagctttttaactgctagttactgctagtaagaaccgttaatattaatggaacttgaatgtattgtatgtatcacggtgaaaactaactttgtttcttgaaaaattgagtcagtttaacatatagtaatagaataattgaaacttaaaagagatacacatgtatgtgaacttacataaatattctatgtgatgaactccttttaggcagacttaactttgaaaatgggttatttttaaaaatatgccataagcatctgtaaaagttacttattttgaagttttgacatttgaaaccacaaacctaagattatgatctgattatttttgatgctgtatgttgtagttttgtttctttttaccttattaccattatcatattcacatagttttatcacaaataaaatacagctctataagatttgggaatctattagaatttaggaaattatgtgataaatatagtatagatttctttccctcgggtcccaaagcttttcgcttgtcagtcttgtggttctgttagaggagttcagcgatgtagctctagattttctgttgaatcttttaaacctataatctccatcccattttgtcttctataatcctgtgattaagggagtgacgagttaaaaaggttttcaagtaaaggccagttttgctttgttgaagtctaggaacctagtgtcatattggctagataagtagttgggtttttttgcatatcagtacatgggtacttttgaatgggttattgctgagaatcagatgattgattatatagaacacttgcattttctttcctgctccaacctgccaattataaataatttgctttacttttttgtaaatagtgaaagcttggtcaaaaagattgtatgggccaggagtggtggctcaagcctgtaatcccagcactttgggaggcctaggcaggtggattgcttgagctcaggagttcaagaccagcctggacaacatggtgaaaccctgtctctacaaaaaatagaaaaattagctgggcatggttcaggaggctgagttgggaggattgcttgagcctgggaggtggaggctgcggtaagcctagatagcgtcattgcattccagcctgggtgacagagtgagatactttctcaaaaaaaagatggcatgatagttcgattaaactgtaaacttcctctgtttccatatttaaagactgcattccttagaagaattaaagtaattgacttcagatgatttagtaatgagatgttaaaaacgaaggtgtaccagatggccctgtaggcctttaattttttgaaatcactagctggaggaggacagggttatgtgtttaaggattctagctcatgaatagatatgtgacagatgtctcctttacaatggcacatttacatattagaggagagagataaaagagagaaaccagaacggaggtttgaaaatcttatgagaaatagactatgctttagccttttggcctcagggcctctttactctcttaacaattattgaggaccccaagagatttaggtttatgtagattatatctactaatatttgctcttttagaaattaaatgacaatttcaaatatatttattaatttaaactgtgttgtaaatagaattttttatgaagaataaatatgtcctaaaaccaaagaaactagaccagtggcattgttttatatttttgcaaatcaccttgatttctggcttacttggagaagacagctggattttttgtctgccttcagtctgttatgatgttttggttgagatatgtgaagagaatccagcttcatgtagatatatggttggaaaaggaaagagtgagtattcttctttggtattacatcaaaattcaacaagtggcagttttttgttttttgttttttaagttactgacaatgtgaaagcatattgtattccaaaaatgtctctaggacctacaggaagtctatggaagatacatttaaagaagagactaacggttgggagacgtgatagctgtctccaggtatttaagaaacttggatttcagtaaataggatttaaaaacctgttaattttaataaataggagggagaatagatccattctcctgctttagaaggcagaccaacgggtgaaaattaggaagacattgaggtcagtctaattttttaccagaatgtaagaactgtatgacaactagacttggaacagtggaacagtggagcaacaatggaactcgcaacagctaacaacaatggaaagaagtagttagttttgagaatttaaagtggactacagggacatattttttggggaggtggagataaattctgtagattcttacgatgagtgctattggattagtgacttaaggcttcatccaatttaaaaatgtaaacattctgtgattttttaaaaatccctaaatatagttaaactatacttatatatattcattaacgtttttgaatgttcttgcaagtcagtagtatgaaactactgttgttgttgactttattactattttgcatttttattgtgcttttcctctgaggatttttctgtcttttcttgtgtcagcaagatcagtcttcatgaaatcttgctaaattccctgtgaaatataataagcttaagacattttagagaaccaaatgctgtttatgatacagtttagtagagttgtaatatatttcagcacagaattttagaatactatgggggctgattttcaattttgtaagagaaattatgagcatagtttatatagtcttttatttgtaattgtttacgtgatttcagaagtaatatgcttaagttattctaatgtttttaaagctagagagtctgaaaagagggaagaagaaagaaaagtgtttaaattgatctcttttgaatttaaaatgcatattaagtataactagaacataaaatgaagaatttaaattctcatcttattcctagaattatacctataatatgtatcattacttataacaattcatattttaattttgcatggcacataatctcttctgtgagttggatttttaggtggtgggaatttaagcataaattctcataactttcttggggtcaatttaatattaataagtgtagtaagtaataatacccagcttgagacctcatgtacttgttgcatttggatttaaagctcatttcctatagaagagctgtagaaatcagtcatgtagtttcataaactccttcatgcttgttaataattttcaagaatcttaaaataaattacaggaatattgttatgaagtagtagaagcagtatggtataggggagaaagtgattgtagttgggatctgaggatagtctttactttgctattaactagctgtgtgaccttgggcaagttgcttatctctgcttcagttccataaactaagaattacagagctgaaccggatcttggaagcaatctagtacaaacctctcattttacagatgaggaagcagataatttgcacaggctttcactgtaagacagttgggcccaaaattcagttttctgactctcaggttggttttttttttccattatactttacagcctcttttcatctgtaaaatgagagcattggattagaggctctcaaaggtctcttccagctcaaaaatattgtcattcctgtgacattagtcgtaatataatttattaggggaaagtttgtagcttttatttattggtgaaagaaatgtttcttgaagaggcagtataacctttgcaaggttatattttgtttttttaagagaatatcatcaggcgaggtgctatgtctcaggcctgtaatcccagctttgggagaccaaggcaagaggattgcttgagtccaggagtttgagactagcctgatcctgtctcaaaaaaaaaaaaaagttagctgggtatggtggcatatgtcggtagtcctagctactggggaggctgaggtgggaggatcccaccttgatcccagcagttcaagactgcagttgatgcagtgagctatgatcatgccactgcactccagcctgggcaacacagtgacaccctgtctcaaaaaagaaaaaagaaaacatcttcattaataccaaagggtatttaagtttatgagcatggtaagtagtgtgataggtagtcttgttttttgtaaaacacttattaatatattaataatataaattgcgtaaataacagtgtgatacccggaagtgaagtaagtaggtgattgttcctcagaaaatattgctggagtttattttatctgggacccctgtgtctgcccctagttaagtgcctgtgttgtttagtgtctcacaggattgtctgtttccatagcatctgcatcatgctacttttattatagttttatttatattgtctactagacagaaaggtcttgaattcagagactatattttgttcattttcgtattttcagtgcacaggaggacatcctctacagagttggcactcaactaaaagttttgtcaaaggactgtttcacatacatcatctctctatatatcatggtatgcacatatttcagacccaggaagatgcttattttagtaattcttaagtgaactatattttagagggtgatatggataacagtaacagtaatagctaaagtttattgtgttcgcacatgttaattcttatatctcataactctgagttacatacagttgttattcccatcttcagatgagaaaactgaagcacagagaagtaaagtgacttaccagtgtgacctagagtagtacatgatggggatttgaaccaagttggtgtattttaatcactaggatatattgcctaaaatatgaaaatttggtttttagtattttagtagtttttcctaagcagattttaacttactaatcagacttccaggcttattcattttacttctaaacttttgttaacttttttttgcatgagtttttatacacgtgtgaagataagatttaaaaaaatacaaaaaccccaaccaaacaacccaatttagaaagctgtaccagctgtgcaaatcctacacttcatttttttaagataagttttgtccattcatggaaaatgttagagatacatcaatgaaaaattttatttccatgttagataatctaatttgtaattccatttatcttgatattttggcctcataaacccactggagccataacaagtaaatactagaatttgaacaaaaaacttcccactgtcagtatcggagcagtctatttattgtggaggctttataacctgatggacaaggctttaaactaaattataatgctttagtggcagatctttgactctgttaatagtattcagtatgggcaaggggaagaggatgtgcagtctagctaatctgtaaaaaagtattttaaaaaaatacttagttttaattcttttattgctaacaacaacaacaacaacaacaataacaaaacctttggtagcatgtattatatagcaaacctaattgagaggcaggatttgaatggattgataggaatttatcagtcatggagtggaaagatatgcagagcagagcagatccaggtggtaggttgtcaaacttgaattaaatttttccaatgtggcttcatcattaggtctgaaatttaatgaatttcaagaaggcaatttaacctgtatttaaataaaagtgattatattctacatagattcattagccaaatataagtattttggggggatgacttaaaatattttttcctcttcatctatgtggattgttaagaattggttatactcataaatttgtgcttttccttgaaaactaattagctggagtaaataaactactaggtttaaattcttgctgttaatatgataagttgtgtgacttcatgattccccactggacacttaggtaagtgcttcctatctgaggatgaatgtagttcctctggtgaaggtcagaggggtttgtgtgaggctaatcatactcatcctgtctcctaagaccagagacatgttttacttttttccttttttgatactgtatatttgcctcataaaaaatataaaatttcccttttccttgccgatttcttttaaacatctgtgtaaatatgtagtttagttcaactttgtatactactctgttacttatttcatttacttaaagatacttatttcatttacttaaagatacacatggctgggcgcggtggctcacgcctgtaatcccagcactttgggaggctgaggcgggcggatcacgaggtcaggagatcgagaccatcctggctaacacggtgaaaccctgtctctactaaaaatacaaaaaaattagctgggcgtggtggtgggcgcctgtagtcccagctactcgggaggctgaggcgggagaatggtgtgaacctgggaggcagagcttgcagtgagctgagatggcgccactgcactccagcctgggcgacagagcaagactccgtctcaaaaaaaaaaaaaaaaaaaaaagatacacatatttattaatgctggacactattcccggcatttgtaaatagtaattcatttgcttctcctaacaatcacatgaagtcctgttattatcccgactttatagatgaggaaattgaggcatagagaagttaagtaatgtatccaagggccaggcacagtggctcatgcctgtaatcccggcatttagggaggctgaggtgggcagatggcttgagcgcaggagttcgagaccagcctggacaacatggtgaaaccctgtctctacaaaaatatacaaaaattagccgggcattgtggtgcacgcctgtagttgcagctagttgggaggctgaggtggatcgcctgagcccaggaggttgaggctgcagtgagccgtgattacgccactacactccagccagggcaacagagtgaggccttgtctaaaaaaaaaaaaggaatgtacccaggcacacatagagaatatttagcagagccaggattcagactgggctgagtacatgctcttaacagttacactattctgtcaatgttatttccttgaatggatgcactataattggttaactactcttctttaggtaggatgttagtcatgaatcctttggttacacgtaataacaacacgactttgttaagttaaaaaatgagtgtattggttcacatactgggtattgtatgtggagggtgatggaatggctttggaaacagctagatccaaggttgcaagtaatgtcattgggtttctttgtctcctttctgggtttttctagcctcttgcttctggagccccagacatatacctttagcttagcaaccacacttgaaagacagcttctctttcctgatgtccacatgtcagttgtgttgttggtaatcaattctgattgtcagttccttaaccaatcattggaacctgggagatgagctacagcaagggtagccactgtggtggctgtggttagggtgagttggggaacccacagaaagccaggattgacagtccccttgagatgacatgaattggatgaggtgtagttttcctgaggaagggatgataatgagcaaaaaacaactatagcgaatcatttaggttatgtctttttaattttaactttataactgtcatagataatgatacagtaactgagtaaaagcctccttttttttaaatactagattttcagtcatggaattacgagagcagagtataaaacaattttagggctttcggtaaatgttgccagattatttttttgaaggatacgtgtacttagctcatataccaacagcaggcatgaggtgagcatgtacttttgaaccaggtagggttcaactcatcttagaaatactgtactgggcttaaatattaacacatgccttgcacttaatcacagggttgcagacttgacactgagcaaatatctaatgcagtttatcaaatgtttcattatattttatctggctattttttattttcatttaaaaatttttattatacagtctttcgttcgttcgtttgttctttctttctttctttttctttttcctttttcttgagacaaggtctcactttgtcacccaggctggagcacagtgacatgatcacggctcactgcagcctccaactcctgggctcaagcatacttcttcatctcagcctcccaagtagctgggactacaggtgcacgccaccatatcctgctgattttttaactttttgtggagacatggtctccctatgttgcccaggctggtcttgaacccctgggctcaaccagtcctcctgcctctgcctcccaaagtgttgggattacaggcttgagccattgtgcccagtctattgtatagttttaaaaaacaaaaccaaaaggctaataaatggcacccctttgcaagctcttccccctcctttctttttcttcccagtgtctcctacttctctgacctagttgacagcattatacttttggatgttggtagcatgtataaagtacattattacataacaagttaatataacataatagtttcaagggttttgccacttaattatactaagttacttaacctctcaatgccttatctgtagattttgtttttgatagggtgggatagtaatagtaactacaaggtttcacaaggttgtgaaattgaatgagaaatacatggcactttaacaagtcactatggattatttaatttcttttcttcttcttctgctgctgcttctccctgcccgcccctacccttttttttagagacagggtcttgctctgttgtccaggctagagagaaatacaatttatttactcccagtaaggaaaatcttagaaatgttaaaaaaaaaaaaaaaaaaaaaaaagaaaagtaattcaaaggatgaaaaatgactatttgcataatatttaccacagtattatatagtgacaagaaatgagaccaacaactagattaagttttggtatacatatcaacaaaatcaactaaagcaacgtgatatatatatatatcgcacatacacacacacgcacacgcacacacacacacacatatatatatatatatatatattttttttttttaagacagagtctcaccctcttacccaggctggagtgtagtggcacgatctcggctcactgcatcctctgcctccagggttcaaatgattctcacatctcagcctcctgagtagctgggactactatgcatcaccacgcccagctaatttttgtatttttggtagagagggggtgtcaccatgttggccaggctggtctcgaacgcctgacctcaggtgatctgcccttctgggcctcctaaagtgctgggattccaggtgtgagccactgtgcccagccttgtatacattcacttaaaaaataagtaggaaaactgtgcaatatggaaacatgtacaaatgacggaacattgcctaaaagttactttgcaatgactccataatattagcttgttttttgtctcgcctttctctcaaaagaaaaaatacaccaccaagagcaacaatgacaaacagcatgcccaaagtcacgcagatgagaagtgattgaaaaaaggatgtcaacccaagtccacacttctaatccctataccacactgcctatgttcccactaatagtaatacacacattattaggcacctagtgcacataaagcactctttctccttggtactaataagaacacacaaaaaaacacaatataggcccctttcaaaatttgcaatatagtgctttacagtatgcagctgctgctgggtgtggtggctcatgcctgtaatagcagcacttggggaggccgaggtgggcggatcatgaggtcaggagatcaagaccatccaggctaacacggtgaaaccccatctcaagtaaaaatacaaaaaattagccgggcgtggtggcacacgcctgaaatcccagctactcgggaggctgaggcaggagaatcgcttgaacctgggaggcggatgttgcagtgagccgagattgcaccattgcactccagcctgggagacagagtgagactctgtctcaaaaaaaaaaaaggaatgactgcataccaatacaaagtataaacactgctaatccaaatctagtgcttgatgcttaaatggtataactgcgtctcatacatgtgatcaattctaaagccacagaaaattacaggcactaagatgatgaaagcagcaatttaggatatcatttgaaatctacatctgtgagctacagttcttcaacaggctggagaaacagaccatctaagtcaagcatgctgtggctataaggaacatttattcagatagtatttggtccctattctttgccacataaacagagaggaaaacatttaaattctaaagtatcattatatccacacataatagtgatagttaaaacataagccaggtgcagtggagcatgcctgtagtcccagctacttgggaggctgaggcaggaggatcatttgagcccagaagttgaaaggctgtactgtgctatgatcacaactgtgaattactttttgttttttacatttcaaagatttggcttactgggcaaagggggcgagtatttttatgtcgtttaatctctgttgtcactgttgttttcttagtggaataactgggattttagtctattgttctctgagatgaatcagttgtcagagctatagagttttatagaaaacttattggcatagtttgttcattcagcaagtatttttggacctgaagcctagtaatgaggaaacaaagataaatatgatgaagttagtccttgctttctaggagcttggtcacagtctagtgaggaaggataatttctaacatttaatttatacttttgaagaacaccttgtgggttagataaaacaacccgaattgccagttttcagcttctgagataagctatatcaaggtgttatattcattggtcatttggttgctagaaattaacttaagcaaaacagatttattagtagtagaaggttatagagctgggtatcccttagaccccagttaggccttaaggaggcctactgaggtagaaaccggaaattcaggaatcacagtagcattgttctcttgtggatcattgagcaactgtttccagtgctgtgaaataaagttttctaaaaaggagaagtgggaaggaaggaaattgtatttctgccacagaggttgtgaacaaagtactccctacagaagggagttacacagttttcctccagtttaactgctgttaaaatggtatcttgtttcagttgatatgtcttgattggtagtgagattgaacttaatatttttatcaagagcccaaagccaatttttcttgacgtctgtatcttagacatgagaatatatggtagtgatgttaattcttgttacatttgatgaaactatttccaccgtcatattttttcttttatatatttgaatattttccattgtataaagttttatgcttttattgaattcaataccagttgttctttatattttatttattttcttatcagatgggtcatatgctgatgtcataacaaggtttgagagaggcacctcttgtgtgtgagcacccagtcatcacacttaagaactacaaaagaatcacattcttacagagtctcactctgttgtcccggctggagtatagtggcgcaatcatagctcactgcagcctggaactcctgggctcaagtgatcttcccacctctgcctcctaaatagctaggacttcaggcacacttcagtatgactggctctttatgatactttaatgagtataagtctttaaaagttactgctttctgaagttcaagtactctaattttagtgtgattcaactgattttatttctaaattttatatattttatctttcatattgaagcataacacatactgaaaaggcacacaaagtagtgctcagtaagttattataaactctgacctgtgtaacgaccactgagacaagaaatagaatattgccagcacttcaaacactctccttccccatcagtcactaccttctccatgctccccaaagtaaccattattctgatttagttatgcctgtttttgagtttgatataaatggatccacgcattatatattttgtatctagatatttttgccccacatattatttgtaagattcatccacattattttctgaaactgtaattttaattgcactataatattactttgtgtgaatgtactacattttatactttgttgattgacatttggattgtttccacttgacaaaatattaataatggtattatgaacatgtttatacctgtctcttcatacattatatttgttttttgtttttttttttttgagacagagtctcaccctgttgcccagtctggagtgctatggcacaatctcggctcactgcagcctccgcttcccgggttcaaatgattctcctgcctcagcctcccgagtagccgggattacaggtgcccgccaccatgcccagctaatttttgtatttttagtagagacagggtttcaccatgttgaccaggctggcctcgaactcctgacctcgtgatccacccgccttggcctcccaaagtgctgggattacaggtgtgaaccactgtgcccggcctttttttgtttgtttgtagtctgtgtcttgctctgtcgcagtggtgcgatctcggctcactgcaacctctgcctcttggattcaaacgattctcctgcctcagcctttccagtagctaggactacatgcgtgcatctccacgcctggctaatttttgtgtttttgttagagacgggtttcaccatgttggccaggctggtctcgaactcctggcctcaagtgatctgcccatcttggcttcctaaagtgctgggattataggtgtgagccaccgtgcctggctgtaagatggtatctgtgtggttttaatttttcatttccctgatgactaaggatgtttaccactttttcataaagtttattggccttttcgttatcctttgtgaagtgcttgttcaaatcttttgttcatttgtctgttgtgtttgtcttttaaaaaccatacttgaaggcattctttttgtattttggatgagaagtcttattttttattaaaactttttccccctattctgtggcctgcttttgtcttctctttatggtatttaagaagccttttcttatctcaagttcataaaaatgttttcccatattttctgtttttaatataggcattatagctgtaaatttccctctaagcactgatttagttcattccataagttttgatatgttgcctttttgtttttattcatctcaagtattttctaatttttctttttatttcatttgacccattatttatttaggaatatgttaatttctgcatatttgtgaatttctcgattttttttctgttactgagttctaatttaattctattgtgatcagagaacgtactttgtatcctttttatccttttcagtttgttgatgctggttttatggtctagcatagatcatctatcctggagaatgttccatgtgtgcttttttagaaaaatgtgtattgtgttgttgggcagaacgttctctagctgtcttttccatctagttgattatagtgtttgttttctgtttccttattgatcttctgcctagttctattcattattgaaagtgggccatttaattcttccaactattgttcttggcttgtctatttctccctttaattctgtcagttttgcttcatgtaatttggggctctgtcataaagtgcaagtgattagaattcttatatcttcctaataaattgacccttaattgttttaaaatgtttctcttgacctctcaaaacaccagtttttaaaagtttgtctgatactagtatattcatgccagctcttttgcatggtatgttttttcccatccatttactcttatcctgtcccgtttgtatttttgaatctaaaatatgtcttaagtagacagcgtttaattggatcttattcttttaaaacccaatctggtaatttctgcctcttgagtgtattatttaatccattcacatttagtgttactgatagggttaaatttgtctgccactttgttttgttttctataggtctcatttctcttttgtcctctttccctcctctactgctgtcttttgcattacatgagtatttcccagtgtaacattttaatttctttaatcattttaaaactatatttgaattactagtgattactgtagggtttacatttatatatcttagcttatcagagtctacttcatagctacattaattcttgcaatatatagaaactttagtcctgtatagctctactattccacctcccccacctttttttttttttttttttttttttttttttttttttttttttttttttttttggagatagagtcccactcttctgcccagtctggagtgcagtggtgtgatcttggctcactgcaacctctgcctcctgggttcaaacaattctcatgcctcagcctcccgagtaggtggggattacaggcatgtgccaccacacccagctaactttttgtattttagtagagatggggtttcactgtgttgactgggctggtcttgaattcctgacctcaagtgatcctcccaccttggcctcccaaatgtatcttttgatgaaactgagataaggaaaatacattttatagtttttgtactaaccttacttgtctattcatttaccatttgatatcatttccttactttcagtaaagtttgtcactactgacccctttgtccattcgtgcattcattcattcattccttcattcagtcattcatttattgagagacggagtctcgatttgtcgcgcaggctggagtagtggcatgatcttggctcaatgcaacttctgtctctgagttcaagtgattctgggttcaagcgaatccctccggagtagctgggattacaggtgtgagccaccatgctcagccctgatttctgatttgactccattctagtaagatttaaatccctaagacttaagttcttggaaatttgagacttgctttatggttcaacatatggtctttttgggtaaacattccttgtgtacaacaacaaaatatttatagactacagttgttagatgtggtgtaatatgttctatcaagtttgtttctgtttcagatttttactgcttttgcatttgtttgctcctattcagacaaaggtttgttaaaatatccccaaatgattataacatttgtctctctgtttaatttgtcagtttttgttttatatattttgattatgttaaagtgctgacaagtcaaggtttttttaaatctacctggtgaatcaaactttttattattgtgacgtgtccctctttatctcagtattgcattttaccttgtagtgtttttaatctagtgttaaggcagatacactaactttcatttggtgtttgcatgctacagctttttccattctttcagctttcgcgttttagccatatcttttaagttgcatatactagtttaaataaactagtttgaccatgtttgttctttaattggaacatgtagtacatttacatttaatatacttgctgatatgtttaaattgatattcctaataaatgatttctgtttatcctgtttgaactttctcttattctccttttctgctgcttttgggattattattattttttgttccaaataccccccaccccccaacttggcttaatagttagaccatctttttttaaatttgtttttaatatttatcctagagattacaatatgcctcctttctgtgttaaagtgtgatataagttagcacttttttctctttctggtcagtgcagcaacattagaaaacattaactgtacatttccctctccagaattacatactattgccagatagtttagttctctgatattttaactccccacaagatattaccattagtgttttattcagtaattatacatttaaatttgtttatatactcagtttttttcttcaatctttagtgcatttccaggcttctagctgggttgattttctctctgaaaatactcttttttttctctatttgggcctatctgttgaggaattcttttttgcttatctgataatgcttttttttcatttttattcttgaagggatttttttggggggagggagctggatacagaaatcttggttggcagtttttttcatttgtcatgttgcagctatgcacagtgcccttgagacctggtttccagagtttctgttgagaagtcaactatcagtcttactgttgctcctttgactgtaatctagcttgtagatctctggtcactttttgtttttgttggagtgggggtgtttatatttggttttcagcagttttactgtgatatgtctaggtgtgatcttttatttgttcagcttggtgtttataggacttcttataactgtgacgtaggactgcactgcccagtgccagccactagctgcatgtaactgttgataccaattaacatttaaaaagttaaaaattcaattcctcacattttaagttctcagtagacaaatgtttctattagttactctattggcagatggagaacatttccatcattctatcaatagaatagaaagttctgttgcacaggactgatgagctcgttcgtcagttttggaaaattctcagactatatcacttcggatagtgcttctgtcttgtcatcttctttcctcctggtactccagttatacatgtattaaacattcttaaatttgccctatgtttcttacatccttttttgtatgttttatctttttattcctgtgtgcatttttaaagatatatttttctgaccaatcttccatttcattaattctcttaggctgtgtctaatatgccatcagactcatacactgagttctttaatttagtttattttactttttggttctagaatttcaattttattctctttagtttcaggttttctgctaaagttctcagtgttaactactcagcatacttattcgagagtctgtgtctgataacttaattatctagatacctttgggtcttgttccatgtttcatttgcattttatttgcgttattttcttggatttctggttaatttttattgtgtatgagacatttgatgtgaaaaactgtagaaataatttgaggcctagaataatggtagtcttccatgacataaaatttacatttaattttgacagaaacataggggccctataaatctgcttttcttaattcacttttaaggattgagattatttgaatctgggctttaattgtaattcttttgctctgaggttgagatcccaacccagagtttgggggaggctcagggtctcatttttgtctggctaacccagtgaggctttcagatgttttgcttagctttccagcctcacagtcactacttaaatcagcagatgcctgtaggggagaagaaacctggtataccagactcacttctgggaacttagtgaattctggccccatttctttactgcctgatctctagaagtagagttttcgttttttaaacttagttcaacttttcaagtttcttcagccagaagattggtttgatgacctgatcaccattactggaaggagaaagtccttgtttgcttttatttttaattctttaattggctttgaaattttgggtgaatctgaatctttttctcctcttaaccacgctcttcttctctcactctctttatcttccttttgtttaaattatcaattggttatatcgggtccacaacaccagggctgcatacctgtactggtcgctatcctgtgaggaatgagccacacagcgggaggtgagcagcaggccagtgagcattcccgcctgagctccacctcctgtgagatcatccgtggcattagattctcagaggagcgtggaccctgttgtgaactgcacatgcgagggatctaggtcgcttgctccttatgagaatctaactaatgcctgatgatttgaggtgtaacagtttcatctgaaaccatctccactccaccccaccccaccccaccccacccctggtccatggaaaaattgtcttccatgaaactggccactggtgccaaaaaggttggggaccactgggttatatacagagtttgaataggaccaacttgtggagcagttagccatctggaattgtaggtttaattggaagcagaactatttttgcctttgatgccttgaagataaccggtttttgttgttgttgttgttgtttgtttgtttgtttttgagacagagtctcactctgttgcccaggctggagtgcagtggtgggatctcggttcactgcaacctctgcctcccagattcaagcgattctcctgcctcagcctcccgagttagctgggactcgtgtgccaccatgcccagctaatttttgaatctttagtaaagacagggtttcgccttgtcgtccaggctggtctcaaacccctgacctctggagatctgcccgcccctgcctcccaaagtgctgggattacaggcgtgagccaccatgcccagccagattactgttattttaagtttttttggcaaccggctagtaccaatgtaagttaagtttggattcaaataaaatcgtcagagcattacaatatatttttaaaagacagctcttcgtgaaataacattatatataatatgtgtgtgtatatatatatcctattcctttaatgctgggtattttctcagctctgtactcaattctttgtcctgtaagtaaaaatgtgatacacgtcttagtcactttgcttcttttaaattataaccctttgagcagtagtttaatataaaaaagttttagctttcgaaacagacttttagagttgctcatactgtataacaccctttatgcctttggaaaatttcatcttatgtattgtagttactgtttcaatttattgattatttagtaaaaaaatatgaatgtctttgtggatgttactgtattgtacgagttgtaactttagagtgccactagcaacatacatatgaaccagtttaatggaaacattactgctcttagtatttttaggaagtgtttggcttgttaagtaggggtggtattacatgttattttacttactacatatatttgattaccaagagattaagcagttttccacgtgtttattactgtttctatttgtgacttgttttaaaaattaaaacagtcttaaatctcatcttggacttgttactcctgctcattactgccaaggcttactatagtatttacaaactacaaggagtgtgatagtttttatgttaagattacttaaatttctttggactaattttcttctctagcttgagaaaaaaatgattgggatttttaagagggattacgttatttcgtactgtcctccaaatgctgccatctgaaatttgaaggtttgcagtattttttagataagtataccttggtatgggagcctctgtgctaggaccaatttatagtagttctctactctctatttgctattataaagccaaaataaatatattaaatatgtcgttgtaagtatattagtatttagcaaattctcttcttccttaaattttatgttaataagttaactggctaaaacaaatgtgtacatggccagttagaacactgtctaaaacttcttgatataagcaaacattttagttatctttgaaagctcacacgataaattacaacccctatctctacccccttgagcttgcttttaagaaagtgataaaagtgatgcaaactttttatcattagttctcaataattttattgtataatttaacttttataggatgccttttctaaatttgtatgaagtaaaaataactttcagtccagttatttgagaagacaaagctgtataactgaatagttgtataaatcctgtttattaagagtgctcaaagagcttaataactaatgaaagttttttttttattttttacttttttattttattttatttttttttgagacagagtctcactctgtcacccaggctgtagtgcagtggcgcgatctcagctcactgcaaccttcacctcctgggttcaagcatttctcctgcctcagcctcccgagtagctgggactacaggcacacgctgccacacccggctaattttttgtattttagtagagacggggtttcaccatgttgcccaggttggtcgcgaactcctgagctcaggcaatccgcccacgttagcctcccaaagtgttaggattacagacgtgagccactgcgcctggctgaaagtttatcttaaaactgaggcttattccggatactaaagatattaaacaaggcatatgtgcatgtgcctgggtgtatatgtagatggcttgggggtagaaataaaataaaaagccacagaaaaggctatggctttttattttttaaaaaatcacttcattgaatcaacattttaatttgttgatattcttttttgaatttacttcgttttatttctgctctgcatctaattccttatttgggataagatatagagcatgagtcagcaaacttttttttttttgaaacagggtctcactctgtcacccagcctggagtacagtggcatgatctcagctcattgcagccttgacctccaagcctcaagcagtcctctcaccttgcctggctaatttttatattttttgtagagatgggtttcaccatgttactcagactgtttttgaattcctgagctcaagcaatccaccagtcttggcttcccaaagtgctgggattacaagtgtgagccaccacacctggcctaaactgttttaaaagagttgtcacaactacgacaggtgcttgtgtttgtgtggtaaagtgcagccatagacaatatgctaacaagtgggatgactgtgttctttaaaaccttactatggacactgatatttgaatttcatattgattttactaatcacaaagtagtcttgatttttttaccttataatatttaacagggtagtcactgctgcccgtccttgtatagagtaactttccttgaggaagttcaacccttctagttacccagctatccaggtagttgaaagttttaagttaaagagcagatgtttctctgacttttcatagatcaagaaaagtcaaggaccaaaattgttagctctgtacatatgcaaacattttagccattttttttcaaaattgtaattgtggttaaaaaacacacgacataaaatgtaccatcttagccttttcttttcctttcctgtcctgtcttgtcctgtccttttttgagacagcgtctcactctgtcacccaggctggagtgcagtggtgcaacctccgcctcccaggttcacttgcctcagcctctggaggctgccaccctgcctggctacctcttagccatttctaagtcggtagtgttaagtgtattcctgttgttgtgcagctaatctccagaatgttttcgttttgtcaaactgtaactttacacccattaaacaactttctaattcccctctgcccctaggccccagcaaccactattctactttctgtctctgtaagtttcactactctagatacctcacagaactggaatcatatagtatttgtcattttgtgtctgacttatttccctcaacataacgtcttcaaggttcacccatattgtgtcatgtttcagtgtttccttcctttttaaggctgaataatattccatagtacgtgtgtaccacattttgtttatccattcatcttttgattggacatgggttgcttccacttcttgggtatcgtgagtagtgctgctatgaacatgggtgtgcagcaatgtctttgagatcctgctttctattttctatctagctgtaccattttacattcctactgacagtacacaaaggttcccatttttccacaatccttgacaacactttttttcagtgtttttgatggtagccattctaataggtgtgaggtgatatcttattgtatttttttatttacattttgctaataattagtggtgttgagcatctttttctttttttcttgtcgcccacgttggagtgcagtggtgcgacctcagctcactgcagcctctgcctcccgggttcaagcgattctcctgccccaacctctggagtagctgggattacaggtgcccaccaccactcccggctaattttttacatttttagtagagatggggttttaccatgttggccaggatggtctcgaactcctgacctcaggtgatccaccctcctcggcctcccaaagtgctgggattataggcatgaaccaccgtgcctggccatctttttcttttttaagagataggatcttgttacattgcccaggctggccccaaactcctgagctcaaatgatcctcccacctcagcctccagacactatgcctagctcaattaatatttttaattggcaaatcataattgtatacatttatggggtacagtgtcatgttttgatatatatatatatatatatatatacacacacacacacacaaacacacacataatgtggaatgattaaacaaagctaattaacatatcggtcacctcctttaatttttccagcaagacatttgaaatttattcttttagctattttgaaatacatgtcatatatcattattaactatagtcaccctgctgtgcgatggatctcaaaaacttattttttctgtctaactcaaactttgtgtcctttgaccaacatttcctcatttctcccagcccctggtaaccactattctttctgcttttgtgtgttcaaattttttagattccacatgtaagtgagattatgtggtatttgtctttctgtgcctggcttattttactttgtcctctaagttcatccatgttgtttcaaatgacaggatttccttcttttttaaggctgaataggtccggctcagtggcacatgcctgtaatcctagcactttgggaggcttaggtggaaggattgcttgagctccacctcaagcaccccttgaggtgtgagctgtgatggcactactgctcgccagcttgggcgacagagcaagaccctgtctcaaaaaaaaaaaaaaaaaaaaaaaggccaaatagtattacattgtatatataccacatttttttttttttcctattcatctgttgatggacatttaggttgattctgtatcttggctattgtgaatagtgctgcagtgaacatgggagtgcagatatctccttaacataatgatttcagtttctttggatatatagaaatgggattgctggatgtgagcatcttttcatttcttggccatttatatatcatctctggagaaatgtctgttcagattctttgcccaatcgttagtcaagttgttagccaactatattttaataatactttcttttctctcttgcagtgtgtcacaagtacaattaaataagaaattaacataatttaatccttacttacaaaggtaatatattgcaagaatgaggagaacagtaaggggaatttctgatttgctaaatgccagtctaatagagaagctgaccattccataattgtttttaaagtacatgaacagcaatctgagaggatgaaatatatatataatgtgactaaaaaagatatgggattgatttttatgtgtcatatagaattaatcataccttgcctatatattataatcaaattgtctgttaagcagataaatttagagaactgttatgctgcatggcatttaggtttacatgctgaggaagaaaaaaacttgaaatgattgtggctgggcacataacaatgaattttatggattaaaaaaaacagccaggtatggtggcacatctctgtagtcctcagctacttgggagaaggtgggaggattgcttgagccggagagtgaggctgcagttagctgcgatcatgccactgcactccagcctgggcaacaccctgacaccatcacaatgtatatgaaacataaataaatgttatgtttagacttgggtcccatcccccagatacctcattatgtacactcaaatattaaaaaaaaaaaaaaatcagaagtctgaaacatgttgctcctgggcattttggataagggatactcaacctgtattcatcattgttcatagttagacactatgaactatcagtgtctaaagccagaaagaaaccattcccttttctttttttaaaaaagcttattttatattattttagacagggtctcactctgtctcccaggctgaagtgccttggtagagtttcagctcactgcaacctctgcctcctggattcaggtggttctcgtgcctcagccttgcgaatagctgggattacaggcacctgccaccaagcccggctaatatttttgtatttttagtagagacagggtttccccatgttggccaggctggtctggaactcctgacctcaagtgatccaccctcctcagccttccaaagtgctgggattacagacatgagcctgcgcctgaattcagtctgtcaccaaatcttgttgttttttctctcttagatacttttcttatctgtcactgttctagttaggctcctattttctcttaacctggatggctgcctaacatgtccccatgtttcccctctggaatctactgttaggcaaaaaggcagaagctatagtacttgacaggtaacaatgtttaattttcaacttgactaaagtagctcagcttgtgtcccttttatttttattattatatagttttacatattgagctccaagaagttatagttccttggtttttaaataagatctgtaagaggagtttaatccatatttagtgttgtgttaatcttcaagccagtaagttagacatttattctcattttacaaataaagaaatcgttgctgagagttaactgtgtggtggagttgagatttagatttagtgttttgttatgttttttgagacagtgtctcactttgttccctaggctggaatgcagtggcgtgttcatagctcactgcagccttgatctctggggtcaagggattctcccacctcaatctcttgagtagttgggatcaccccacccagctaattttttgatgttttgttgagatgaggtcttactatgtggcccaagctgatcttgaactcggaagccatagcacctggctaacagccatcagtattaaacacaaaagtgtaagtgtcccttttaggcttttaattatcttagaaaacagctatttgtaaagaaacttaaaaaacttttactaaaataccactacgctgtattattagagtactaacattaatatgcagtgaacttatacaaatacgtaagtttataatttatctgaaactcgtgttggggggggtaagtaactttatgagtttctggatatatgactactgttgatatggtttagctgtgtcgccatccaaatctcatcttgaattgtagttcccataatctccatgtgtcctggaagggactcggtgggaagtgactggatcatgggggcgctttcccacatgctgggtctcctcccgatagtgagttctcacaagatgtaatggttttgtaagtgtttggcatttctcctgcttgcactcattcttctgctgctctgtgaagaggtgcctttggccatgattgtaagtttcctgaggcttcctcagccatgaagaactgtgagtcaattaaacctcttttctttataattacccagtctcaggtatttcttcatagcagtgtgagaacggacgaatacaatggtaaagaaaaacaaacccaaactgagaattggatggatggagattttatgtaagatctttcatttagcagtacgtcagctagtgataaatatatcatgtgatgaactttcaggattttgtacacattttcataattgtaaatgtaaaagtgtctttgaatgccaggggctaccactgtataaaatgtaatctcaattgttggaaaaaaaaaaagtatgtggaaaaaaagactggaagaaaataagccattgttgacattggttatctttgggtggtaggactatgagtgggatttttttggctttaattttttgcatttttccatttttctttaccatgcgttcatgattacgggtaaaaagggaaagaagtgaaattgcttctttcctgacagttttttaggaaaatatccttttgttcataaggcaaataaattgtcttggggaagaaatatgaagaaatatgaagtcagaaatataataattgaaagaagtcttggtataagtcagtatttttaagtgactgtttgctggaaaactatggtgttaatctgaggccaaccaggcatatgactatagaactttgcatctgccactctgttttggcagcttttagagttatacaaaaaaggtacgagaatgatgtgacccacaatttatttgaatcactaaatactgtccaaaaatggcagttacagtaatttgtgaggacactaggggatctgattatatcataggccattttggtcattgagtattaggttgaaccatatgaacctattttatagattaaaaatggttgagtgtctgtaacttcctgtgatttaacctgttaaaaatagtactttttcatccttcattcaaatttgatttacatagcttgtattatatacatatttctgtatctatctatatatctctgtatctctctctatatatagatatatagatctctgcatctatctatatatatagatacaaagatatataggtatctatctaagtttacaggttggtgtgtccgttaaggttgcagataaaagaaattattattagaatcttaaaattttgattttggggtgatttggtctttggaaatatgtctttctagaggaccattatgaccttaatgtggattatgtgctaatttatatatctggatcccaaagttggcattccctggagtcttgatagcacgttagagttggaagtgatggttaaagattgttttagttttcatcaagcaggataactcaacatgtctacgtggacatgtagagcaggtaggagccctatcctacgtaggctagcctgttttattggaaatctggtggataaaatttatttatttttgttccttatttgaaggtttaggctaggtgagtagaaagtgagtagattggaatgctaatatgttccttctgttgctttctcttctcacgtgatttactttgcatgtatttttgggcaagttgcttatttttctgggacttagtaagtaaacatcatttaggctaatatggtccaggaacctgccaaaaccttacatgtattatctcatttaactcaccttatgaattaacgctgtgtcctgcctgtgaacaaccctgtgatggacatagtcattaccaagattttttttttccccgagatagagttgctctgttgcccaggctagagtgcagtggtgcgatcttggcttactgcagcctccgcctcctgggttcaagcaattctcctgcttcagcctcctgagtagctgagactacaggcacatgccaccacgcccagctaatttttgtatttctagtagagagggggtttcaccatgttggccaggttggtcttgaacccctgaccttgtgatctgcccgcctcagcctcccaaagtgctgggattataggcatgatccactgtacccagccgttattaccaagattttataataatcgggtcactacgtggcaaagctgggatttgaactcaggcagtctggccacagagcccatgttcttaaccttacagctggctgtattgttaaaataaatgtccacagaaatcaattttaggaatcttacgaggatatggtaaagatgatgttgatgaaataataggttgaaatcactgtatgaatatttagaatatttagaattttacccatgttatgttatgttatgttatgttatgttatgttatgttatgttatgttatgttatttggtaacctatctatatcccaggctggagtgcggtggcagcatttcacagcttactaccacagcctctacttcctgggctcaagtgatcttcccacctcagcctgggactataggtgcggactaccatgcctggataattttttaaatttttttgtagagatggggtctcttcaggttgcccaggctggtctcgaactcctgggcacaaaggacctgcctgccttggccttcaaagtgctgggattacagatgtgagacaccactcctggccccttgttgattttcattcattgttttcagttgtgctttaataggtagatcgtattcaacttggacttcttacaaaaagtacttgcagcctcctttttggtcagggatctacttacctgctgtaaagggactttaagaaagaaaaactgttctgtggcccttctttcaccctgtattattgggatagaagaataggccaagaaggagtactgtggagcagtaaatcatcactgtcctttttaaggttcataacaattggttacctctcaggagtgggatttggagacaaggaggtattgggactttttacttttatatttttgtatttatttcaagaagcacctattacttagtaatgagggaaagggatgaaaccaaaaaagagtcttgagtacttaggttagagacaagataccagtctactttctggtagtgaggagagggtaattaccagctcaagttttaccagattcctgttttggagttttcttagagaacattccttcttactgcaggatcaagtacatgctctgtttttctctgtgtctctgacacggacacgtgcacacacacatacacacacacacacacatactcttcctctggacccttcttttgggacagagatgcttagttgagtggatataaactataacaaaaggcagtataacttaacctttcagtgtctcaatttctttatttttaaaatcaggactatatgttaatacagaaatgcagtctagtataaaatacatctatatgtgagtatgtgtatatacatttgtatgtatgtgtatatatatatacatgtacatgtatatacacaatgtgagagattgattttaaaaatagcagattgtcacaagtttgaggctagaggaagaggaacttggttagttgtgttactactatattagcataaagaaattaggcacggaagtatatgtaatcctattatacttagcaggaacttctaaccccaggaagaaagctagaagggggcttattacattatatatgctaatatttattgagcacttatattttagcatacatatatgttcacatttattgaatgctttctaagtgacagatttagttcaaaactattcatagaaacttattttactttaacaactctataaggtatgtacttttattatctccattttctatataaggaagctaaaatagagagagattaaagaacttgaccaaactttacacaacttatcgacctacgtatgtttttgatgaaagaaaaattagttgtcagatttttttattagtaagaataaaattgaaatttaaattattttcattttttaaggtcatggcagtagagagaagcagaaaccctatgctttagtaactctgatgcaagccatatctccttatatgaattatttggtctcagagtatttgaattctttgctgtaagggttgcaacaaaagtgtttaaaaagaccaattatattaaaaagattaggtgaagcattactctgacttggaatgattctagattagacctgtcttctctaccacagggttatataattgaacatgtatacctagattcagggacctgactttctatacttactgttgtcagacatttgggtgaaatcttcggaaagtgtgtgtctgtgtttatgtgtgtatgtgcagtacatatatatctatatatgtagatagatggatagataatatgactcagaaacagataaatagtttagtgaaactatttagtgaataaagtacaaaacagaccgatgtttatggaatgtgataaccagagaggtattttaaattagtgggaaaagtttgaattggtgagaaattgggacattttcctttggaaaaaaattagatatatatctatatataattctaaatggattaatgttctaaatgttaatatttgaaatcattagaaaaaaatgtaggaaatgggtttattgaattcatgtgagggaagggttagaaaaagaaattgggctggttttgtgatagctcatttaactaacatgttcatttaactgccaaaaaattagaatatttggttttaaagtagggaatcaaactgtggaataaataatgcaacatagtatagccaacaaaagttatagctaaatatggtacaaaatattgtcaatgaaaataggtatgttctatttattaaccatgttaaaatggatgtttcaagacaagattcagaagtaattccagtgttatacaatatagacttcttgaattttttctttcttttttttttttttttgagacgggagtctcactctgttggccaggctggagtgcagtgacatgatctcagctcactgcaacctccgcctcccgggttcaagtgattctcgtgcctcagcctcctgagtcgctgggatcacaggtgtgcaccaccacgcctggctaatttttgtattttttagtagaattggggtttcaccatgtttaccaggctggtcttgatctcctgacctcaggtgatccactcacctcagcctcccaaagtgctgggattacaggcgtgagccaccgtgcccagcccagacttttgaattcttttgctttcgatacttttgagtgcattaaaaaaaactaatgaaaaggaattatttaagtggaatattttatcttggagaaataatttcgttgtcatagtgtttatttttaataaaaggaacctctgccttatctagtataatatgtaaagtattaatagaagaaaagctttaactgttctctataaatcagcttatcaagtgtaatatgaaaagtagcagttaaaatctcgagtgaattaaaatatttttagacttcaggaagttttaaatttaaaactaaggtcatggctcagcagcaattgaatctactattagaaagctcttagtgaaaaaactctttttcacctttttggtaactggtattaaccttttaaaaacctgcattctaggcatttgattttattatgactgtcgtcaaggaagattaagacttaaggcaactaaaaaattatataatgaaaaaatgattccttgtcataaatacaggtgatataactatcatataaagtgatgttgactaaccagaactagtaatatgttctaatatatcatccttggatccttgggagcccatacttctacagtaatcaacatttattgagtttatgagagtgtgtgtttaaagacagggagagagagaaaacatgtttattaaaatgaaacatgacaaactaatgggtcggattgtgttctttatgttccctaaaatttttcttcatcatattgaatgtgattgatctctaatttgggtagtgacattccttgttatatgttttatgtgatgttttggatttacatttgtaaattttgggaaacaggatagtaagaagagtagcataattaaaagacaggtggttgtgctttgaaatgggctattctttaagaatggtatgatctttatagtggcttttgtaatttcttccttttcaaaattataaacatttattgtaataaagaatttgatggattatagtgaatttactttttttccagaaaatttccctcttgaggacagaattttttgttaagggtcaaaaatgacagtttgagtccataaaagattgaaatctttgaagtgtgttttctagaacaggagtaagcaaacttacctatttttacatggctaaaaacatcaaaaaagaataattctttcaggtgatgggtgcaccaaaatctcagaaatcaccgctaaagaacttattcatgtaaccaatcactacctgttcccccaaaacctgttgaaataaaaaataaataattctttgtgacatgtgaaatttgaatttcattttctatttataaataaagtcttattggaacacagctgcttttgctttataatggcagagctgaggagttttgacagaaactgtatatggcattctcattacttcaagctactgtttggtgtaccacaaatttcagtgctgccattattgcttgacggtgttttgagtgccacatctgtgaccagattgcaattttttattttatttgtttatttattaccactgtgtatccatcatgtcaaaaaaaggaaagaagagaaaaatatagacgtgcttttaaggcacattggagtgtgggttattttgttattgaatttaatagcaaaacattgctcttattatgaagtgacactagagctgcaatagaggaatacagtatacatgaaagtaactagactaatcatatactacactatgtccaactctgaggaaagcaatagaaaaattacaaaacttaaaaatggaatatctcatcacagcataatttcttcataaaaatgaaaatgaggctgccaccaaaataagtttccaagtggcttatttgtttgccaagcaaggaaagccatttactgatgttgagttaattaaattgtattttattgaagcagtcaaaaaaattatgtccagagaaaataaacttgttttaggctattagctttttggcaagcacagttgatttaagagttgaggacatttgaagcaacatcactagtcaattaaaaaacaaggcaaatgatttggagtggtttttctcggctcttgatgagccggcagatgttattgatacaattcagttgttctttattcaaggagtcaattccaagtttgaagtggcagaaaagttggcctctgaatagcctgtgcagaacaactacaggcaagaatattttcaaagctgagaaaacactaagtacaatctgaagtggaatctgtaaggatgtgctgcaagcggtggtgatagaatacatacggagcagcaaaaggcttagttggagtaatttacaaagcttgtaaaactgaggagttcatagtttatggttattcattgttattcattggcagatactttgcagaaaatatttccatctatccatgtgtgttactgaatcagtactgtcaactgtgaagtcagtttgctcttttggacttaactagcatcagctgcattaatttttgttagaaacaggacaaatatcctgactggcttagaagtggtaaagtatattttcacaattgtttgagctaaaggctgagattgaaatttttttaataaagagaactgccctcaactgctattaaatactaattagctttggaaattagctttttgtgaagattgagtaatgtttttaaaatgaatttaacctaagatttcaaggcaaaatagtgtctatatttgaaagaatgtggtaaagtcatttcagtggcaactgatattcaaatcccaaataatttcaggctgctttatatatttctcaagctgtcaaagaagttagattgtcattcccacataaatatgagtggacgtattttctagtctcaaactatagttcccacagcatttttcagaagttgacacaaatgcacagaaagttccatatttcaaaaatttgtttaattttgtagtggagaaactttctacctaaccttgaattggaagtaattaatctgcactgtgatgacatactgaaaggcaaatatcaaatgaagaaccaatggataactgccttcccagtaatgaatatgctcaattaaaatcatgcttgtgggttaatatcaatatttggcaatatctgtttctgttaaaagacattttcaaagacaaatacatacagtctcattacagatcagtgtttttttgtttgtttgtttttaagcaaaagtgctctcattctgcgcccaggctggagtacagtggcacaatcatgactcactgcaagcctgtatctcctggccccaagcgcttctcctacctcagcctcctgagtagctgcgaccataggtgcataccaccacaccttaggttttatttttttaatttttgtagagacagggtctccctatgttgcccaggctggtctcggactcttgggctcaaacaatccacctgtcttggcctcccaaagtgttgtgattacagacgtgagccactgcgtttagcctgcagatcagtattaacagatgaggccaggcgtggtggctcatgcctgtaatcccagcactttaggaggcacaggtgggctgatcacttgagattaggagttcaaaaacagcttggccaacatggtgaaaccctgtttctactaaaaaaaaaattacaaaaattagccaggcatggtggcatgtgcctgtaatcccggctacttgggaggctgaggtgggagaatctcttgaacctgggcggtggaggttgtagtgagccgagattgtgccactgcacttcaggctgggcaacagagcaagactccgtctcaaaacaaaatttaacagatgagtatttgtagtagattttgatgataggaaaccccaattaagtgaggtgctatcttctcaaaaagaatttcattcttttcattagcaaacttttattaaaaaaagaagtgtgtgtgtgtgtgtgtgtgtgtgtgtgtatttatttatttattttttcatatagggtcttctcttgtcacccaggctggagtgaagtggtgtgatctcggctcactgcaacctctacctcctgggttcaagtgattcttgtgcctcagcctcctaagtagctgggattacaggcatccgccaccacacctggctaatttttgtgtttttagtagagatggggtttcaccatgttggccaggctggtcttgaactcctgaccttaagtgatccgccctcctcagtctcccaacgtgctgggattatagatgtgagccactgcacctggcctattataaaatattatactcattattgtatcttggattttgtcaataaaaagtttttggaaattgtttctgtatccagcctgggcgacagagtgtctccaaaaaaaaaaaaaaattgtttctgtcttgttatgtaagtatctatatgattttgcctgttggccagcaaagactaaaatatttgtgactgggccctttacagaaaaagttacagatctgtgttctacagaagtacttctgaaacatgaatgtatatagtaattactggggatcttgttaagatgcagattctggtgtggtcggtttgtggaggaacccatgattttgcatttcttataagcatcttggtgatacagttgctgctgggctcatgcactgtagtttaagtagcaaggctctactgtttaggattaacatttgctaagcacctattatgtgccaggaattacaccaggggctcttgagtatattgcctctttaaaatatcttattagggccgggtgcggtggctcacgcctgtaatcccagcactttgggaggctgaggtgtgtaattcacgaggtcaagagatcgagaccatcctggccaacatggtgcatcctggccaacatggtgaaaccccgtcttcactaaaaatacaaaaattagctgggcgtggtggtgagcacctgtagtcccagccactcaggagtctgaggcaggagaatcgcttgaacccaggaggtggaggttgcagtgagccaagattgcaccactacactccagcctggtgacagagtgagactgcgtctcaaaaaacaaacaaacaaaaagtaattagaaggtgttaagaattaaggagagattgtgcttttaagagtttttggttagaaacccatttgttcttgggtgcctaatttcctgtaagacctcatgaagagggttgaggtcctagaggaagctatatatctgggaaaaacaataggaaacaaaatatattattatttactgatctaggtcaaagcagggccccatgccctcatcttccatggtaaatttcagtgtgccatcaaccagttatcaagtcaaagagtaggcatagtatatagcacatacatgctttataaatgttttcttccaatctgttgtttaccttttcattttgtaaccatgttcttttgaactagcaccattttaaatttttgatgaagtccaatttattgaattaagaacttgtaagtattatttgagacaggttctcgctgtgtcacccagcgtggagtgcagtggtgcaatcttggctcactgcagcctcgacctcctgggctcaagcagtcctcccacctcagctccttagtagctggaattacagatgctcactgccacacccagctaatttttgtattttttgtagagacagggttttgccacgttgctcaggctgatcttgaactcctggactcaagtgattctctttgccttgggctcccaaagtgctgggattataggcaggcgccgcgacatctaattatttttttttaaattgtggcaaaatataaaatttaccatgttaactatttttaaatgtaaagttcagtggtattaagtacattcatactgtgctaccatcaccactattcatctgtagaaattttctgtcttcctcagctgaaactctgtacccattaaatactaacctcccattccaccacacccccagcccctggcaaccaccttttgtgactggcttattttacttagcatatcttcggagatctccgtgttgtagcatgcacccatattttcttcatttttcaggctgaataatattccattgtatgtagataccacattttgtttatccattcatctgttgatggccacttggattgcttctacctttaggctaatgtgaataatgctgctgtaaatgtgtttgtacaaatacctgtttgagccattgctttcgcttgtattggttatatactcagaagtgaaattgctggatcatatggtaattcagtgtttcattttttgaggaaccgctatactgttttgcacagtggccgcaccattttatgttcccaccagcgatgcacaaggattccaatttctccacatcctcactagcacttgtatatttggggttttagtttttgataacagccatcctaatgggtatgaagtggtgtctcaccgtgattttgatttgcatttccctcatgattaatgttgagcatcttttcatgtgcttattggtcatttgcatatcttctttggaaaaatttgtattccagtcttttgcccattttttaattgggttttttttgttattgagttgtagaagttctttatatattctggatatcaatcctttatcagatatataattttcagatattttttccattctgtgggttgccgtctcactctgttgattgtgtccttttaggcacaaaagtttttaattttgatgaagtccaacttacctattttccttccttccttttttttttttttttttttttttctgacggagtctcactctgtcgcccaggctggagtgcagtggtacgacctcgattcactgcagcctttgcctcctgggttcaggtgattctcttgcctcagcctcctgagtagctgagattacaggcacacaccaccacgctcggctaatttttttgtatttttagtagagacgtttagtagagatgttggccaggctagtctcgaactgctgacctcaagtgatctgccggccttggcctcccaaagtgctgggatttcaggcatgagccactgcacctggccctattttttctttagttgcctgtgcttttggtgttagatcaaagaaaccattgctaaattcagtgccatgaagctttatccatatgttttcttctaagagttagaaagttttaggtcttatattcaggcatttgatccattttgagttaatttttttatatggttaaagtaaggatccaactcaatttatttgcatgtggatatccagttttccctgcaccatttgttgaaaagactgatctttctccactaaatggtgttggtgttcttactgaaaatcatttcacgtgagggtttattttctggtctccctgttttatcccattgctctatatatatgtctgtctttatgccagtaccatattcttattttaaaaatgtgatttaatgttttcaaaatagtcctgtgccagggaaggattgatagttttttataaagcaaaacttcagtagattttaagtttcagtgccaggcttaagacttggcagacctggcatataataggtgtgtgatttgagaatcatgtttgaagccaaaggagatctgaaaagaaaacagaaggccatggggaatatttgcagttaagagagaacaagaaggtggtggggggaacaggtgtggctgaattatgaaaactagaactgtttatgtttttgctttggtttttcctctcaataaaggaataatatacagtttctgatgtaatagcaggaagagaaaaaatggaagcattgatgatactaaggatgatatggttataaaccagtttaagggaagaattaaatggtagtacagtaaaattgaggctaaggtagacttctaaaaagacataagtgagggcagaaggagacaaggagtgagtagatgccagagaggtagggtacttgtgaatacaagatttcttggatgtcaagaaggagtgaggtcaaaagcaagtgttaaaggctttagctttttagagggatttacctctttttttgagctagaagaagtagacagaggaaggtgtattttcaggtacagggatccaaataagcatgaaagagtggccaccatccatctagtcctctgtccaggtgaggataaaaagtaagaaagggaatttcaaaagataagatctataggagtagttgttaacctttaggagaggaatgtcaggatgtgtggaaggggctagtatagttcaaaaatgttccccaagtcattctggattctggtaatatccttacctgctccctttgagagccattcatttatgtcacttctggggtttttgttagaagagaattagcagacatagataaagtaatttttgtttgaacttcatctagaatttggagtgctttagtctgcataataacaataacatcagggtgttaaatttttccccttaattttcaaggtggtttaatactagtaagtgttacttcagtcatctgtgtgtgtggtaaacgtgtttgtgtttcatttacctgatggaaacttaaaactatcaaccgtacaaaaaatcttaaggattgtgacaataataaaacagttctttatagtttaaaatgtagttagttatataagatatacataaacaaaataattaagtggtaatgtcgcatagttacaattctgggtatgctcagaatagggagattacattaggagagtagtattttttaaactatggacccatggtccattgttggtttatgaaatcaatttaattgctatttactagtgtcacctcactcttttttaagtggactaggataggctagaaaatagatgttgtacaggactcttactactgcattgcagtaagatttggtattctgtgaaacttttaaatatatgaatgtttgtaactgtgtactaaattagatggaaaatatatttcttctgtgagttgcagccaaaagtgttggaaatccattgtaggatgttttgataagttgatgtgtacatttaaaaataaagtctctcaatttcgtctgcttgtagcattcattcctaaatttttaacatcttaactaatcacatatatatatttgtgtgtgtaagtataaagtatacacacatatatatgtgtacatatatatttttttttcttaataggtgcaatggatgagcttcatagtctggatccaagaaggcaagagttattggaagctagatttactggagttgcaagtgggagcactggaagtacgggcagttgcagtgttggagctaaagtgagcaaaattctcatctttatttgacagtctttctttctattaaatgatctaaaatagtatgtaaaggattcctacataacgtgcttaacagcaaatgtaacttttataatgtgtagaataagatcagtgttcataaatgcgtttttaatgtagtataccatatttcaggggcattataatacagcataatatgtttcagggataaaaaggagtttggtagattgtactgcctgtctcccactatgtagtttcttatccttcctgcccttattatccatggtcctatctgtacatctaatccacagtttctaactgctgcataaaactttaatagtgtatatcttttaggccaggagtcctcaacccctgggccaaggaccagtaccagtcctgttagtaaccggccacacagcaggaggtgagcggcaggagagtgagcattactgcctgagctccacctgtttgattcagcagcgttagattctcataggagcatgaactctattgtgaactgtgcacatgcaagggatccaggttgtgcactccttatgagaatctaatgcctgatatgaggtagaacagtttcatctctaaactattccccacccaacctccaccttccctcttttttcatggaaaaattgtcttccatgaaactgatcctgggtgccaaaaagattaggtattgctgtgttcagcctttcagtgatagacccagattgtctacctcaaactgtgatgagttttcatgtacttgggctcttatggacctttgtgaccatttatttaggatgttttcccaagagtacaattgctagatcatagggtatgtatagactgaaattggataaatacaaggttgctattcagaacagttgtactaatctgcattttcagcggagtgcatgagtatttctgtatttccatatcgcagaaacacttgacaccatccacattcctcatttaagtataaaatatcttcttgttttacttgtaccatcaattattttgagcatttcttcttttttttttttttttgagggagtctcactttgtcgcccaggctggagtgcagtggcatgatcttggctcactgcaacctccgcctcccaggttcaagcgattctcctgcctcagcctcccaagtagctgggattacaggtgctcaccaccatgcctggctaatttttgtatttttagtagagacggggttttaccatgctggccagctggtctcgaactcctgacctcaggtgatccacccacctcggcctcccaaagtgctgggattacaggcgtgagccaccacggtcggcctattttgagcatttctttgtatgcttgttaggttgttgggagtcttagaaattattttaattctttgtctgtttttatattagtattactttcttttttgaactgattttctcatgtttcatgtatattctacatgttgatttcttgttgacttcatacatcgtaagtaacttctcccactttgtcatatgtctcttactttgttcatggtctctgttgaactggagttgtgtgaattcatagcacattgaactctctaaatttgttgtaatcagtctcaccagttttttgccttacggtttgtatctccaaagttttgactaactcttggtatttaacagaaataagcatcaccattaaccatttgggtcaaatagacctttttgtatttttatatttataagctattttactactaatttatagacacatgaataaaagtattatgaaaaacaactttattagatattttaataagaattaccttgtacatctctttgtatcaggtaaattttggctcacaaacataaaagatgaaagagtactgtgatgtgtcctttgagcataatgaggtggtccagaatatggttgcagaatattatatgatgcagtccttactgtgttttctttttttccttagaaatatattgttcaattcattgattcttgaatttgagaaaattcgtctagcattatgttacctgattatgtgagattttacatatagtcaatatcaccaccatcagcttcagagtctagacatgcaactgttggtgtttatattttctgattcatctaataattgtaagatgtattcctctgtcattttcttctcttggccatcgtgggtggaaaatgaaaatttttgaattcttaggtggagtcagtgaaagctaacattagactacgaagatggtattctagtctttcaaaaatattcttaaaaggccgggcacggttgctcacgcctgtaatcccagcactttgggaggccgaggtgggcgggtcacctgaggtcaggagttcaagaccagcctcaacatggagaaaccccgtctctattaaaaatacaaaaaaaaattagccaggcatggtggtgcatgcctgtaatcctagctactcgggaggctgaggcaggagaattgcttgaacctgggagacggaggttgcggtgagccaagatggcgccattgcactccagcctgggcaacaagagcgaaactcagtctcaaaaaaaaaaaaaagaaagaaattcttaaaagatgaagcaagatgaaagatgatgcagtacttgaaagataatggaaggcaagaagaaaactgaaagatgatttattttactattgcaccatccttttaggttattaaatctgtatttttctattgtttccataacaaactaagtaaacttaggagtttaagataacacaaatttattatagttttgtaggttagaagtctgttactagttttatgggctaaaaccatggtgtttataggactgtaatcctttttggaggctcaaggggaggatcagtttccttgccttttttagtttctttcttcttctttttttttccctctgagacaggatctcactctgtcactcaggctggagtgcagtggcatgatcttggctcactgcaccttctgcctcctggggtcaggtgatgctcccaccttagcctccccagtagctggcagtacaggtgcgtgccaccgtgcccggctaatttttgtatttttagtagtgaagaggtttcaccttgttgcccaggctggtcttgaacacctgggctcaggtgatttgcccacctcggcctcccaaagtgttggaatacaggtgtgagccactgcaccaggccaccttttttagtttctagaggctgctgtgttctttggcttggctattcctccagtttcaaagccagcaacagcccatctccttgaccattcttccaaagtcacgtctccctctgacaacagtctggaaaggttgggcctctacttttatgtactcatgtgattagattagaccaacccaaataatctgggataatctccccagttcaaaagccttacccttaatcacttctgcaaagtcctttttttggccatgtaaggtaacatagtcacaggctctggagtttagggtgtgtgtatcattggggaaattattctgcctaccatacaccatcattcttcatttttttctttgattttttattttgttttttagtatagttgggaataattgatgaaaataataagtaatgatgaagtaattgctagtacgtgataaattcaaaatataggaaaaataagatatgtaagattccataatatattttagatttatggaagggcccatttgacatctggtaattgcaagatggaatgagttttattctattaacaataaatataatttttgttttttggatgatccctaagaaagaataaaagtcctcaaatatcagtctttacaaatagttagaatggctcaaacaagaaattcaaaaactagaatttgatctcatagaccttgatggtattctaattaaatactgcttctgcatccctggaccataaagatattctacagtttctgttactaattttataggtttactatcatacttgctctttaatccatctagggtccatcttttatataatattggtagtgatccagttttatttttctccatctagtgaacaagttttctccacagtgcttcttaaatcatctttttaaaaattgatttgtgatgccatctttatcatacatatgacttacataattaacacatatatgatttacatatatatgataagtatatgtgggctgggtgtggtggctcacgcttgtaatcccagcactttgggaggccgaggctggtggatcacttgagatcaggagttcaagactagcctggtgaacatggtggaaccccatctctactaaaaaatacaaaaaattagctgggcatggtggcgggtgcctgtaatcccagctacttgggaggctgagacaggagaattgcttgaacccaggagatggaggttgcagtgagccgagattgtgccattgcactccagcctgggtgacaagagtgagacactgtctcaaaaaaaaaaaaaaaggatatgtatgtggttgccatgtatatatagtatgtaggtttgtctctgaaatgtctctgatgtttcagtgatctgtgttcttgtgctccagtatcacattaaaaatattatcatattttggtatgtcttttttatatggtagagtaaaatctctcgtttactctttttctggggttgactttgttctttatggatctttagtccttcataaaatttaagcatctctatattcttgatagcatttgggaattcttctattatagctttttttgtgtctttttccttaaaatattcaaatgtaattttaattttgaatgcattcaatttgtagattagggactactagcatctttgtaagattaggttatcctatttaagtacatgaaatgtctccctgtttattcagttctccccatggacttcttaggaattttcggctgttagatcctttaaagtttgttgctgatctttttttaattatattttctagttgatttttgctggcttaggatgcttttaatttttatagtttggtcttgtatctggcagtcttgctgttctcttttattggttgtaatggtttgttggttctgtagatttatttaagggaaataattatcttccaaaaatgatagtttaatctcttataccttaaatacatattttttccttatcttggtcatgaccttgaatgctgtgtcttgttcttgctctaaaagaggaattgtctgaaggttctttattaagtgtaatgtttgctgtaggtttggagtatataactgcccaaattaaagaagagcctttctattcctggttagttaaggagattttgttggttttaaaaattataaatagttttgaacttatgaaagtcttttttcagtgttgattaaaagactcagatttttctcctttggattattaatacaataatttaatagattcttaaaatgttgaaccttgtttgtatttctgggataaaccatacttgatatgatatactatttaaaaaacatttatcaggccaggcgtggtggctcacacctgtaatcccagcactttgggaggccaaagtgggcggatcacgaggtaaggagtttgagaacagcctggccaatatggtgaaaccctgtctctagtaaaaatacaaaaattagctgggcatggtggcgtttgcctatagtcccagctacttgggaggctgaggcaggagaattgcttgaactcggcaggcggaggttgcagtgcgccagggtcatgccactgcactccagcctgggccacagagcaagactgtctcaaaaaaaccaaaaacaaacaaaaaaccctaccatttattggatttaatacatgattaattatttaggatttttacatatatgctttaagagaaatgaatgtgccaactggaagaatgtagttcagtgagttttgacaaatgtatatacactcatgtaatctacattcctcttaagatacagaacattttcattaccctaccatatctgttttataattcactatcacattagcctcacaaaatgaactgggcccctttcactatttttagttttttcagcatcctgtatatgataggaaatgttcatgagaatatgagtagacacgtaaaactgtcttggcctggcctggagcttatttagaatggtggcttttttttttttttttgaatacaggatctcactttgtcgcccaggctggagtgcaggggtgtgatctcggctcactgcaacctatgcctcccaggctcaagcagtccctctatctcagcctcccaagtagctgggactataggcgcttgcaccatgacattcggctagttttttgttgttgctggactttttttgtggagaccaggttttaccatgtacccagactggtctcaaactcttgactcaagtgatccacctgtcttggcctcccaaagtgatggaattacaggtgtgagccactgtgctcagccggggagatcttttactgtgattttaatttctttaatatttagttcattagttcatttcatgtaagcttttaaacttactagtatatagttacaatactttaaaaacctcctttgttattttctttcttcatattctccttttctgttcattcttgccagagctttgtttaatgaatatttcaaataaacaaatttttgttttaatttttttcactgtttttttcttctcccttttccgcagtgatttctgccttcataatttacttgttattttggatttgcttctgtggctcttcttccagctattgagttgaatgtttagtttatttacttgtatatagaaataattaagtacagtaaaatgcgtagctcttatgtgttcggttatgggactttctccccatggtttttattaaggtataattatcagttagtaaaattacccttttttactatatagttctgttgtaagatttgacagatgtatataattgtgtaaccaccatcacaattaaggtattaaatagtttattttgctgaaatattttcccatacccctttgtagtcaactcctctaggttgcctctggcaaccactgatctgttttctgttcttttagtttaggtttttaagagatgctatataaatggatacatattgcaatatgtacctttttgagtctggcttcttttaacttatcataatgcattcatttgagattgatccatgttgttggatgtttgacccttttgaatgctaaatagtattctgctctatgaagataaccacttctttttagtccattttctgtttgtttatttttttgagacagtcttgctctgtcgcccaactggagtgcagtggcacaaccttggctcactgcaacctccacttcccaggttcaagcgattcttctgcctcagcctcccgagtagctgggattacaggcatgtgccaccatgcccagctaatttttgtatttttagtagtgaaggggtttcaccctgttggtcaggctggtctgaactcctgacttcaagtaatccacctgccttggcttcccaaagtgctggcattacaggcatgagccaccacacctggcctttttagtccattttctagatgaggaacatttgtgttgtttccagtgttttgataattaggaataaaggtattataaccattcacgtattcccccctcttagatttggaaattgttcagtgtaaataccacacaaaacaaaatatagaacacttccatccctccagagagttttcttctgcccctttccagtcagttccctcttgtcaaaccctttcccccaacccttatctaatttctgtcactacagattagttctgcctgtacttggattccatatacagtaaatgaaagtatgcagtatattcttttgtatctggcatcctttatttaatgtagtgtttttgagatttatccaggttgttgctgttttagtagttaattctttttgttgctgaatagaattccactgtatggatataccacagttatgcatttagtagagtggtatttggatgttttcattttgcctgttaggagtaaggttacaataaacattttggtacaaatgttttggtaacatgttttaatttctcttgggaagatacttagctggatagatgtatattttacttggtaagaaactgccagatttccaaagtgtttgtacctgtataagaactttgattgttctgcatcctccctgacattttgttgtgattctttttcattttagtgtagtgggtgtgaagtaatatcagctcgtttattttaacttttcttgtttcttgattaatgctgtccctccaggaactgctgtaactgttccataagttttgatgggtgctgttttaattaatgttcagatctgtatatttcataattacctttgtttcctttttaacacaagggttattaatataggatattttgagctatctttttgttgtggattttcaatctgttgcattacagttggaaagtagtttgtatgacatcagtccctgacatcagtccctgaatgtgccttattttagaaacatttcatatctaatagctgttaattgtatttgttcagatcttagatatctccttgcattgtcaacttggcgtatctttttctgagagagatgtattaaaatatttaactgatgatttatgtatttctacttgctgttcatttgtttttgcttgatatattttgaggcagtatttttacatgtgtatctcttgttctattctttttgtgactgtatactacttactgttaattttagctttcttttggtttatgtttgttttaggtatatggttttctattttatttttgctctttttaaatgtgtttcttggggctgggagtagtggctcatgcctgtaatcccagcactttgggaggcgggggcaggtggatcacttgagcccaggagttcgagaccagcctgggcaacatgatgaaaccctatctctacaaaacattagccgggcgtggtggtacccacctgtggtcccagcttcttgggaggctgagttgggaggattacttgagctcaggaggttgaggctgcagtgagctgagatcatgctacttcactccagcctggacgacagagtgagaccctgtctcatttaaaaaaaaaaaaattaaatgcatttcttgtagacagcatatgttttttgatacaataggagcattcgactctcttaaatggtgagttttgtttattacattttttgtaattattgttattttctgactcagttctgccatctattgcttaatgtcttcttgtactttacgtgttttccattggacaaatgaatttttttcctgatgttttaaagttacatattctattgtagtgttataatgacagtatactcagtgtagtgtatagtatatgagtatagagtgtcattataacactaaaaatgctctctcaaactgcattcctgtgggtttgttccccttaaaatttgtattactttttactttgaaaataatctatacctatagataagttgaaaatgtagtataaagaatgccatcatattcttcatctagatttaaaaggtgtaaacagttttgcttaatttgtgttcatgtacatctttactgtgtctctctggtattgctgtggtctcctggctcctgtttttttgttgttgttgttgttgttgttttttttttgagagaggggtctcactctgtcacccaggctggagtacggtgacgcaatctcggctcactgcagcctctgcctcctaggctcaagtgatcctcatgcgtaagcctcctgagtagcttggataggcaagtgccaccatgcctggctaagttttttgtattttttttagagatgagtctcaccatgttgcccaggctggcatttaactcctgggctcaagcagttcgcccacgtcggcctcccagaatggtggaattacaggcctgagccactgcgcctggccagctcctttttttattctgttgttataattcattattgtctttgaaattcaaattgtcccaaatttggccagtggaaactccttcgcatggtcactttagagatcttttatcagtctttggttttcagacacaagacatttctggcttccctcgtccttttctgcattgaatatgaacagacattctccaaggattcctggttcattttaatgaagaatggtgcttaggaaccaacatctaggtgctagttatgcttgttgttataatacataatagtctcttagaagaatgccagctaatgtagaatcagaacactcaccatttgacatccccaatataattattgattaaggcaaggatcatatgttttccattggacatttacatttagtaaaatgttttcaagagcagtatacttacagagtcctaatgttttaccccatagattagttattacaaaagagaaatgtgtctaaaatggacaccatttctcaccaccataataagcaagatcagacttttcattggcatattatctcagagaatctgacattgtatgtgcctcctaaggtggtgcagtaggagttacacaaatcacctctgtttttaatgctggaaatatttgatttgaatttagtcatgagacaatactcctgggacactgctagacaactggcctggactcatcaaagtattcagtgtcttgaagaacaaagagaggtaaatggaattgttgtagattggatgaggctaaagagacaagacatagcaatcagatgtaatgtgtgaatctgaatcctgatttgcacctggactggaggaaaacagttataaaggacgtttttgtgacaatagggaaaattcaagtacaggtatatgttggatgaagatactgaattaatgttggttttactcttttgtcttttaagttgtaattttaaaatataggtgaagctacagaatgtatgacagttgtgaccaatgactcctgtaatgtttagagtgatgatgataatgtgcttgtgagatgcagtattaataggtaggcaaattttaatgatagtagcatcaagagtttgtaatttggaagtaaaaacattctaaggatcaaattgctggtagcaacggtgctctagcagagagggtcgggtagaaaggtaaatacattatctaggagtattgatttatttctagagaaaaatagagcagtatatttgccagcagcaaggaagtaagcacaagcaacagatactgtacatacaaccttcattttttgtttttctgcttttattgtttttaattgatagagtaattgtacatatttatggagtacagtgtgatattacatgtagagacaatgcataatgatcagatcagggtaattagcatatttgtcacctcaaacatttatcatttctttgtgataggaacattcgaaatctgctcttccagttatttgaagatatacaataaattgttgttaattatagtcttcctatagtgctatagaacaccaggacttactcttcctatgcagctgtacttctatattcattaatcaactgttggctgtcccctcccgcctactcttccctgcctctattctgctgtctacttacaagatcagcctttttggtttctgcatatgagtgagaacatgcagtatttatctttctgtgcctggctaatttcacttaacaatgtcctccaagctcatcagtgttgctgtgaatgagagaaatttttttaatggtgaaatagtattccattgtgtatgtataccacattttctttatccatttgtctgttgatggacacttacattgattccatacttcagctattatgaatcatgttacagtaaacatgggaatgcagatatctcttcagcatactgatttcctttcctttgtgtatacccagtagtaggattgctggatcatatggtagttgtatctttttttttaaggagcctccatatttttttccataatggctatactaattcgcacttccaccaacagtgtaggagggtttccctttctctgcatccttactagtatttgttattttttgtcttttttttttcgagacggagtctcgctctgtcgccaggctggagtgcactggcgcagtctcggggctcactgcagcctccgcctcctggtttcaagtgattctcctgcctcagcctcctgagtagctgggactacaggcgcacgccaccacactcatctaatttttgtatttttagtagagatggcgtttcaccatgttggccaggctggtctcaaactcctgacctcaagtgatccacccgcctcagcctcccaaagtgctgggattacaggcgtgagccactgcgcccagccaagcattttttaaatatacctgttaaaatttgtatggtttttgtatggttacttctttcaagagatgtctttgcccatttttagattggattatttattgttttgctgttgagttgtttgagttccttgtaaattctggatattaatcccttctcagatgaatagtttacaaatcactttcttgcaggttgtatcttcactctatgattgtttcctttgctgtgaagaagctttttagtttgagataatagtttgtctgtttttgcttttgttgcctgtgcttttgagatcttcttcataaaatcttaacctagaccaatgccctgaagtgtttcctctaaggtttcttctagtagtttcatagtttgggatcttacatttaaatctttaacccattttgagttgatttttgtatacagtgagagataggggctagtttcatttttctgcctatggatatccagtttttaatgttcccagtgcctttgtcgaagattagttggccataaatgcatagatttatttctgggttctattctgttccattgatctgtgtctgttacacaaaatcaacatacaaaaagtagtagcatttctatacaccaacaatgaactagcagaaaaagaaatcaagaaagcaatccctggctgggagcagtggcttatgtctgtaatcccagcactttgggaggatcacttgaggccaggagtttgagaccagcctggccaacatggtgaacattgtagtgtattttgaagtccagtagtgtgatgcctccagttttattcttttagctctgtattgctttggctattcagagtcttctgtggtttcatatgaattttaggatgttttttctctttctgtgaggaatgtcattggtattttgataggaattgcattgaatctgtagatcacttttggtagtatgtcattttcacagtattcttccaattcatgaacgtggggtgtctttctatttttttatgtcctctttaatttttttcttcagtgttttataattttccttgtagaaagggaaccccttcacctcattggttacgtttatttctacttttgtttgtttgttcttagttcttgtaaatggaattttttttttttttttgagacagaatctcaactctgttgcccaggctggagtgcagtggtgcaatctcggctcactgcaacctctgcctcccaggttcaagcaattctcatgcctcagcctcccaagtagctgggattacaggcgcccaccaccatgcccaactaatttttgtatttttagtagagacggcatttcaccatgctggccaggctggtctcaaactcctggcctcaagtgatcctcccaaagtgttgggattacaggcgtgagccactgctcccagccagagattgctttcttgatttctttttctgctagttcattgttggtgtatagaaatgctactaatttctgtgtgttgattttgtattctgcacctttactgaatttatcagttctaacagctttttggtgaagcttttagggttttctatatatgaatttgtgtcatctgctatacatagaacttttaaattactggaatagaatgtagaaggaggaatataaagaaatgtaattcaacaaaagagaaggagaaaaagaaaaacagaaaatatttcatttttatctgctattatataagatggaagcaataaagccaggcatgtattaacacagtaaatgagactccatctacaggctgttaacaagaaacatcccttaaaaaatgatgaacattggaaatatctggaaagaaagtatctcagataatcacgaagaaaaatgaagtgcaattaaatataaatttgaggtcaagagcggtggctcatgcctgtaatcccaccactttgggaggctgaggcaggcggatcacttgaggccaggagttcaaccccatctcaaaaaattagccggacatggtgggacgtgcctgtaatcccatctactcaggaatccgaggcaggagaattgcttgaacccaggaggcggcggagattgcagtgagccaggattgcaccactgcactccagcctcagtgacagagtgtgacttatgtctcaaaaaaaattatatatatatatatataaatttgagatcaatttttttcttaactcagaaccttccccaaacttcccattgcatttcaaataaaattcagtgtcttcactgtgccccacacagatcagaaggccttcctctaaatcaggaggccttttgatctagtgttaggctaacaactgccccaccacggcagttattatttgctgtcttatttgccacttgcctcaaacacacttcacgctgacttcattcaaatttcccctcttcaaagaggccttatctcaccgctgtatgtaaggtaatacctttgtcactgccccttagtttctccacttcttttttttaatactacaacttattgattccataggtaatactaaaatttatgtgtttgtttatattctctttcccttctcgtaatggaaactccatgagcactggacttcagtctgtttttttcactgctgtatccctagcatctacaacagaaccaaggccctcaatgaatacttttgaatgcatgaatgaatagcaaataaagcattcttcaaaggcaaaaaccttgaatggtataatgatagacgttttttaaggactaagtctccacaaagaagataaggcagttaaaatttttatatatcaaaccgttttagaaataacgtagtgaatttattaaaacacagttagaatgagggattttaaataattcttttagattttgactattgttttaccctaagcctgtttcgcctgtttatttacttaccagaccctgatagcatatgaatttgtgactctcagatagaaagaagggtaaatgttataaactgtaattatgtaaacttattgtgtagttgtcatgttgggagaagttaaggatatattttcttattttacataatgaggagtcattacacacagtttgaacttaaagaaaatattatatttaaggtaaggcaaccatttgaagaattaaaaataaaaatataactaaatgtctcagaaagaaggagaaactgtgatgctagataaattcttcatcttccatggcagggtcaattgaggatttactagaatctggtacgtactcacctgtttgaaagaaaggaagtaaagaaaaaaaggaatgaagaagctatctgtgttttgatttggaaatgtctccaagatatattaagagaaaaatatgcaatgcagtctgtataatgttatctttgagtgagaagggaggaaccaaagaacatatatttaatttgcttgtatagaaatagagactctaggaagacaataagaaagaaaccaaagtagcctgtttatattgcctattcaaaagttaattaaaaacattttttaaataagtcattgcctctcaatagtgggactgatgtgggaaggagaaattatctttctgtaatgattgaaattcctcttatgtgcctgtgttgcttttatattttttaaaacaatgtctcatgggtgttttttaaaaaaacctattcttttgaaggcctcaagtctgtgtatgtgtgcttgcagtggaacatactatatgagtgtttgcatgaatgattatatactgtactttgttgagcttttttccttctgatttccctccactaatgtgaacttttagaaccacttttattgagatataattaacataccatcaaaatgactcatttaacatatttaatggtttttaatgtattcacttttttatgcaaccattaccactgtcgaactctaaaacatttttgttaccccaaaactgaaacacacaaacattagcagcaactttccttcttccctagcctacactgcattgcctggcaaccaccagtctactttctgtatctctggatttgcttgttctggacattttatatcaatggagtgatacaatatgagttattttgtgcctggctttttttttttttttttttgagacggagtttcactcttgttgtccaggctggagtgcagtggcgctatcttggctcactgcaacctccaccttctgggttcaagtgattctcctgcctcagcctcctgagtagctgggattacaggcacgtaccaccacttctggctaatttttgtatttttagtagagatgaggtctcaccatgttggtcaggctggtctcaaactcctgacctcatgatccaccctccttggcctcccaaagtgctgggattacaggtgtgagccactgcgcctggcctgtgcctggcttttaaaacctagcataatgttttcatgttcacagatgttatagtatgtattgtactcattccattatatgacagactgttccattatatggatgtgccacattttgtttgttcttttgtgagttgttggacattgggtggttgtttccgttttttgatgcaaatgttatgaactgttaggaacactcttagaaattttttgtagacatatgttttagttcttttaggtatatagataggagtgaaattactgattctatgttaactctgtgtttaatgttttgaggaactgccaaactccttttcaaaatagccacaccattttatattcctaccagcaatgcatgagagttccactttctccacatccctgtcaacacttattattgtctttttaaattatagcctgtattcatctgcttgtgttgccataacagaatgccagagactgggcagtttataaagaaagaggcttatttagctcttggctctgcaggctgcgaggttcaaggacatggccttggcttctggcgaggagttttacatttccctcatgttacagaaggtcaaaggggaagtggatatgtgtgaagagggactggggagggggaaccttgctttataacaacgtgctcttgctggaactaaatccagtcttgccagagtaagaactcactcattactgcaagagttgcaccaggccattcatgagggagatataacacaagcacctttcactagaccttacttcccacaccgccacactttggaccaaatttcaaaatgagttttggtggagatgaacagaccatattcaatccatagcataaccattctgggtgatgtgtgaagtgggatctcactgtgtttttggtatgtatttccctaatgactgatgagcatcttttcatgtgcttattttccattcatatatcttctctggtgaagtgtttgttaaaatccttttcccattttaaaattgggttatttcttaaatcttgagtcataagaattctttatacttactgggtactagactcttatcagatacacgatttacagatttttgtctcattctgtaggtgtcatatctaagaaatcattgcttaatccagaatcacatatttatatacctatgctttcttctagggagtttataattataaataattcttacatttaggtctttgatccattttgagttaatttgcatatatggtatgaggtagggaatccaaaataattttttcgcgttggactattcagttgtctcagcaacatttgttgaaaagactattctttctccctttgaattgtcctggaacctttgtcaaaagttaattgattgtaaatatatgggtttatttctgaactcttaattctgttctgctgatctgtatgtctatcttttcgccataccacactgtgttggttaatatagctttgtagtaggttttgaaactggcagtgtgtatcctccaactctgttcttttttcaagattattttggctattctgggtcccttgcatttcaatatgacttttatgatcaatttgtcaatttcaacaaaaggccacctgggattttgttaggaattttggtgaatgtctaggttgaattgggaagtattgccatcctaataacattaagtcttctagcacatgaacacaactgttggtacattcatttagatcttctttattttctttcaatgatgttttttagtttatactgtataagtcttgcatttgttttgttaagtttattcctaagtattttatttttttgatagtattgtaaatgaagttttcttaatttgtttttcacattgctctttgctgttttatagatatacatttggtttttgtgtgttagtcttgtgtcttgcaacctttctgaacttattagctttaatagttttgctgttattactgtatttacctttagtatttaccttttatttttttcttgcctaattttcattgactagaacatccaatacaatgttgaactgaagtggtgagagcacatatattgtcatcttagagaggaaagctgtgagtgcttcataaatgtcctttctcaggttgaggaagtttccttttatttctagattgctgagtggctcttttttgttccttttaaatcagaaacagggtgttgggttttggcagacattttttctatgtctgttcatgatcagtggttattttttgttctgttaatatagctggtgtatgttgaactaaccttgcattcctggaatgaatactgtttgctcaaagtgtataatcctttttatatgttgctggatttggtttgctagtattttgttgaggatttttgcatccatatttgtaagggatattgatctgtaattttcttgtgatgtttttatctggtttcactatcaggtaatattgtttttccagaatgagttggtaagtgttccttctgttctttggaagagtttgtgaagaattagtattagttctgctttacatatttggtggaatttaccagtgaaaccatctaggcctgggcttttcttcgagggtagatatttattcgttttcttgttttaattatactgctactatttctttacttgtaaggactattcagattatttatttctacctttctaccccagctttattgaggtatgattgacaaatagaaattatatatatgtgaggtgtatatgtgatgttttgatatacatatatattgtgacatgattaacactattaagataattaacatgttcatcacctcatgtagttttttttgtgcggaaaacatttaagatctattctcttagcaaatttcaagtgtacggtactatattattaactgtaatcaccatactgtacattagagcttcagaacttattcagtgtagatgaacctttgtacccttttaccaaaatctccccatttcccctaccccctagttcctggcaaccatcgttgtactctctgcttcattgcttcatgagatttcacatgtgagatcatgcagtatttaactggcttcttttatttttctttctctttctttctctctctttctctctccctctctctccccgccccacccctttcccctttcccttcctttcctttcctagtggagtcttgctctgtcacccaagctgaaatgcagtaatgcgatcttggctcactgcagcctccgcctcccaggtttaagcgattctcctgcctgagcctcccgagtagcagggattatgggcacccgccgtcaacacccagctaattttgttatttttagtagagatgtcatttcaccatgttggccaggctggtctcaattcctgacctcatatgatccgcctgcctcagcctcccaaagtactgggattacagatgtgagccaccacacccggccgcctattcttaaattaggttgttgtcttgctcttgagttacaatattttggatattaagctcttatcagatacatggtttgcaaatattttgtcccattatgtagattgtctctttactgtgttgattggttcttcttctgtgcataagctttttagtttgatgtaatatcatttgtttatttttgcttttgttgcctatatttttgggatcattttcaaaaatcattgcccagaccaatgtcaacaagctttttttcctgtgttttcttctaatattttaaaaatttcatatcttatgtctttaattcattttgagttgatttttatatatggtatgagataagggtccagtttccaacttctggatgtggattaccagttttcccaaggccatttattgaagaaactatcctttccccattgtgtgttctcggcacttttgccaaagatcaattcaccctacatgtgtggattcgtttctgggctctctgttgtgttccattggtttatatgtctatttttatgccagtactgtactgttttgattattattactttgtagtatattttgaaatcaggtactatgatgcctccagctttgtgcttactcagttttgctttggctctttgggttcttttgaggttacacgtaaatttagggttgttttttctattgctgtgaaaaatgccattggagttttattaggattacactgaatctgtagatcactttgggtggcatggacagttaaacaatattaattctttcaattcatgaaaacaggatatctttccatttgtattgtcttcaatttctttcgacagttttatagtttttattttatagatctttcacctccttggttaattttttttttttttttgagacagggtcttgctctgtcacccaggctggagtgcagtggtgccatcttggttcactgcatcctctgcctcctgagttcaagtgattctcctgcttcagtctcctgagtagctgggactataggcgcctgccaccatgcctggctaatttttgtattttttggtagagatggagtttcactgtgttggccaggctggtctggaactcctggcctcaaatgatccacctgccttggcctcccaatgtgctgggattacaggcatgagctaccgtgcctgggctgattaaatttattcttaaattttttttatgctattgtaaatggaagtgttttattaatttctttttcagatcattagtatatagaaatgcaactgattttttgtgtgggattttaaaaaaagtttattttattttttatagagatggggtctcgctatgttgatcaggctggtcttgaactcctggcctgaagcattcctcccatcttggcctcccaaaatgctggaattacaggcatgagccaccatgcccttccacaactgatttttgtatgttgattttgttatcttgcaactttactgaattagtttaactgactccaatagtttcttggtggaatcttcagggttatccatatatacaattatgtcatctgcaaatagagataattttatttattcttttctgacatggatggcttgtattctttttttttctttcctttagcctgattgctctgggtaggatttccggtactatattgaatagcagtggtgagaatgggcttacttgtcttgttcctgatcttagaggaaaagctgccagcttttcatcctggagtatgaaattagctgtgggcttatcatttattgcctttattatgttgggtacatttcttctatacctagtttattgagagtttaatcacaaaaggatgttgaaagttttttttttttaaatcatgaaaggatgttgaattttgtcagatgcattttctgtatctattgagatgatcataagatttttattcttcattctgttaatgtggtgtatcatatttattgactatgtatgttgaaccacccttgcatttcaggaataagtttcagttgatcttggtgtatgatgatcctgttaatgtggtgttgaatttggtttgctagtgttttgttgaggatatttatgtcttctagaatcatttttggtagcttgtgtctttctaggaatttgtccatatcatcttagttatctgatttgttggcataaaacttttcattatattttcttgtaattcttagttctgtaagtcagtaataacgagctctttcatttctgattgtagtaatttgagtcttccttcttttggtcttggtaggacttgctaaagatttgtcaattttgttttcaaggatccaacttttggtttcattgtttttttttctattgtttttctattctctatttcatttgtttctgctgtgatatatattttcccccctgcttgctttggttttagtttggttttcttttttctagtgttttttgggtggacggttgggttatgattcaagatctctttttaaatgtaaacatttacagttacagttttccctgtaagcactgctttaactttatctcatatgttttgatatgcagtgtttttgttttcattcatctcaaagtttttttctaatttcctttgagatttatcctttgacctattggttatttaggagtgtgttgtttaatttctgcatgtttgtgatttataacaaatctttatggcagtcatacataaacctgtatctgctaccctcttctccccctttagaaaatttagtttgaggccaggcgcagtggctcacacctgtaatcccagcattttgggaggctgaggtgggcagatcacctgaggtcaggagttcgagaccagcctgaccaacatggtgaaaccctgtctctactaaaaatacaaaattagccaggcatggtggcgcatgcctgtaatcgcagctactcgggaggctgaggcaggagaatcgcttgaacctgggaggtggaggttgcagtgagccgagatcacgccattgcactccagcctgggcaacaagagcaaaactctgtctcggaaaaaaagaaaatttagtttgagggtattgcttgcccttacagtgtcgatcttttaagcattcttgaatacatgctgccatgttttgagtttgcatgtctgaaaatgtctttcttttgctttctcgtagtatctcagtagtttatagatactatttttgatgtcttctaggttttaatttttcttcagctcagggaagttttctttttaatatttgattttttttcttaatttgtttcctcccttctgaaaacgagttattttcatagtagatcccctagatatgtcctttgtatctgttgttttaactcatgattttaatttcttcatattttgatgttaacgggatgattctacttcattttctagactactaatttcatttctagcagtgcttctgcccctactctttactgaatttagatttttgcaattgcgtttcactgtcaactcttttatttctaattatatttactttaaaattcaaataatatacttataaaagacctatttctgctctgaccgtaatttctcctctagttgagccacctattctgtgtttgactagggctctcccttgcaaggtaattaggctccttaaattacctgtaagattttcttgccacagcatccattctggttaggctggtgatcttctgagtagtgatagattggttggtggtgaggtttacaggtgttcccttctcttactcctggtgttggctacaatcaggtggcgtctagagcagcatgggacaggtgggtaaggggagtcttctcattatgcagaagtgatcaacttaaatctctgtcagatctacctttatgtagccctacagacattcttccccatagatttgaccagaaaagcaggcctgatcttacttacctattctaacttattgattctcctagccttcttaacagtggcattaagaaggtgttgcttggaattttttttttttaatggtttcacatagtttttaagttgaagttcaaattacctgacatttttcggattcctaccttaccactgtagcccagtttcatgccccactttccatcttttcttcacattgtactttgaacagcctatttgtggttccctaaatggatatggtttttcacatctttcctttgaacatacagttcactttgtttcagatgcccatatgccctttcttttcatcagatgcatcactctttgaatgtcaaggtcagatcaggtatcactttaaggatgtttctctgattacctcattccatctaattgcccaaatccaaatctggtggacctcctgtgtccctcttcaacacctgtgtgtacctagacaaaatttttcccatcacattttaattatttgtttcttactagcctactaagctcttgaagacaaaggactgtgtggcatattttaatggtctcagcacttagctctgtgtctactctttagttatgtcctcaattttgggggaatgaaatccttttattataagaaatcaaaacagtgtatcctgattcagaaactttggagacttaggcagtaggaggctaattttgagactggcatatatttttaagagtactgggggaaaattttgaattgcatttagagtttacatggagtcatgtggtccttctggacttgctttaatattatgttcttagcactgcccagtatcagcaagctctttggaactgaaaataaggccagtgtctgtttattttactaattttcctaacttctaacctgttaacatcacgtaaaaaaaaatgtacccatctagttgcttcatttccttagcatatactttaaagtactcatgtgtaaggttccatttagtgtccttggtttgtagacagaggacaaaatccttgccctcagatgcttttagtctgttctagtagtaaccacagcagagcaagcatagtttggtaacttccaggtggacatattcatcattttgtccatgggggtaggagggtggtcttaacagtttgcaggtttaacccacatttcaaaaaacatgttaaaatatgaagtgttctaattaaatctattggcacagtaaatagatattttgggatattagtgaactaaagagatatttggggagatggcagctacaagctaaaatctgaacactttgattaatatttagaattaattgacaactacagagagccagtagtggtggtgctgataagaatgtggatggtaaccaaaacttagtctgtcttacagttttgcctacagctggtcatagtgaaaatatgtagtgtgaaagtgaatgtcattgatggacaagtcttctttaagacatttgacttcgttttctacttttgtccactccagattttttgccaaaacaatatggattttttttctttggcagaaataaaccccagctctctagctaccttgagcaaagaagggaagttattgatcgaatatcagtcaattcacagaatgatttggaagcctggaagaccagagttgcacaggaaccagggcaaccttgggtgatgaagcaacagaaactgctcatccttttgattgtgggatctccagtggattaaaaaaaaaaagacggccgggcgcagtggctcatgcctgtaatcccagcactttgggaggctgaggctggcggatcacgaggtcaggagattgagaccacggtgaaaccctgtctctactaaaaatacaaaaaattagccgggcgcggtggcaggcgcctgtagtcccagctactcgggaggctgagataggagaacggcatggacccaggaggcggagcttgcagttagccgagatcatgccactgcactccagcctgggagacagagtgagactccgtctaaacaacaacaacaacaacaacaacaacaacaacaacaacaacaacaaagacacccccccgccatcccatgcttattatatcattcctttgagattcaaacttctggggaagagagttgattaattttcccctttgtttctcgattataggtatgggtaaagattatgtatgggagaaggaccctccttagaatttctctagttgctgggcaggttgatttccagtcctaccaaaaatacaaggacaggatggttttctaaaaagaaactatgttgctgtcatgaaattggaatggaggttgaatacctaaaatgggaaatgtttactgtgttctgaatcataagacttgactttcaaatcccaaatttaagacagttaatgctttttagggatgcaaggaatgtttatactagattatgtctggttagatgggggcatctattgttgaaatataatattccctcttaacccatatagctcctctcaagcattgaactcaagcactgatttttgtgattttcgtatgtctgtagcagaggtcggcaaactttttctgtaaagtgccaggtaactaaatatctgtaggtcatgtggtctctatcaaaactactcaactgtgccattttagtactaaagcagacatataccatatgtaatgaaatgagtatggctttgttccagtaaaactttatataaaaaccaggcagagggccatagtttgctgatcccctatcttatagcaactctgtctaatagaagtttctgatatgatggccatcttttgtatctgtatggcctaatagtagccactggccacatgtggctactgaggatttaaaatatggctagtgcgactgaggaaattaattttcaatttaattttaatagtttcttagtaaaaaactattgtgtctgctagtttaaatattgttctttttactaaacttttggcaacattaccaataaaaagccttataaagtggagttatagtggagctaggaaagatatttttattgatagagaatgaattctggtataaaaagcattaagaataaatgagtgcttatctatggggaaatattaccagctttagtctccaaagaattaatactgaaatttaacctttttaaatacatgattttagaaagtgaatacctaggaaaatcccaaggatttgatgactttgtagcaaaaaaccgttcaaataaatagcataggcgataagtagttctcttcctcactacatttagaataatgcacaaatcataagtacactcaatgaatgttcacaaactgaacacagtgatgtaagcagcactcatatcaagaaataaagattatccccataacatgattatgatctagagaaaaatcacaaggaatctaaaaataattaaaactaataagtaaattagttaaggtcattgattataaatcatatattaaaaccagttatattttctgcatatcaacaacaaataagtagaaagtagaaaatgaagttttagaaaggtaccatatacagtattaaaaattgttaatataaatatgttattaaatctttataataaaaatataagttgaaataaatcttacaaaagatactcaagacatcttcactgaaaactgtaaaacagtgaaatcagaaaaggccttagtaaatgagatgcaatattcaaatattggaagactcaatgttataaagctatcagttcttactaaatcgatttgtagcttcagtgcaataccaattaaaatcccagcaggattttggggagggtggaaagtaacaagctgattccaaaattatataaaaatgtaaagaccaagaatggtctaggcagccttaaaggacaataacagagctgggagaattatactactagatatcaagaatattttgtggtattattgataaaattaaaccaggcacggtggcttgtgcccgtaatcccagctacttaagaggttgaacgggaggatcacgtgagcccaggagttcgagggtgcagtgagctatgatcatgccactgcactgcactccagcctgagtgacagagcaagacctggtctcttaaaaaataaagagaaagttagttattaagtcagtctgatattgacatggatagaaaaatagaccaatgaaagagaataaagtccagcagtagacccatctgtaaatagtaacttgatctatgacaaaggtgatattgcagtgcagtgggaaagagttgatcgttaaaatagatgtgctgtatcaattggatatctataagggaaaataaataactcttcactttgaactcttatcatgatagaaaaatcaatttcaagtaaattgtagatttaaatgggaaaggtaaagcaataaaactttaataaaatgaatagactgtcttcattaccttagattggcagagatttcataaataggttccaaaaggcagtagccaagaagaaaaacatttgataaatgtaactacgttgaaatgacacagtaaggtgtgaaaaggcaaaccatagattcatgtcctgaatatggaaagaattcctacaaatcaagaaggaaaagacacacaattcatgttcataatttcaaagccaggccaaatgtggtgtctcactcctgtaatcccagcactttgggaggccaggagttcgagatcagcctggccaacatggcgaaaccttgtctctaccaaaaatacaaaaagtagccgggcatggtggcacatgtctgtaatcccagctactcagaaggctgaggcagaatcacttgagcccggaaagtggagtttgcagtgagccaagatcatcataggatcagggagacttttgtgtctgtcctgtgtttgagctatttcatgtatcccatatcttctctttcttgctttatttctttgtttttggtggagcagattctctggttgcttcttgaggaaagatatatgggtagtgaaatttttgagaccttgcatattttcctcctcccactttgtttttagtgtatctgacgggtagaattctaggttggaaatcattttctcagaattttgaaggcattgttccattgtcttctagcttccagtgttactgttgcacactccaatgccattctgattcctgattctttgtaaatactctatttgttcttccctcgaagcttttatttaggagcttgtgtttgtctctagaatttgaaattatttattctgatgtatcttggtttggttttctttaagccattgtgcttgattttttaaaaatgtgtctttccaatccagaaacatgctttccagttctggaagaattttttgagtgatattggactttgttcatatctgtgcattaggcacttaaacacttactggaaactgtgtaactgggcagggtttactgactgatggatgggttttgttttttggggtgtttttgatacagggtctcagtcgctcagggtggagcgcagtggcactgtcacagctcactgcagcctctatctcctgggctcaagtgatcctcctaccttagcctcctgagtagctgggactgctggtacatgctaccacatctggctaattttttttttcctctgtagggacagggtttcaccatgttgcccaggctggtctcaaactcctgggctcaagccatccgtctacttcagccccccaaagtgctgggattataggtgtgagccaccatacccagccatggatgggttttgcagtaggatgatctagttaagtcatttctctgagggacttatagaatctcccagagagagatttttatcatctcatacctgtggagtaaaagcttggctgctaactttttagaattgagaacaagaaagggcctaagggtctctttagtgtagactttctacttaaccttctctgttttctcagctgtgccttatgcatcttagtacagagttctcctagctcactatttccagagtgaagttggcctccagcatttatgatgacaagtcaactgttacttttatccttttttgttctcatgtgtactttctccagctgctttcaagattgttttctttatctttggtttttcagcagtttgactatgatgtgcgtaggtgtggttttctttgtagttatcctgcttgggagattgagtgaacttcaatctgtaaattaatgtctttgccaaattttgggatttttctggctgtcattttttcaaatatttttttctgcatatttttctcattttatgaccccagttacatgtatcttagactgcttcatggtgtccaacagacactatttttcaatatttttttctctgttctttagtttgagtaatttctcttgacctatcttcagtactctttttccattcttctgttaagcccattcagtaagttttctattttagagagtgaaattttcagttgtagaatttacgttcagctctttttacggtttttatttgtctgctgaaatttccaatcttgtcgtttgagctacttatattagctgctttatgttatttatttgctgattccaaatctgtgttacttcatgattagtatctattgattgtctttcctcttgagtatgggtcactttttcttgtttcttcatatgattacaaatttttattgtatcctccacgctgtgaatgacacattacagtgactttggagactgttttttgtttgtttttctttgttttaggaggcagttaacttggctagactgaaatttaagctatgtctccctgcagagggcagcactgacatccctgctagttgttttagtcttatctaggctgcttatcgtctgctccgtttttgcatagatcactgaccagccaaagaagtaggcagagttaatatgcagaatttgggactctccctttgtggatctttattttccagcgtatccctccttactttgcagcctctttggaagcttgaaactcttgtttttcaagccagtaagactaaagattttgatctgggtttcaactgctgtttgtgcagctctgatctccgggaccttcccctcagcaaaagctgtaaaaacaggaaacctacccagatctattcccttcttctcctcttctttttttttctgttttttttttttgtttgttttttttgagacggagtcttgctctgttgcccaggctggcatatagtggtgcgatctctgctcactttaacctctgtctcccagattcaagcatttctcctgcctcagactctctagtagctgggattacaggcatgcgccatgacgcctggctgttttttgtatttttagtagagacggggtttcactatgttggccaggctggttttgaacttgtgacctcaagaagtctgcctgtctaggcctcccaaagtgctgggattacaggcgcgagccactgcacccagcctctgttcccttcttctaagtgttgtcttgtacttagattctgcctacttttggttcaggtagtggcttttttaaatcctttttttccaggatttatatatagttatctgtagaaaataaggtattctgtttttactggtggtggaatcttattcatctacctacctacttatatttttattgtttgttttaaaagataaaaatatttcatgaatttttattgatatttcctattcaaactcaggattataaggtttttttcatatgcatctttatactgtgaattatgaaattcgaagatacgaagcagaggatagaattggatatcccttaattattttactttattctgtatttcacacacatagctgtctcaaaataacattagcacagtgaacaaagtgggtactgaaaacaattattttgtgtatgctttccatcccctagttttaaaaatactgtactattaactttgcatgcatttagtcattaaatattatatcctctcccttgtcattatcatttaatcttgatcaacaataagtcatattattgcttgccttcagttcttagactggtaaactattcattttggttgtcttaagcttgttctgtagtagattctttaggaagggctcatgggagcagggttccctaattgcttgcatttttggtaaccgtttatctatgctttccatgtgtttaaaatggattttactgaatataaaacactttgcttttattttctttccttgaatagcttatgtcactccatttttgtctggcataaagtgtttgcctttgatgttcgctttctgggttgttattcctaggtgtgcatggtgctctgtcagtagtttcaatttttttaattgaacatttaaaaaacaacaactgacaacaagagactgacaactgaaaatgtcagagacatttttttttctttttttttttgagatggagttttgttcttgttgcccaggctggagtgcaatggtgtgatcttggctcgctgcaacctctgcctcccagattcaagtgattctcctgcctcagcctcccaagtatctgggaattacaggtgtgcaccatcacgcctggctaattttgtatttttagtagagacagggtttcaccatgttggtcaggctggtctcgaactcctgacctcaggtgatctgcccgcctccgcctcccaaagtgctgggattacaggcatgagccactgtgcccagccatcagagacattttcttgaattacagtttttactattttctggctttagtagtttttagggtcttctgttatctgtatattgatctttgttgcttcatcatcagctgtagcttactctcaaatacttttcatctcttcatttcttttgatttcaaaaatgtccctgttttttgccttctggttatcttaaagcattatctactgtatatatttgctcttgggttcattcagatatactttttatttctgaaacttttatttttaatgctttcttgagttctgttaccttatttccgagttttttgaaatctgatttatatagttgtttcatgtcttgagtcctttttgtaatatctcttagttcattttaaaatagtaggttacaatttttacctattttgtggatgtgtgttcctggtatgcttttattatctggatgttattctgtatcttactttattttttcttatacctttatgacctgcataattttcttttgcctactttcatgtgaaattggatttcctgaacacttaaatggttggtgtggttcaggatggcttttcttacagggctttctctactgctgtttttaggcacgcttcaaaactgtggcatttgctttctgagattgctaggctgtgttccctcccttctttatctgaatattctctttccattattgtaattgtacctatatagtactcaattttcattccacacccagtaatttgtactcattgtaccaccctgttatgtaaagatccgtttcaaggattcgtggaggctagactgctctcactttttaaatgtaaccgtggactcctcccacttagtcactaattgaaagtgcaaaacccttctgtacttaagttaacctagcttctgtacctaacttgttggctgttttaggtgtcttttgttctcggttatcagacatctgtttctttctgtttcctcccatattgataatgataccatacattatctatggttgttgttgacttgtttccatctgatgttttgagggggattcatggagattcttgtcacctagttttgttgtaaatacagtctgtgggtttttggtttactatttagttttatacatttttttggtgggtatttacagatgctcaaacactttgccactgcccttattgtcccagaatctttctaatgtattacttcttaattgctgctgtttcaaatttgataatcttgccataattagattataacttattccaagtactacttgaattgtaattagttcaagcgctatcctttgttgacagcagcttttacagtatccagcatagtactgggcatgtatgcaatggctcagagttgtcactttggaaattaatctaatttcaattatataattatagtctaactggcaacctgttaatagtaggattagcagccactcctgttacaagtgaggtgaaacatgaggatatcaattggcttgcctgtatgtaatgttaattcttgcatcatctttgacatatatgccataatctgtcagccacctggtctaagcatttctggaagactatgatctgatgtactgatggtacaaaaaagtgcacaagataataagtatcatagaagcgtattggaaacaaagcagacatcatcctacagaatgttagctctttctttgttacagttcaaaaatattgtcaaggaaatggagaaattcttgagcaaagcaattaattaaaatggtcgagatggtcaaagatgtttttgaagagatagagttaaaacaaattttaaaaaaaagaaaaacaggacagtttgttaatacagagaaaggcaaagaggtgtgtttcagacatgatggaatttgataattgtgaagggacctgaagagcccaaataatactttcagccaaaggtagcattagtttttaatacattgagtaataattttagggatcttgtcatcctaacaatggcccagttcctttgcttttgaactgggatttaaaaaaccagctaatagaagtcagttcctaaaacacagcagaactttattgacttgataaaacttttcaaagtatatagtgttaagaatttagtatttcttatttttacctcatttggcttccttgttttaaggaattatactttatttatttatgaagatagattatctactttgtaatatgtttgtttaaaattattcccgctgctttaaaaaaattactcctaatttttaccttttaaaaaatctttaacaggcctcaacaaataacgaaagctctaatcacagttttggaagcttgggatctttaagtgacaaagaatcagaggtaagtaatttcattttaaatatggtgctattaaagtaaaagctggaatcaccgttttaattagtattttgtttcttcatcagttcttttgctaaaggttaatgcttttaaagtttcttataggaatgttttgttctgccttatgaagcacaacattcagattgaagactgcatttggcattagaaagaaaatataatttctttggttatgtagctgaacttgtaaatgaatgatatgtatatattcttactggagacagttattagccattcatagttctgtgagaggaaggaggttcttaagtatgttgggtttcccagttttctattatttctctttattctttccttttagtttgatccttagtaagagtttgtgtactttctgagatacacattttttccctctttttagaatttcttatggaatcatgctgctggttttcatttttcgtattttaaaaaatctgaagaattccctcccctcttaatccctcccccttttacccacttactgatcccaccaagaaaatatctgggattttacaagcaggcatttggatccatggtataatttaccctgagcatgatatacttgatgacatcttttaaaaatgggtagacaggaagttccgtgagttttagcattcatttgttgatgttacagcttgactcttgtgggtatagccttttctctccttggatgataacaggtctgtcacttgtgtgtgtgtgtgtgtgtgtgtgtgtatttttcccgtcagtcttatttctacttgatccatttttgtcttttttctacttgattagtatagacttttttctacttggttagtatagacctatcaacttgataataccagtagttcattagcactcagaaactcttaggcattttgtttcactgttcagaggaaagggaacttcaaaggtggcatctttttagctctgtgttattgaaagcatctagaaatctctaggtagacagtttcgtgcagttctgtgcaggcaccctgacactacaaaggagtatggcatagggctctcactcatcaggctttcccttccacagaaacaactggcaggcagctgaaaggactgtgcaagtgacgggactttatctgcagtaggttcccttgaggtaagcgttagtagcccctgtagcatcagattatcagtttagtttttaaaaaattaacatacttatactaagcctttgaaaattgtaggtttagctctagtcaaagttttttaaaaagtgtatcaagaatgttctcactttatatttcctggactttggaacatttcttgatattttcccagaattgggaatatttagtaatttcacctgcctcctgtttcatagacatttgtgttatgaagagcaataaaataatgttagatatttctcttttctgttcactaaatatgatatttttgatagattttttaaaaaagcaaaacatggtgaaagttagatcacttatcacagttatacattctttataggtacccatattccaaatataagttatagatttaatatttggattttttcagaggaattagtctataagagaattcagcttccctttaaagatcccaaggatcacttttggctatatttttagttaaaacatgtttttgtttcttaaaagaccatactggcatttgaaatgaaacacaatttggttaatcattggatatacttagctttatctgtattgaagttttgacatttggggcagcagtagaaaatcttgaaaaatcttttgggccatgtacgggggctcacgcttgtaatcccagcatgttgggaggcctaggcaggattgcttgagaccaggagttcgagaccagcctgggcaacatggcaaagccccatttctacaagaaacacaaaaagttagctgggtatggtgccacgtggctgtagtcccatctactcgagaggctgaggtgggacagtaacttgagccaaggaagtcgaagctgcaatgagccatgattgtgccactgcactccagcctgggcaacagagtgagaccctgtcttaagaaaaaaaaaaaaagaaaaatcttttgacttttgctgttctgcattctctgtcttggagttttacaaattaatggttaagtctagtggcacagaaatgactacagattatacattgtccttaagattcaaagaaataattactattaccattattattattattattattattattattttagtgtatctttccatttaaggagttgcttatctggaaaatgattcccaggttttatctgtatagttgataattaatgaattcctttggggtgaaattttatatatatcaaaatacagatatttatagatcattaagtaaacatgagaagaaacagttgcaggatagaagtacttttgtttttcctagtactcctagtagtaaagtttatgaagtatttcattgtcttctgatgtcactattcttttggtaatccattctccaatttactacagttgttaaaatagtagtttttggttttgggagcaaatagtactggaaggtttattactttttttttttttttttgagatggagtctcactcttttgcccgggctggagtgtagtggtgcgatctcgtctcactgcaaactccgcctcccaggttcaagcaattttcctgcctcaacctcctgaatagctgggattataggcgtaagccaccgtgcccagacagtttattactttttttttaaaaaaaattgctttctcctaccacccttaccccaccctggattcctgaaatttatatccatattttaatataattaatatgcataccctattgtagttcaccagttggacattttctgttgaatccctcttaggatttgtgatggttttaactcaccacaatcccttttctgtacttcgttttctcctacccagtactctttttcagacatccagaatcctcttgttttcttctacccttactattaaaactggaaagcatccaattgtcattgttaagttgattaatctacttcaagtgaaatttttatttcagtttgtatgcggtttattttatatatgaatctttttttctaaatgtggaattaaatagaatgaaaaagtttttcctctcgtaaataaaagaagatggtaggtaagaaggtattgttttgattttgttttattttacatcactcctggtccattcagcaggctccaaaaaattcaggatattttcagtaaacatttattgcatatctattaacttttagtctctgcccaatcacagagaatataaagatgaataggatacaatccctgccttcaaatgaaatcagtgtttagtagaacaaacatttagacagtctgcctcatgacagtgtaggctgtgctgtaacagatagaagcacaagatgctatggaagcaaagcgcaagaaaccaccaattccatttgcctgtaggggaaaggaagcaaagaggtcttccttcaaagaagagatgatagtcgagtttttaagagaggctgtgaattcatcccataagacagagtgaagtatgaaaagaaggtatacagagggactaggatatgtgtttgcttttatgtgggagtatgacaagtcgtttggtttaagagaggacagtgattctcagccactactgctctttagatctccggaaaagctttaaaaaatacccagctgcttcagtgattccactggttttcaaacttctggtagagggactatatgcaggaatggtgaaaggtaggcaggggtcaggtttgaagacccttgtatttcatagtaaagaatttggacttcaggtagagagccattgaaacaggggaaacaaaagacaaagtagaggtgaaaggctcccacagatggaatgtagaggattgcgttggagggacatgaaacccaagttaggaagatcacttaattaaggaatacagccttctttataaaactctataaccttcaaggtttaatattaggaggaaaaacttgagataagaggacttctaactagtattttcaagtttgctgtttgggctctgcctttttcagattctctaactttggttactgagactatcaccacccaaggctgtggttctcaaactgttctgtgcgaatgaatcacttaatgtttatgacggtaggtctggggtagaattttgcatttccaacaagcttctagatttcattagattttttttttttctttttgagacggagtctcgcctgttgcccaggctggagtgcagtggcgtgatctcagctcaccacaacctccgcctcccaggttcaagcgattctcctgcctcagcctcccaagtagctgagactacaggtgtgcgccaccatgcccggctaatttttgtatttttagtagagacggggtttcactatgttggccaggctggtctcaaactcctgacctcataatctgcctgccttggccttccaaagtgctgggattacaggtgtgagccaccaagcccagcagatttcattagatttttaaaaagtagaatcagtagggtttgatgacttggaattagcataaagaaggaaagggaggagcctaagatgattcaaagggatctagctagagtgcctttgattgagatgggcatcacagaaggaagataacaagtgtagatggcacagtagaagatatctggaattcaggaaagaggtcaggctacataagaagacctaggggtctttggcataggtgttaattaaaaaggcttggttgtagataagcagatctcagagtatggtttgaggatttctaggggtcccctgcgattcttccaaggagtccacaaagtcaagtgttttttataaaagcgccaacacattatttgactttttaactttcattagctcatgaattcacaatgaaaatttccagaagctgtataacgtgatatcatcactctgatttattcatttgtattcttttacacttgtatattctattgttataatgtttttgtttaaaatcctaaaatagtaaatatcgatagttatacacatgtaaataaaagctctttggggtccttaacaattttttaaaagttacagagggatcctgagacccaaaagtgatagtaagtggaattaaatgtcatagaagtcatttaagatagggactgtaaaaagtgactaagaatttgacacttagacttaattttagtagattaatgggaacaaaatgccagattgtagttaattgaggagaaattagaaagtgaggaaatagcgacagcaaatattgactgcttttggcagaaccttgactatgaaggaagggagacagtatctagagtcagacaggcttgacatatcatgtgctaaggaaagagtcatagcagagctgtgatggagacaaagtgctgaagagagagggaaaagagaaataaaaccacacatcttttcctggaggaggaatgaatgggtgaaatccagaccctggttgggcagggttattcatagacaggactaggaacatctttcccctgaattggggtagatgaacttgcatatctgataactttttctcttacttcacagtgaaaataggttatcagctgaaaggaaagaagcgtgagtgggttgtggatttgaggactgataaaaattttatcagaggaccagagaagagagtttaccagggccactcatcctttatttaaattttttagaatacctgaaggagttagaaatatggtcatgtacctgacctgctggctaacagcccacattattttatgaagataagagcccgtgtttcttgagtaccagtgtttcttttttctttctttctttctttcttttttttgagacagagtctcactcgttgcctaggctggagtgcagtggcgccatctcggctcactgcaagctctgcctcccgggttcacgccattctcctgcctcagcctcctgagtagctgggactacaagcgcccaccaccacgcctggctgatttttttgtatttttttttttttttttttagtagagatggagtttcaccgtgttagtcaggatgctcttgatctcctgaccttgtgatccgcccgcctcggcctcccaaagtgctgaggttacaggtgtgagccaccacgtcctgctcagtgttttctaagttttaaaacctgccttgatccacccatttgcagttcttcttgtagcactttcactatctaaacacaatgatcttgtgtctcagttcattttctgctgctctaacagaatatcacagactgggcaatttataatgaacagaagtttatttggctcttgggtccagaggctaggaagtccaagagcatggtgtcaagcatcaggtgaggatcatcaccccgtggtagaagatggaaggcagaagtgagcgtgtgagacagagagggagaattggactcaactcatccttttaatcaggaacccactctgtcagtaacgaacccatccccacaataatggcattaatccattcatgaggcccctacctctttttctccccccgccctccgagatggagttttgctctgttgctcaggctggagtgcagtggcatgatcttggctcactgcaacttccccctcctgggttcaagcgagtctcctccttcagccccctgagtagctgggattacaggcacccgccaccatggctggctaagttttatatttttagtggagacagggtttcaccatgttagccaggctggtcttgaactcctgaccgcaagtgacctgcccacttcatcctcccaaagtgctgggattacaggcaagagccaccgcacctgcctccctcccacctcttaatattcttactacggggagtaagtttctacgtgaacttcagggcacatagtcaaaccatagcaccttcagattctgtacagttgctgtctatacctaagcccaagatgctaagttagattatgtatcttctagctcatttggaattcttaatgattattaaaagcataaccatttttcctcttctcgttttggatgccctaggatacatttatctgctttatttatttcttactgaagttgggatatttgtgactgaacatatcatttaattacatcatttttaataattaatgttggagaagcacagttatgtctgtttatacgtgtgcttatatacaatatactccataatattcatgtttataaagcagacatatatcaaattattctgtttttctcaatttaatccttaatattcatctttcagaatacttttgtataatctcaatcaaatttgaacaagttaaaatatatactatctctataaccaaagtagttttccaccatttttcatgggtaactaccaagtcttaagcctttatccactgaccttaaattactgtgtatttttcatcaaagtatattttgggattttcgagttattaattttaaattatatggatatgtggaagctgggacagttgttgcatctagagcatttcctgatttaaccttgttttatatacatacccacctctactttctcataccttcttttttgccctcttaatgcttagtgcttagctagtgcttagtgtattctaagcactagtgcttagctatgattctatttgaaaacagaggtaatactggccttaagttttgttaacattttcattaaattttaatttatctatatttatttactgtgacctggagaaatctttttttttttaatgccttactctgagtacctagtaagaaagaagagagactttaaaaatcgatttactgttggatgggataagtatcactgaaagttacatttttaggccttttactcctgaataaattaccttgcttttgactaactctctttaaatctgttctcctccttaagatgttagacacctatcatcaattttaagacatattctatcttgctgtctaaattattttctaaaatatgttagtgtgataaatgatgtttgtggtgttctacttgttgacctcctctgtcttttatttatcttcctgctagtatgttctcactttgttcttaccagaaatcttactatttttatgtcattggttttttcttctttctttctttctttttttttttttttttttgaggcagagtctcgctctgtcacgcaggttggagtgcaatggcacgatctctgctccctgcaaccactgccttctgggctcagcaattctctggcctcagcctcccaagtagctgggattgtaggcacccaccagcttgcctggttagtttttgtattttcagtagagacaaggtttcaccacattggccaggctgatttcaaactcctgacctcaaatgatctgcctgcatcggcctccgaaagtgctgggattacaggcatgagccactacacctccacctccagcctatgtcattgtttttactgaggcatgatatgcaacaatgttgctgtatacaatgaacaaatatgtacagtaatgatgtcttgaaagcaagtactctttgtacacatggaaaatagtattattttgtaacataaaaaatggggaatgtggccgggaggggcggctcatgcctgtaatcccagcagtttggaagactgaggcaagcagatcacctgaggtcaggagttcgagaccagcctggccaacagggtggaaccccatctctactaaaaatacaaaaattagctggtcgtggtggcacatgcctgtaataccagctactcaggaggctgagacaggagaatcgcttgaacctaggaggccaaggttgcagtgagccgagattgcaccactgcactccagcctgggtgacacagcaagactccatctcaaaaaaaagaaagaaaaaaaaaggagggggggggggaatgttaagtttattctcttctctgttattaagacaaataatcatgaattattagacttaaaagttcctgtgaaacacctgaaattactttgtaactttttttttttaaagagaaaacagtatttaattcaccactatatattgaaggacacagtcttttagagacctatattcaggcagaaattagagtatctgacactaaaatatattgtattaaccgggttcatagcaaaggaagtgagtcctgcttgaatatgttcatgcttattagtctcttggaaggaaaagtgaactggaaaccaaatgtgagtctcatcctggctgtatacatctgtttccataaaggtagaagaatatgtatatcagaattcttcaggaagctttttttaatgtttgagtagccaggctccctgcttggaaattctgatatattctgtctagttgagttcttgtaggtcatgaaatcatgaaatggatctgtaagctatttagcaagcaaacaaacagctgttaaatgttaccctttaaaaaagtatattcgatgtggttcagtggttgtttgttacagcaagaaatttctaagggaacacaacaagagtgcccaccttcaccacttattcagtatagaatgggaagtcctcgctagagcagtcagacaagggaaagaagtaaagggcatccaaattggaaaggaagaagtcaaattatccttgtttgcagattatataatcttatatttggaaaaacctaaagactgtaccaaaaaattattagaactgataaattcagtaaagttgcaggatacaaaatcaatattaaaaaagtagcatttctatatgctaacagtgaacaatctgaaaaagaaaccaagaaagtaatcccatttgcaatagctataaatactatgaaatatgtagacattaatctttttttttttttttttcgagacagagtcttgctctgttgcccaggctggagtgcactggcacaatctcagctcactgcaaccaccacctccccggttcaagcaattctcctgcctcagccttctgagtagctgggattacaggagcgaaccactgcacccaacatttttttttctttgagatggagtttttgttctgttgcccaggctggagtgtaatgatgtcatctcagctcactgcaccctccgcctcctgagctcaagtgattctcctgcctcagcctccccagtagctgggattacaggcgcccaccaccacgcttggctaatatttttttttaaatgtatttttagtagaaatggggtttcaccatgttggccaggctggcctcaaactcttgacctcaggtgatccaccaaccttggcctcccaaagtgctagaattacaggtgtgagccactgcacccggcctacccagctaatttttttgtacttttagtagagatggggtttcaccatgttggccaggctggtcgaacttctgacctcaagtgatccgccccccttggcctctcaaagtgctgagattatgggcgtgagccaccgcacccagcttttagacattactcaaagtagtaaaatatctctacaataaaaactataaaacattgatgcaagaaattgaagagtatgcaaaaaaatggaaggatattccatggtcatggaatggaagcatcaatacttttaaaatgtccattgtacccagagcaatctataggtttaatgtaatccctgtcaaaataccaatggcattcttcacagaaatagaaaaaataattctaaaatttgtatagaaccacaaaagacccagaatagccagagctatcctgagcaaagaacaaaaccagacgaatcacattacctgacttcaaattatactacaaagctatagtaatcaaaacagcattgtactggcataaaaacagacacatagatcagtgaaacacatagaccagtggaacagaacagagaatccagatagcaatccatatatctacagtgaagttgtttttgacaaaggtgccaagaacaaacattggggaaaggacagtctgttcaataaatggtgcagggaaaactggatattcatatgcagaagaatgaaactagatcccctatctctcaccatatacaaaaatcaaatcaaaatgggttaaagactgaaatctaaaaagacctcaaactgtgaaactactataagaaaacactggggaaactctccaggacattggtctgggcaaagatttcttaagtaatacccgacaagcacaggcaaccaaaggtaaaaatggacaaatggggtcaggcgtggtggctcacacctgtaatcccagcactgtgggaggcagaggcaggcagatcactatgtcaggagatggagaccatcttggctaacacagtgaaaccccgtctctactaaaaatacaaaaaattagctggacatggtggcaggtgcctgtagtcccagctactcgggaggctgaggcgggagaatggcgtgaacccgggaggcagagcttgcagtgagctgagatcacgccactgcactccagcctgggcgacagagcgagactccatgtcaaaaaaaaaaaggacaaatgggatcacatcaaattaaaaagcttctgcacagcaaagaaaacaatcaacaaagcgaggagataacccacagagtaggagaaaatatttgcaaactatccatctgacaaggaataaataactagaatatatgaggagctcaaacaactctgtaggaaaacatatgataatccaatctaaaaatgggcaaaagatttgaagagacatttctcaaaagaagacatacaaatggcaaacaacttgatgaaaaggtgcccaatatcattgtttatcagagacatgcaaatcaaaattacaatgagatatcatctcaccccagttaaaatggcttttatccagaaggcaggcaatgacaaatgctggcaaggatgtggagaaaagggaaacctcatacactgttggtagaagtgaagattagtacaaccactatgaagaacagttcggaggttcctcaaaaggctgaaaatagagctaccgtgcgatccagcaattccactgctagatatatacccaaaataaaagaaattgatatatcaaagagatacctgcactcccattttgcagcactattcacaatagccaagatttgtaagcaacccaagcatccatcaacagatgaatggataaagaaaatgtggtacatacgcacagtggagtactattcagccataagaaagaatgcaatctgtcatttgcaacaacatggatggaactggaggtcatattgttgagtgaaataagccaggcacagaaagacaaacttcacatgttctcacttatttgtgggagctaaaaattaagacaatgcaacttatggggaaagagggtaaaaagatggttactagagtctgggaagagtggtggtggtggggagggggaatggttaatgggtacaaaaatagaaagacttagtaagacctagtatttgctagcacaacagagtgtgtatagtcaaacataatttaattgtatatttaaaaaaaaactataagtggattgtttgtaacacctttgtgttacagttgtttgtaacaactgtatcaaaatatgtaccccataaatatatacacctactgtgtacccacaatgattaaaaaaaaaaaatttaaaaaggaaccttctaagctgattggtggaaacaagattggaagagaaaaatggcctattactgtaagagagtgaagatatttttttaaagtggaacccagtatagttctttaccataataggtgctcagtaaatagctgttgtctacccacctcgttaataggctactacttattctctagcatactcatctcacttgctagcatttcctagtatacaatcaggatgagtgtatctacaaaagcagttttcaaattttgggtctcagggactgctctttaactttaaaaattgaaggaccctaaagagcttttgtttatgttggttacaactatttggtatttaccattttaggatttcaaacaaaatgttgtaaccctagaattcacgaatacataatccataaatcatccagtgagatgtcgtcacatgtcatatagcctctggtaattttcactgtaaactcagaatgaaagtaaaaaagcacaccgtacagttagttttatgtaccaactacaaatgattcttaatgtgttcatcaaagcaaggtttctcacccttaacattattgacgttttgcactggataaattttgaggggtggggttcctgtcctatgcaatgtaggatgtttagcagcatctctgcctctgtacattagatatctacagccttgttaccgccatcctcagtgcgtcaaccaaaaatgcctctaggtattgccaaataccatctctcctggttgagaaccaactcattactggaaggagaaaaaagaaagtttttagcctgttaccaatggagctagattgcgacttcttaagttttacatgtctaaatttagaaaccggtgctcagagtaaataatttgtccatagtcacacagatacaagttaacagagtcagaatttcattcccaaagtatgccttatttcaaagtgatgctctcaactactgtgctattataatctttccatataactaagatagtatataacttgttatataaattaccctggtaagtcttggacaaaaatggtactctttggaaatatttagatttcagataacttacagtaattatcaaatttgccaatctaagatatacctgagctaacagcacttcacaaatgtttaatctgataaatgttgcttttagactggatttttaaagcattgagcacaagttgacattactgacaaattttgtttcagaattttattctttagtttaaaaaatattagaaagatgtatttttatgtcagtagaacacagtgaattttctttaagattctcatttttctaaaataactgagtaaccatgacaacccatttgactttttataacctaattagttttctgctatatgtaataattttggtctttaatatgggaagactttaaggaataacattcttaattttagagatactgtaaagtggagtatgtgggaactatacaacgtactattttatatataaacctagatagacagacagactgttcctaatcctgatgatacataacatcacttctggacctttttaaaattaatgattcctttggtctttttccagagatggttaaatttggactggagattccagcataagctttaaataaaagctttataaatgattgatgtatagtcagcattgagaatcaatgctaataaagatatgatagagcaatttaaaaaaagaacaaagaaactgggtatggtcacatgtctgtagtcccaggtacttgggagcctgaggcaggaggatcacttgaacctaggagttacagtccagcctggacaatgaagcgagaccccatctttcttttttttgtttgtttttgtttttgaggcggagttttgctcttgttgcccaggctggagtgcaatggcgcgatcttggctcactgcaacctctgcctcccagatacaagcaattttcccgcctcaacctcccgagtagttgggactacaggtgctcaccaccagatctggctaatttttttgtatttttagtagaggtggggtttcgccatgttggccaggctggtctcgaactcctgacctcaggtgatccacccaccttggcctcccaaagtgctagaattacaggcttgagccaccatgcccggctgatcccatgtctcaggaaaaaaagatcactttttttctgattaaaagtgttgtattggcaccacggaatactatgcagccataaaaaaggatgagttcatgtcctttgcagggacatggatgaagctggaaaccatcattctcagcaaactaacacaagaacagaagaccaaacaccatatgttcttactcttaagtgggagttgaacagtgagaacacatggacacggggcagggcggttggggggacttcacataacagggcctgttttgaggtgggggctgagggagggatagcataaggagaaatacctgatgtagatgacaggttgatggttatagcaaaccaccttggcacgtgtatacctatgtaacaaacttgtacgttctgcacatgtacctcagaacttaaagtataataataaaaaaaaagttgtattggtatagagaaaaatagtaacacttttttacccatcacatctcaaaggattggtgagtagtcttatacagtgttaatgtaaacatgtcaattgatactggctttgaatgtgcaatttggcattatctttaaaaatctaagtgtgtggccgggcgtggtggctcatgcctgtagtcccagcactttgggaggccgaggcgggtggatcacaaggtcaagagatcgagaccatcctggccaacatggagaaaccccatctctactaaaaatacaaaaaaaacaagctgggtgtggtggcgggtgcctgtagtcccagctactcgggaggctgaggcaggagaatagcatgaacccaggagacagagcttgcagtgagccgagatcgtgtcactgcactccagcctgggtgacagtgtgagactctgtctcagaaaaaaaaaaaaaaacctaagtgcacatattctgtgatacagcatttacatttaaaagtatgtataccagagaaataattgtacagacctagggattcgtgttcaaaggaatgtttgtaggggtatgatacaggagtatgttactccattgtgagtgtcacaatgggtcaaaagttgtgagaccacagctctgaatttgactattacaagcactttcaaaatgccaacatttccagaataaattatctgaaagtgttacttcccaacccccacccttcagcagttgttctaaatggctgttttattcttgtatgatttgaaaactactggcaaggtaatttgagtaggggagaaagttcaactttattctaattttatagtatatactgtttaacaaataaagccttaaagggatagccagagaagggaaagtgccaggaaatagactacgtaagtgataagaaaataacagacaaaatcattttcatcaatattaaaaacttagtatactcctttaaacatgtgtgaatgcagtgggtccaagtgataggagtttaagaagtcacaatgtgaggatgtcaagttaggtagttgttaaaaattgagcataaaataattgttttaatattacatttctttggagtactgatacggttgtgaatgctgtgcatgtgtaaatagagtccttcagcctttacaaaaatgtatgaggtggcatactttaagtatacctgtaagacagcacatattttagttgggtggttacccaatttcttcttactggtgttctaccatcttttatattacacgttattaaacaataaaggcagtacagcagaaaatatactacactccaaattgctgatatgatgattttgatttacttagaattgcaaggaaatgcttttatttgatgataggattccaaaattttacatacataaattttttatactaaatattaaaatcagcattatagtagagatcttcttttagaggtcaaaggttcaagtaaatatttacagataatagttatcaatattaaagttttaactcttgggcagagacagactatgtgaatttcaggtcataccagctcaaaatcatccttgaattcggatgtgcatatttcatggtaacgtttatatgtaaataggatacaaagcagcaaacattttcctgtctcacatctagttcaacaagttttgcctagaaatgtggataaaaattgaacattgttttaccagctgccagcaaaaaggtttgtcatgccatttgttcaaattatagtacccttgaatttggtacccaagtatgaatcattagaatagccagagagggctgggcgcagtggctcacgcctgtaatcccagcactctgggaggccaagatgggcggatcactaggtcaggagatcgagaccatcctggctaacacggtgaaacccccctctactaaaaatacaaaaaaattagccgggcatagtggcgggcgcctgtagtcccagctacttgggaggctgaggcaggagaatggtgtgaacccaggaggcagagcttgcagtgagctgagattgcgccgctgcactccagcctgggcgacagagcgagactccgtctcaaaaaaaaaaaaaagaaagaatagccagtgaagttgcagttttgaaaccagtctttggctgaatggatctgtcagaaaaaaattcattctgtcaggtttgaagattgaatattttgtaaggatactatttaatattagagtaacttttgtttctgttttaaagtattttcttgtttaacaaaaagaaatattctgtgtctattaactatagtgattttattagagatgatgatacctgatttttgttgtctattcagtgaggcccaatgaagaacaaactttaatatccattccctctttttttgttgctattaaaatattttttgtatactgtaaaattttctgtaatgcatttatttccataattttaaatctctctctagtttgaggcttatacaggtggttatctgttttcatggaataattcatattgatttctgtccctcatactgtaacagcattgagattcatgtgttcttatgtttggtcttatttacattgaagaaagactcctttatattttattataagataaaagcagcaggctacatgattagatataaaaaccttgattaataatcactgacctaagttccaagtaaaattggaggattagttaaattatatcactacacttcttgagtcctttaaatttgtctttgtgttttttcaacaaactttcaactggtagaaaatactgtgtaaattcacactaatatcttggaatctctaaatgccagagtagtcattcaggttttggtatgattacaaatctaacatttacacagctaacttggtttaaagtgtactagtctctcctttcttcattttctcctaatgactgtttcattgtatattggagctctttggccttttataattactgaatacttttcatctttacttcaaagccaaatcctattattttgccttccgtattaatcttttctttagtggtctatttatagtaggatagctaagaaaaaatagagaataaaagaaagaaatgacagcattattagcaagagcagtcttgaaaatgttctatataaaatgtttaatatgtgcacattatataccttagcaaatacataggtggcctggttgatgtcctttggatttcctcaaggaaatcattggtcatgatcagtagttttttttaaaagctgtcgaactattttttcaaaggaaatctcatctggaatctcaatattaaaataggagatgctgtgtttgcagattcagggtagaggtaacataggatatgtctctggtaggctggagccttaactcagccacacacttccttcccttctccttcccctttaataacttctggggcacaacagtcttaaaattaattttagtcctgttaccctttttcttctccatctgtaaattcttctctggtttaaaggaggtaaacttgttgccttctttactataattataatgcattcgtttgctttttggttggtttaatgaaaagacatttttgccaatggactgtcccatacctccacactgggaaattctgcctcagaggaaaaaggcttcacgaagtaatctatatgttaaacaacaaaactaagtaatctgtatgttaaacaacaaaacaaccttaaatatcctgaagtgcatatccagtgaagtatttaacgaatgttgtctcaaataagttttgaaaatttattgtatcttcccacctcatccctcttttggagatagccagtgcatgttagcattttgatggttctgagaagccttgcagtaaagaaatctaattttgtttaccccgtttgaactcacccctttttaccctcatttagaacatagtcttctcaacctaccattgaacactagttccttaggatatactttagaaaatggtacagaaccattttgaactttacattttattttgttttctagctagaaaatgctgtttccaatacaactgtttcagaattataacattttgtatgggtttttcccccctatttttgcctgttcaagagtacctagtcaagatttaagatggaattcgaataggatcctgccatgcttaaaaaattagtataacattaaaggattctgaaaaattatgttttcttcgcttttttatatataaattaagttaggaaggatatgaataaattattatttggggatcttttattttaacgtagacttggggttcttttgtttttgagatggagtctcgctgtgtcacccaaactggagtgcagtggtgtgatcttggctcactgcaacccctacctcctgtgttcaagcgagtcttgtgcttcagcctcccgagtagctggcactacaggcatgcaccaccatgcccggctaatttttatatttttagtagagtcagggtttcaccatgttggccaggctggtctagaactcctgacctcatatgatctgcccgcctcggcctccgaaagtgctgagattgcaggcatgagtcactgcacccggccgatttagggttctttaataaatgttaaaagaatttttaatgtagtgatatttttatttctaggaaaacagaagattgattattgtttgagtttggtaattttgacaatgaaacaaaagtagtaaactacctacccaaaattgctggtacatcagtctacctcctgagtagatggccagttagggtggatttctttaagacttctggtttgtgaaatgaaaacatactggcatttcattggacatattgagttttattcataaacagtaaaattctgaaatatttttgtatagtagattcatttagttagttcttgatgtaggatatcatagaaaaaataaagagcatttaggtcttagaatcatacagaactgaatttaatttgaatcctggctctgccacactggtagtgttaccttgagtaggttacttaatattcatgcatgtatttatcaagtaataactgtatgctaggggtggggtaagagggtgagatagggagaagatgtaacatctgtatttaaagaattcagatgctatgaacatttggtccaatttctctgaatctgttatcttgttggcaaaatggaggtgggagaactttaaatactcaagatggtacttagaggaacaatatgtgttcaataagaattaggctatgtattgttattcatatatttaattgtaggcccactcagagacatgaaaatacggattaaatcccttccttgttgggggaccatgatgcttttaagagatttattttaagttgtttagtaagattcattcattcattcagtcaaatattagtggagctcttgtgaagttcaggaatttttctggcaccagaggtgcttaccacgtttctagaatttgagggcctggtgccattgcctgtgcttttgctcttggttttaatttttgactaagcaggaaagtttgtcaaactccagaaaaattacttgtattagtctaatgaagatactttctatctgttataggaacacacatgtcatttggaaccagagccaccatctagagcagggatctgttaactttttttgtaaaaagccagatgcttgcgactttatgggccattccaactctgttgcagctactcagctctgccgttgtaatgtaaaagcagctatagacaatacctaaatgaaagagtgtggctgtgttccaataaaattttattaggaatactgaaacttgaatttcttgtaattctcacaccacaaaatattctttttgttttgaatttttaaaatttcaaacatttaaaagtgtgaaagctatggttcgatcatacagaacaggtgaccaaactgattaggcccataggccatagtttactgatccgttatctggggcataatctgtgaattggctataacggttggataataattgccaggcatttacgtggatggtcctttttagtagggattgtgtatatcagggtttgtgttctgccccttttttctcatccaagtttacttttatacactaagtatgtttgagtagtaggaaactaaggaaaaacttaataggaaaaaactcataggaaacactaaggtgatttttttccccctcatccagttaagcatttgaaggtcatcttttaaaggctaattattctaggatttttcatccacttcatgtcaaattctgtaactgaatatcagataatatgtacaaggtcttctctacttggaattttaaaatgtatacaataggaaattttatcttttaaataaattgtgtgtaaataacagtatattaacatctcttgagcactactgaatgctatttttttggtctcgaaacatggttttatgttgactgtgataattttgtatattaaaactgtcatttaaaaatctgttatcttgttttctgtagacaccggagaagaaacaatcggaatcatccaggggaagaaagagaaaagcagaaaaccagaatgaaagtagtcagggtaagcacataacatcttccttcagagcctagtggacacttaaaattaattgttttaatttttaaccaattaatactctaattgtaaaataatatgaagttgtaaattttggtgtgtgcacaggtagttagtgtataatgattgcttttaggcttttcaatgttgcccttattgttttcatttgggtcctagaaagacaagtatcatgtccaaatctggcaagcattaacttatgacttttcatttttcattctttatatgtattgtattgaaatggcttgtttttgaattaaaaacttcaatctcactttaacagaactactcaaacttttcccatttatttaaaaaaaaggctatcaaaataattatgagagactctagttaaagtattatctgtttttctttccatcctttcttgcatacctactttttgtgatatgaactaagaaaattattttcatttaactaaatatcttataatgaatagaaaaatagtgttgtcatttaatttgagcactcaaaattaaatataataaattgggctcttaaatcgtgtataatgatgactttatacataatgttacatgtgttggagccaatctttagccataagatctatggctgtgaacccatgacttactggtgtatatagggcactggaagcaaggaatgtatttgcagcaactgtctttatggaaggaagggtaagtcattttagtgccttttctgaggtgtattgtattttgtatctcagtttacactgagctcctttttggtcttagtgtagcctcccccaggttgtagttagtggacttggagctttatttattgtaaagatataaactcaaaaacaagcccccgaataagatgaggcttctggattggttgaaccatgtttttttcctttgtggtctgccatctacagatttgtctgattatctttgtttttaggatggttgcctaaattgttttttcttgtttcaccttcctcacttatatttgctttagtctggctttcagtgttttttccccccttcctttggagtaaacttgacttcaagtccaaagcagacctctcctctcatcttctgcagggttccccaacctcccggtcttccagtccttggcctattgggaaatgggtcgtacagcaggaggtgagcagcgggccagtgagcattaccgcctaagctcggcctcctgtcagatcagcggcagcgttagattctcataggagtgtgaaccttattgtgaactgcacatgcaagggatccaggttatgcactcccttatgagaatctaatgcctgatgatctgaggtggaaccgtttcatcccaaaaccatctcccctactccccgcagtctgtggataaattgtcttccacaaaactggtccctggtgccaaaaaggtggggaactactgatcttatggactagattggtcatatgtccattccaaaactagttaggaccaacagaggtactattgccttaaaaaaaatcaggccatctgtaggtggatagtgtcagaaatttaaaaaaagaaaaaaatcagggccatctttgaacctggaaatggaattaagttcttaaacatacagcctgtatggagaagggatgatacttgaacaaaattggatttctaataagaaggtgagaaggggacctggaagtggaagttgtataggagtcagcttcctctgaagttacatgtgccatgtagggtgaagggtgttaacagaacaaaatttccattcagttaaggaaagagaattggggaaatagcttctggagtaggcaaccaaaaccatctgtcttcattaaaatatagtacctctttagaatctacagagaaattattatggacagaagggaagtccctttagtataagacctttacagtcatctctgacctctaaataaatctgtgcagaactaatgttcaaaatttctaggtagcattggtagtcctgaatacttgtttagtttttaaaaattccccccaccttgttccaagaaggaatttaaagttgttaaacttttaagaatactgtttttcatcttagtaatgcctggcacatagtaaccacttaagaaatatttgttaaataaaataaatgaatcatgaaataagtcagcattgaattaacaaatatatgtatgtttatattaagcaaagcttttgactttgtgatatcactagttgtaacttgaagaaatcgtgtattctgtatagttccagtcaaggatggttacttctcccccaagaaagcatctctaaacattgtatttcttagcaagttcttaatttaaaacttacaggactgatgaagaatccattttagagcaaaatatttaaaaaatagcgtgatctctaatgagctggttcactttgtcagcgtggtcatatatgagcaatatttacaatctagtttttaaaaaacattgtatttaatttgggaatgctttttagaaaatcaaaatacattttacaaaataacattcctattgaagtgtgttactgtcagtttgacaggaatcatgttatggtttgtataactaaagctgttttattattatttacaagtaaaggttagtttgtcagtgatgcagtcgctacttttttatttactgatttgcttttctgaaattagtagttattaagcagtattaataatgtagttttaaaacaggacatcacttacatcatttatttgtaagattctccaataactggaacttttaaaaattggcatgtctctattgaaatgtcatttgattttcatatttgtgaaattgatagctgatgtcctgcggactcttaatatttttttgatgcccatcactaccctactaacatcatgcgcttcttatattttaggaaaaagtattgggggacgtggccacaaaattagcgactattttgaagtaagttcattgaggattgtctccatttcctaattcagtactattctgctgtgagctagaaataatttcttagaagcacaaggtcagcttttgattacttacttgattagagcagagctttattactatgtgatatctttctaggaaaattagatttacatttacattgggatgccatatcatttttttctaaatactttctcacatagttgtttataataacctgtaagataggcaaaatacatattagtgtttcagtttacagatgatgaaactgaagaccagaaatgtaaagtagcctacaccgtaattttttgaatttttgcagtcagaccgtggcagcagtgaccttgagcaataatagaacactaggcataaatgggttaacccatttaaggcaaagtctgaattgaagagtaaagaatagaagttaaagttcactggctctctagttgagaattctttctactatcaagtgtaattattaaaacaacaaacatggtctactcaattgaaaaatatttatgtttacttgagagagcagaattggctgattaagggaaggactgatttttttttccaccactgctttctttcttgggttcgtaaaatctaaagtaaagcagttgctgaccatgagatacctgatgctctttggttgaggtcagtcacttactgatatcattaattaagaacctttgccaaaggtacgatgaattcaaatcaacaaatgtctcttgaatgcctactatgtgctaaattttatgctaggctctattgataaaataaataaggcaaaatccctaggttgcaggaagttgtttaatgaacatgctgggaagttcctatctgtgctgttcatgtaagtaaagtaattaaacaagaaatgatgaaatggacaataatctacacccccagaggaactttgctgcagcaagttattttcttttcccatccttcgtatgtgaacttgaaataggagaaaagatagctatggaatagatcagttggcttctcttcatatgcagctaagtcatgcactttgtacagaagaattgattttttaaagattttgtgctgttagagggaagggacctattataattctttttatatagtgccatgaacacttgggtatcttgagaatgatattctgtttaaaatagttgattatgttcactaaggtctatgggtaaacattttgaaatttcttgggattagggactatatggctcaataaacatttgtaggggacctgtgctaagatttggggggaaaacaaaatatgtttattgctttggaggaatttatttgtctttgagttgaccaaaataacagatgatagtcagaatatagagtaataaggatctttataaaacagtctcgtcatgttcttgtgatcagtagtctcttagtcttttaggacttggctgaccttgtgttttttttttttgttctggacccatttaaatgactacttattttaaaattaggtatatttagattaattcttaatgtcatatctgaaataactgtctgagcctgctttagtaaataataatgcttcctttttcttttactcagtaccagggtggaaatggctcaagtccagtaagaggcatacctcctgcaatccgttctcctcaaaattcacattcacattccactccttcctcatctgtaagtcatctttcaagtttttcatgtgtagtctttgggagggttatgtacactgaataagttttataatttgttgttttttattgagaacttctatataaataagttagcatttatcttttaatacattatttctgtgacatgaattaaatccttttaagttatctggtgctattggaattttatttctggaagtgagcctcttaaagattttctgaattaattatatccaagaagcattgtttatgttaaaagaatgcctgttgagtctgtgggactaacatgagtactcttgtatcagtctgtattcagttgttgattcctaatttataactttcttaacaattgaatttcttaaccactaaaatgatagcataattcctttctgggaatccttaagaaaaaggcagggtatgtagttcagtataggaaaagaatcatggacttaaaattatcttaaactttttggttttttcataacattttagatatagttcttttatatgcattgttttgcatattggatttcatttttaaatttactttcattgtgtgaaagttcaatatctaactagaaaaacaatattggttttcagtaatttaaagaggaattaaagatttttaaaaatcagagtttcacttatttattcaaacatcttgtttttatgtcttgtgtccccttcttgtcctttgtctttagacatacttggttttgttttactcattttgtacctttcaggatatcacattgccgtgtataaaagtaaggcataagattcaacagtaactaagagttgtagtgatagcgctgatacaatgttataatctgctttcagtgagtgtctttttgaactagtgaccagataaactatgaaattcattgataaattgatattaaactacatatgggcgtgtattattgtccctagtaagtttgttttttcaactatcataatcattgtttaatatttttcagaataatttatttggccttattttttttttaactgtatgaaagcattaagatttcttttatggcactagaatgtaagctctatgagggcagggaatatattgttgtatttctcactgggtcttatgtaggaggtacttaatgaacacttgttgaataaatggtgattaaaggttttaaaagtcaattatgtttcaatttaggtattattctgatagaaacttcttcagaaatgttaagtaattgttgctaattagaaatctgttttgttttgtgttttttttttttttttttgctaatataaaaattttaataatttctttaggttcgaccgaatagcccttctcctactgcattagcatttggggaccaccctattgtacaaccaaagcaattatcctttaaaattattcaggtaaatgataattaaaatgtttttttctatggcttctaagaaaccattgactaacttactaacaactaagatgtctgtttgttttatatgtagtcataaagcagaattacacatcaagaaagataacttactaaacaaaaacaacagaatttgtaggaaggagtgagaaactgaaacacacaatttactatcagctttttaaacaaccgttaacatgtcagttctgtttactgattctttctgaacttaatttccaagtatatgtaattgatattttgtgaaactgctgtattttttagaagtggacattaaagcctctcatttgactgtatttattaaatacgtatatgtgacaaattataaacattatttgaattatttgtatattttctatacttatttagtttcatgaatttgagcactaagtttttcattttaattttttacatgtgacagtttctgagtggcactttctcagactggggtttgggagagtagatcttactcttcaagctcagcttgacagtttatttctattagactgtatttgtgaggtcatatccaaactgttgtgcatgtatcaaaacctctttctttggatgatcctgaggctaggattagaagtacattcctttcagccactgagtagatcatgaaaggttttgctgcatgagatgttggtcaaaggacataaaattttagttggaaagtaagttcaagggaactattatacatcataggggctacagttaaaaacaatattttgtgtatatgaaaattgctaagagagtagattttattcacaccacaaaaaaaagatatgtgttaaataacttgatttagccattccacattgtatatacatatatcaaaacatcgtgttgtgtaccataaatagataggtttttacttatcaatttaaaaaaggtcttgcaaaattcaaaaaaatcaactagaggaacgtatagcacaaagcagcggatatattgaattataatgaggaacatcagtattctaagtaattggcctttctagatgtttcttggtaagtctgtagcatttatacacttgaagttattaaaactgcactaaaactttttgagattcactttacatatacacacaaatatatttttctttaccttttgaatttggagtaaaatctagttttatgtttgcttgaaacaacatatataatggagataataaaataactttttttcatttagactgatctcacaatgctgaaattagcagcattagaaagtaataaaatccaggacctggaaaagaaggagggacgtatagatgatttgctcagggtaagtaatgagtcatagaggggaaaaaaattgaataaattatttggcaacagtcaaactgttcagaaaatacttagcattgtaaaaaaatctgtagctaggccaggcgcagtggctcatgcctgtaatcccagcactttgggaggtcgaggcgggcagatcacaaggttgagagatcaagagcatcctggccaacatggtgaaaccccgtttctactaaaaatacaaaaattggctgggcatggtggtgcgtgcctgtagtgccagctacttgggaggctgaggcagcagaaatgcttgaacccgggaggtggagattgcagtgagctgagatcacgtcactgtactccagcctggcgacagagtgagactctgtctcagaaaaaaaaaaaattctgtagctagaactcaataagctttttctgttagtttaagtacatgattgaaaaataccaattttaaagtgaaatattttattagatcttcaataaattgggaattgagaaactgttggagaactggaagttaataacatttatatgaccaactaccataacacaaatagccatttcatgttaaagtttattgattttattatatgcctgacatctgatacctatacgatgaagtaactgctgcagttctgtaggatttttaatggaagctttatttaaaaatacatctagaagtatacttaagaatgtaagggtttaaagcagcagttcttaccccttgatgctccttagactcaccagttgggaagggtgaaagtactaatgcctgaaactctaccctgaggggttctgatcaagttgatgatgatgtaggtcttggacattggtagttttaaaggctctcccagataactttaatttaagacagcattgagaactactggtgtagaaactcgataaaaccaacacctgtgatcctactgtatttgacagtgtctttaaaacatccagtgtgtctttttcctgatcctgtcatatttactttctcacacccatttaccatttaaccactattttaaattttgtatttgtgatgccttggtgtttctttatggttgtattaaatatgtgcttacattcttcacaacatattatttcagttggtttttgaacgttaagtgaaattttccagtatggacccttttgcccagcttgttttcaatgaaatatatcagagagtcatccactttgatgagtataactgtagtttgttcatttcattgcaatattgtaaggtgttacaagtataccataatttctgtatcttttctgcttttagttgacattttatttctactttttctagtataaacagttctaagaacattctttgtacatgtcttcagggcacatatgaaagaatttttctgtggtatatgtttaggaaagacatagccagagtacagggcatacgcattttccattttactgtataataccagttatttctcaaggttttttggtctggtcttttttttcccccgctaagtgacagggtctcactgtgtcgcccaggctagagcacagtgggggatcatagctcactgtagcctcaaactcccgggtttaagcaatatttctacctcaggctcccaagtagctaggactacaggctcatgccatcactccgggctgatttttttttattttgtagagctgggagtctacaggctggtattgaactcctggcctcaagtgatcctcccaccttggtctcccaaagtgctggggctataggcatgagccaccatgcccagctgatctttcaatataaattattagtcttactgaaattggttttgggtatggcatgatgtagggtttcatttcaatttctttctatatggataaccagttgttcatccccatttaattaaaagctcattcttatactgccagctctatcatcataaaatcttgtttccagtatacaggtggatctgtttctgtgttctgtatcatgtttccttgttctgtttgtgtctctacacaagtactgcagcatctttttatcattgttgataaaacaatttttatcagttgtttttggctgttagtaacagtgaacataaataacagtacttcagatgagatagaagcttatttttcaagagaagaacagaagtgggcagctcagatattattactcctcagtatcataagggaccttgtcattgttagttcatggcttatatctcaaaggtcacatcaaggttcaatatatctattagggtcacaattatatctgtgttctaagcagataacaggagggaggatgggagcagagaacacaaagcacaattctgtgtgcagccttcttggatatctcattgaacaacttctgcttgcatctcattaaccatccttcgctctaagggaagctgggaactgtagtcatttggctaggcagatagcaatccaggataaaacattgaatttccattattaaggaaggaggaggcttgggtgatcatagttatgtagctttatgttaagtcatgatacatggttaaacagatatcctcttcttctttttggctatttttggcccttcacagtcttagagaaattttagaatcaggtttcaagttgcatatgcatcatacacacacagtgttgagattttgtttgaattgctgagggtctattggtgctaaattctgtttcctcttccttgaaaaacaactgtgttgggtatctaattttaggttggcaattcttttctctcagcacttttaagattttgtgcccttgtcttgtggattccaccatggttggcctagacttttgattctcaaagtgtgatcttcagaccaggagcatcagtattactggagaacttattagaaacggaaattttcaggtccttcctgagacctgattcagaagctctgggaatggttcccagtaatctgttgtaacaagccctataggttattctcttgccactgtactaatcagactcatcttttgatgttagaaggaagcctcttctctgagcatatggccacctacaaagtgaacagaattagtatcctattgctaaggaagaatggtgaggacagttgttgggtaggcaacttgtgtatgtcatttataagttcagtggagaaaatattttgttagttataagagatagaggaaaacccacatttaatttgttaattataagagatagaggaaaactcacatttatttttaagtgatagacactttatataccatattttagttatttttaacaaagtgaggtagattgtgttgcttctatttagaaataagaaagctgaactaaagttcttataacttagccaaagttaaccttagagtatggatttgaatgtatggatatggatacaaatttccctgtatgtactttccactacacacttaagtaacatttaacagtattatctcatggttaagtaggctttttttttttctcgtatcatactcagatatttaatattattagtcctatctgtatataatttatttagaacattaaaactatttctaagcttttcatattccccagtctagacctcttgcattttctacttatgtcataggctaactgtgatctcagacggcaaatagatgaacaacaaaaattacttgaaaaatacaaagaacgattaaataagtgcatatcaatgagcaagaaacttcttattgaaaaggtaggctaaaagttgagtaaattttcgctttcccttcattagccccttttgctttgtatgcttttataaattaatgaatacaattgagtgatgattttttttctccttttcagagtacacaagaaaagctgtcaagcagagagaagagtatgcaagatcgattacgcctcgggcactttacaacagttagacatggcgcttcatttactgaacaatggacagatggttttgcatttcagaatcttgtgaagttagtcattcttaacatttaaaagtttttagtattcgtttgggttttcattactttaaaagattatagatttgtaattatgctctccagttcctcgctactctgaaatcatagaatttagtacctttgaaagggatatgaaaccaagagtattacagttttagcttagtaatttcttgattaattagcagtcatctatagaatgtaatatattattctaattctgactttccgagatattaattgaacctttagctttacagatgatgttttgagagggaaattgttgaaaatttaattttcactggaagatttgtgtgtgtgtttatttcctaggattttcctacttagttttttcccattccccaatccttacatgttaatgttcagcacttgcctgctctctattcctaagggaaaaaacttctcttttgcctcagatataataactgatttatcagttaaactgaacatgtggctttagcgtttctgaggtaaactctatttattatttatttattttaatttcaacttttattttagtttcagggaatatatatgcaggttgttacaggggtatattgcttgatactgaggttcggggtacaattgaacccaccactcaggtagtgagcatagtacccagtagtttttcaatccttgcccctgtctctgcctccttcatctttgtagcccccagtttctatcattctcatctttatgtccatgtgtctccaatgtttagctcccacttatacatgagaacatgcggtgtttggttttctgttacttttcagatcaaacttttaaacagaggaattatagttaccatattttcttgagttcagatggtggtagaaaaggatttattggctgtttatgtgttaaggagtgctaaatatgctactccgtttttggtggaaaatttttttaaacctgaaaatggggagtaatgccagcatgaacatcagcttttccagagtatccagttatttgaaatagaggcagaacttactttcacatggtatcacaccaacattgctgttcaaacactgcctcctaggacttgccacagaatggccttctctctcagcagatttattcaacttttcttcaacatatctgtgctagttataccacagtgaaacaaaggataatgtccttgtgatattagagagtttgggtttcaattctgcagataatgggacttgttaaaggtttacatatagtgtacgtgatcggaatgatatctacagtgatagttgtagaataataactgatggtaatgtgaaaatattattagaggatgaatgttattggtagttaagatggaggggtatccagatgaaaggtgattaaagcatgaactaacatatcaacagtaaagtggaaagcaggagaagataattttttagtgtttatgagcaagaggctctgctactaaacccagaccggcaattgtcctgcaatgaataaaagagacagttatataattaatatgaatgttctgaaatataaattctactagtagttccaatttctcctcttaactgtcagaaaagaggccacaggtgcagtggctcacgcctgtaatcccagcactttgggaggccgagttgggaggatcacctgaggttgagagtttgataccaacctggccagcagggtgaaaccctgtctctactgaaaatacaaaaattagccaggcatggtggtgggcgcctgtaatcccagctactcgggaggctgaggcacgagaattgcttgaacctgggaggtggaggctgcagtgagccgagatcatgccactgcactccagcctgggcgacagagtgagagtctgtctcaaaaaataatgtcaaaaaagaaaataattacttgtatgtcctgactttcactaataagcatttattgaggacctactgtgtgtatatcaagccgtttataattggtgatataatccagagtggttagaagatgagaagagaaataaataaaagtaataatattaatctctaaactgtatagtcatccctgagtaatcagctattaatatctattccagtaattctttactttccattaatattttaatcattaggattattattgcttatttgcatttataccatcttgattgtgccctaaaatagccttaagatttacttattaaaaattgaaatttattcctgcttctaaatgaaaaccggattaaagtcttgttctcactttgctattcttgagatttttctctaccctttcaatcttctacctagattcttcttgatttttttcactcctatcatattctgctactttatcactaaaaccatagggaaggggatgtgtgtaaggtcaattctgcattagcaaagtaggagccctttagttgatgtcagtggttggggagaggagggcatgaaatatttgacttgctctaagtattgtaaccatgtaggatttgaaaattttttattggcatagtgaggtgacctgaaagagaacatggttactgttagaataagcttaaggtgttgtatgataagttggttttaaaaagcttcactgttaactactttatgctctgctcaaactgctaaaatatctaatctacattttaataatagacatggtatctattcgtttttagaattagggagctatttgcaaaattgtttcagtttcttgaatgggaagcattgattttatttttgttactttcccatttttcagagccatgctaatttttcttgctattttcttgtctttttccccttaaattatcaaaaaaatttttctcataaatttcttatattaaggttaatttgtctcatttcaaaacaccaacttcccattaccaattttttttaacaaaagtagatttagaaaataactctcttcacattaaattcatatttgccttttgtaaatttgtttgcaaatactgtggtgagatgcatgtgtaacatataccccatactttaatagtttggggtattgttttatctcatttcattcaagaaacatttactgagcaaaggtaagtgatgatcactacactaggtactagggatacaacagtataaatactgtataaatagacaccatctgtgttcttagggagtgatgtcatctaaccggacactttctgataaagtatctataggaataatatttattagaaagagtgaggtggggagatagaagatcccatgaaattatatatggcaacacatctttccctaatctaggggtttagagaatacctcacttaaaaaaattctttcaaatgagacctgaaggataagtacaaattggttcacaagagtggaaccaaaaggttacgaatgtatattttatggtttttcatgttttttatgcattttttccaagtttagccttgaaaagtaatggaaggttaatatggttttatttgtttatttttacacaggcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgtaagcctccatttaaaatttttcttttttaaaattgttgccagtgagcgtgaatgttactaatggatgttatttataattaatacttagatagcaaaaatgattaagaccaggaaggaaggcagtattgaaaatttagctctaaattaatagccccaaatatctgaattctaccgttttaagcagagatttaacaattctcttttaaaacagagacctaggtagctaagaggttaccagaattcacccttctgtgtctgaatcagttaggaatcaattaaaagttttggattattctaattcaacgtttccattcacattcctttgtctgagagaatgaagtaatgtaactaccatttatatgttttctcagcctgtgaaagcagttcattagtgggttataggtattgtttttccctttctgcttttctttgttttctggattttctttgttaatgaattattctttataatttaaaggacaaagacattttttaaaagaaaatttggaaaataggacaagaataataatatagaccatgatcccatttcacagagaacaccattgttaaaatttcaatatacagatgtatccaaacttacataaattttctgttctagaagaacttacgtaaactcacgtgagtagaaaatacatagaccgggcacggtggctcatgcctgtaatcccagcactttgggaggccaaagtgggtggatcacgtgaggtcagtaaattctcagagagaaaccccgtctctactgaaaatacaaaaattagccgggcatggtgtcaggcacttgtaattccggctacgcaggaggctgaggcaggagaattgcttgaacttgagaggcggaggttgcagtgagccaagatcgtgccattgcactttagcctgggggacaagagtgagactttctcaaaaaaaaaaaaaaaaaaaagagaaaatacatgtaccctctaatgtcttgtatgtcatgtattcttttctcctctattgaaagattgtctgtcatccatgctttgaatcccatccacacctgtatcaggaacctcttctgttgatacctcctttgtgctctgcttgttacttcccttccaaaaacatgtaagcaaaaccattaaaaaactctccctcaattacaaatccctttagtctctatattctgtatgttctcttcataactaggcttcttcaaagagttgcctgtcctcgtagtctcttctgccttgtcttccagttgccctttcttaactgaaatttttcttaagattatcttcctgatgctaaatgctgtaacatttgggtctttaacttacgtagcagcactgaatattgttgacttatttttttccaaaaagactattttagttttgaagatactgaagtttccattttaactcatccggctgcatcttctcagtctctttctatgggcatcatttacttaccaatctgtaaaatgtagatgacttttagggatatgtcctaggccgtcacatttctcactctgcgtattctccttgagtagtatctactcttagggtttcggttaccgtatacatcctgctgacatcaaaattaccatctccagcccacttttctcttgagtatcggatacttctgtctcagtcttgaatatcacatcctgcttagttgctatcagtacttaaatgtctcacaggaacttctaatgcagcctgttcaaaactatatttactaaaaacaaataaaaccttgtatttactgttatctttccgattcagtctgtctttacacacacatactttgccccttttctgtgttctcttagtgagtggcactaccatcctctcacatgtaagaattctagttgtcacctttaacattttaagtacagattttatttatttttattttttattgttttgaagagatggagtctccccatgttgtccaggcttgtcttgaactcctgggctcaagctgtactctttgccttggtttcccaaagtgctgggatcacaggcatgagccactgcacccggccagattttgttgattttttcttaatccattagtaattagatggtgatagtattaatctttcaaagtccatctcaaaatgtactttcttcttaaagcctttcttaattttcttgagctgttgtaagttacaattaaaacattttgactatattaattttttaaaagaactgtactttttgtaagttagtaaatttgtttaagaaaaaaccaaaagccaggtgaatgactggcttggtgggtgattgtattaaaagaaagtgtgggctgggtgggatgtctcacactataatcccagtgctttggaaggctgcggtgggaggatcacttgagtccaggagtttgagaccagcctggccaacatagtgagaccttgtctctatttctttaaaagaaaaaaaaagcaaagtatgtgttagctttaactctaccctgtagatgcccagtcctgctagataccagatatgtccactcatcctttatgcaagttcccgctaacaccattcattctaactcaagttaatgctgtcttttacttgggtgatgtttataatctctccctcttcccgcttcaattttggtctcttcctgcagtctgttttcatgtcgtagagtcatttttctgaaataaaaatgtgatcctttcattctcttccctataaccctaacaaagctctccagtacttgaatgatctaacccaaaagtcctaatatggcttataaagcacttttgatctggctccttcttcgttatctagcctcattgttgccatcactcagtacttctacttcactgccaacattcagactctcacccattgtcttaatttctgttaatctgttaagtcccacggtagttatcgcttcctcctggaagcttttctttaatatatgaaagatgggagttatttattactttgaggtatcaccatagtaagtaccctctatctcttcagtcgcagcatcaatgtccactcaggtgatgacactaggaatctgcctgtcatcttaatgtttctctttccctcattctctgtgtctgtttccataacattttcatgtttgctccattcttcattttcacggtcactgtcttagtgtaggaccttggttttttttttaacctagattactatttttcatgtctcaccatgtttaacctctgtcagtggctttctagataaaattcacccacatgaagaccctttatgtaaaccttatttctcactttatcctcattctccagcatttgccctacatatatcttaagttaaactttttcaattctctaaatggactgtgctttcttgcttctgtgactttatcttgttccttacctttcttcatttgtctcatttcctgtttatcctttaagacttggcttaaatgctgtcttcaaaaggaagttctctctaacctttttttttttttaaccagtttctcctattgcctctcacactaggtgccatgatattttgtgcatacttgtatgtattgtagcatttatttcactgttttatctctgtagtcccaatgcctagcacagtgtttggtgtatggaaagtggtcaatactaaattacaatacacaagcatttaggctgggtgcagtgactcatgcctgtaatccactgttttggaaggccaaggtggaaagatcactgaggtcaagaatttgaaactagcctgggcaacagagcaagaccctatccttacaaaaataaaaaaaaaaattagccaagtgtggtggcatgtccctgtagtcccatctactcaggaggctgaggcaggaggatctcttgagcccaggagtttgattacagtgagctatgatcactccactgcactccagcctgggtgacagtgagacccggcctcaaagggaaaaaaataaaaaaaacacatttgatcgaatttcattttctttttgatagatcatctttctggtttgtcacaggtattttgtttactagttgtcttccaagatgctaacagctttaattatagtctaatagtcatagtcttctttcgtttctatcccattttattacatatgttgacctaaaactaactctgtggcaaatgaagtgatgggtactacatggcaatttgattgcattcttaaacaaattataggtttaaatagggcaaaaggccacagaagcactttgattcatatatactgcagtttgaataatgcttttttaacacaaaatgtcacatctctacttggcaaactatcttttaaaacttcttttgattcattgtttaatgaaaatggctttggcttgtgtgcagaatatctagtataattaggggacaagttatgaatctagttatcaattgtctatcaagaaattaacatagaaaatgaagttactattatgtagtacagtagtccccaaccttttggcaccagggaccagctttgtggaagacagtgttttcatgggctggggtgggggctgggggatggctttgggatgaaactgttccacctcagataatcaggcattgtattttcataagcagcatacaacctagatcccttgcatgcgcagttcacaatagggtttgtgctctatgagaatctaatgccactgctggtctgacaggaggtggatggagttcaggtggtaatgcctgctggcccgctgctcaccacctgttgtgcagcctaacaggccatggacggtacaggtctgtggcccaggggtggggaatccagatgtggtgggtaggactttaggttctgtagtcagacagatgtggattccaaatttaactctcccagattatttttagtaagttattttacttctttgaatctccattttcttgtgaaagtatctacattatactgttgaaaagatggtaggaggtaatgcatgtacttggcatggtttttagttcataatttatttttaactattagcaagagtcagttttttaggtaataacttgtaattttagttacaaggactttttattcagagtaaatagtttgggtagttaatactatctctagataaagtctgttgacacttacattgattttcctttactaatacattttaaccaagatttttacttaaaatatatttcaaattaagctttggttgtatctgttagacttacatgttgcatgtttcacagagggtgactgcaaagttaagaataagtaatattttacctcatatattattgaagttggacaggtcattgcttttccattatagctttaattttaaattaagaatatattttaggctgggcgtggtggctcaggcctgtaatcccagcactttgggaggctgagacgggaggatcacttgagcctaggagtttgagaccagcctgggcaacatagcaggaccccatgtttaccaaaaaataaaaaattagccagacatggtggtatgtacctatagtcccagcttctcaggaggctgaggtgggagaattgcttgagctggggaggtcaaggctgcagtgagctgtgattgcattactgcactccactccagcctcggcaacagaggaagaccctgtctcaaaaaaaaaaaaaaaaaaaaacaaaaaaggaatatattttgtataacattattagtagactacttatctctttttaaaattaatgaacttattttttagaggaggaggagggcagtagtacagcagaattgagcagaaagtacagagttcctatatacctaacccctgtccccacacggatacattctcttctactgtcaacatcccacaccacagtggcacatatgttacctgcatagacacatcgttgtcatccaaagttacattagagttcactgttgatgttgtacattctatgggttttgacaaatgtataactgatttttctaaaatcctgtctgaaaaatcttcctttcattggagaatttaatctgtttttcaattcatgcaattacttattgaggcttatctttatgcttctgtttatcctacctagtctccccctttttctttttttctcaccttttattgcattgaccagtttttgtttattttattctttttctctattacagtatgagcatgcttctatacacagacacacatatatacacacatctacctataggacatcattattgtcttgcatagtgagtgttcatatggactttatccacatatttatttattttttgctctttacttatttctacacctctcacaagatttttctgccaagaataccctttacaaattttcctttgtaaaggaaaattacaaaggggtctgttggtagtgaccagtttttgtttgtctgaaaattattttgccctctttggatatctttactggttttagaattttgggttggtagttacttgaagagatgatttttattgtcttctgatttacattattactattgacaaggtagctgatagtctttagagaaacaatcctgaatgcagcataagcagtatttggagatgagataactaagagtgtttcaaaaacagatgaacaagatcagtctacaggttcatgaaggccagcaaattccaggggatatgaataaaaagaaacactcattgaggttgggtgtggtggctcacacctgtaatcctgccactttaggaggccgaggtgggtggatcgcttgagctcaggagttgaagaccagccttgacaacatggcaaaaacccatctctactaaaaatgcaaaaattagccaggcatgggcctgtactcccagctacttgaggggctgaggtgggaggatcgcttgagcctgggaggccaaggctgcagtgagccatgtgcgtgccattgcactccagcctgggtgacagagtgagatctctgtctcaaaaaacaaaacaacaaaacaaaacaaagctcatctatacacatcatagtgaaatttcagaaaattaaggcaaagagaaaaaaattcttaagcagccagagggaaaaaagacatattgaaataacagtttagaaaagacaggcaaacaccacccaaaagaaagctatattaaatcagacatagtaaaatttaagacaaaaaaaattattagaaatgaagtggttgttataaaaggttgaaatcactaggaagctataataattctaaatttatataaatatgataacatggcctcaagataaataaaaaactaataataatagacagatccacaaatcatagtgggagatttaagcacatttcttagaaatagaacatgtagataaaaataaagcattacaaaacaaaacacacagtgcatgcaaaattaatgggattggcaaacttgaaccaatggacatatatagaatacctcccaacatctgcagaatacatgttcttttaaaaatattgactataaaaaaattggttataaagcaagcctcggcaaatttcacaggattgaaagtttatgtaagagtggtattctttctcccttagtcattggtagaactccaggatgaaaatgattgaaaccattatatatgttccctgaccacaatgcaattagctagaaatctgtaactaaaaggtagtggaaaagtgccaatggaaatgagagaaaattctgaaatgaaagatttcaaaatattttgaaatgaatgttagtgaaagtgctacataacaaaattggtaaaatgtatctgaaagagtatcgagagaaaattatagctttagttatgtatgtaagaaaagaagaaaaactaaaactttagaaactaatcatctatttcaataagttagaaagaaaatgagcaagagaattaaccaaagaagagggaaaagatagcagaaattaatataggaaacacacatacaatacagagaataaactagttttttaaaaatcgcgttaaaatttttgtaggggaaaaaacctgatacaattgatatgattgatttttaaaaaccacagctatccccaggaatgaaaaaaggaatattactactgtgtctagatatttaaaggaaacaacacattataaattgcttaaatttgaaatctttgtgaaattgacaaatttaaagaaaaatacagtggaaccaaaactgacagtagaagaaacaaaatccacatagttctgtaactattaaataaagtgaatctgtaatttaaacatttattcagagaaaaactgcaggtccaaataaccgcatctaagaattctatcagccatttaaggatgaaatagtgccagtcttttacaaacttttttgaagaacagaaaaggtagatatgcttcccacttattttctgaggccgacataatcttgatgtcaaaactcaacaaagattgtacaagaatgacagttacaggcaaatctcacttgtgaaaataaatgcacaaatcttaaaatagtaacacaaacacaacatataatatataaaaatgctaatttatgaagaccaagttgggtttatgttggatgtgcaaggttggttatagatcagaaaaatatatataacttttcacataaatagaaaaatcatatgactatcttaatagatacgaaaaattttaaaaaattagataaaattcaacattgatctgtgactaaaactcttagcaaacaagcagaagatacttccttaatctgcagtttgctttcctttttacttttgcttgagtatctccatgctgtactcttgggtcatcatgcctctgtttttttttttttttgagacggagtttcactcttgttgcccaggctggagtacaatggcacgaccttggctcactgtaacctccgcctcctgggttcaagtgattctcctgcctcagcctcccgagtagctgggactacagccatgcgccactatgcctggctaattttgtatttttagtagagatggggtttctccatgttggtcaggctggtcttgaactcccgacctcaggtgatctgcccacctcagcctcccaaagtgcttggattacaagcgtgagccaacgtgccaggcccatcatgcttcttaataccctatttcttcttcctggcctcctgctgttgcttctttttaatttagttcagatattaccttttctgtgactttgactagtttcctgcagatagaatgtattttttttctttgctctgtgtattcatagctgtattataaaaagtaattatcttaaaatcagctgatgagcaaccttgatcccatttaaatctagccttttttaaagactaggatatggcattttgggaaaaccattattctgtttactgacccccaaagattcacatcctttccacatgcagagtacattcaccctatctcaacatccccattacagtgtcagcacaaagtctgacatcacatctaaatcccataagctcaaagttcaattctcatcaaataaatgagatatgagtgagacttggggtataatccaccctgagacacagtttttcttcatctgtgaaactgaaactcgagaagcaagttacctcctcccacagtacgatggaggaaccaggtatctgatgacagtttagagacatttctgttcaaaacaaaaagcagtggaagcaaattcctgcagaatttcaaaatccattcaaactccatttggattcaaggtctgggaataatcttttatgatgatcttctgtgcttctgccttttgggcacaggtttctgtcctctaggttatcctttctttttgatgaagtttagcctgctaacaatctgtttaaactttttagaaattatgctttttttggggggggagacagagtctcgctctgggttcaagtgattctcctgcctcagcctcccaaatagctggggtttacaggtgcccaccaccatgccaggctaatttttgtatttttaatagaaacagggtttcaccatgctggtcaggctggtctcgaactcctgacctcaagcagttcacccgccttggcctcccaaagtgctgggattgcaggcgtgagccactgtgtccagccttcagaaattatgcttcttaaaattctagcctctgtcccctgcccagttccaaagccacttccatgtttttaggtatttattaaaggcgcattctacttccaggtaagaagatctgcagtaatttcttatggctgctgtaacaaatcacacaaacctagctttaaccaacacaaatattaccttaccgttttagcgatcacggacctgaaatgggtttcatttgggctaaaatcaaattgttaacagggctatgttacttctagagactctagaagagaatccatttcctttctttttccagcttctagaagctgcccacattttttggtttatgatccccttccgtcttcatagccagcagcggccagtcaagtgtctcacctgtcacattactctgattctgacactgcctccccttccctctgggcacacatgggtaatgcagaataactccctgttttactgtcagctgataagcaaccttaatttcacctgctacccttaattttccttttctttataacctaatacattgacatgtctcaaggattaggatatggaagtctttggccattattttgcatatcacagtagtacttggtatgtaagtcattgtattagtttgctttcacgctgctgataaagacatacccgagactgggcaagttacaaaagaaagaggtttaatggacttaacagttccgcgtggttggggaggcctcataatcattgcagaaggtgaaaggcacatctcacatggtggcagacaagagaagagtgcttgtgtaggggaactcccccaacccccttttttttttttgagacggagttttgctcttgtgcccaggctggagtacagtgtcaagatctcggctcaccgcaacctccgcctcctgggttcaagcaattctccttcctcagcctcctgagtagctgggattacaggtgcctgccaccacgcctggctaattttttgtatttttagtagagacgaggtttcaccatgttgggcaggttggtctggaactcctgacctcaggtgatccaccctcctcggcttcccaaagtgctgggattacgggcatgagccaccaagcccagctggaacctcccctttttaaagccatcagatcttgtgagactcactcactatcatgagaacagcatgggaaagacctgcccccatgattcagttacctcccaccaggtccctcccacaacacgtgggaattcaagatgagatttgggtggggacacagccaaaccatatcagccattatacttatactaagtataagtaattgcacttcaatttctattacattgtgaacgtttggactcttcaaaggaagactagtttcatccctcccacaatcacctattttttttcctagtgataacattttttaattgaggttaaatttatgtaacatacgaataaccatttaaagatgtacagttcagtggcttttagtccattcacagtgttatgtaccatcacttctctctagtttcaaaactgtttccttaacccagaggaacactgtgcacgttaagtaatcactccctagccctttctcttctcacctccagtagcaaataatcggttttctttctctgtgtatttgcttcttctgaatgttgtatataaaatgactcataccttatatgaccttttgtgtctggcttttacttagtataagttttcaaaatatattcatgttgtagcatgtatcagtacttcattctttttatggctgaacaatatttcattgtgtgattatgcacaatttgttcattcattcattgatggacatttaggttgtttccaccctttggttattataaatagttctgctataaacacctgtctacaattctgtgtgagcttgttttgttttctttatctgtctagtactgagtattatggtaattctgtatcttaacttgttcaagaactgcttattttccattctgcaccgttttacattcccatcagcatgacaattatccctatttttctacatccttgacaatactttttactttgccattttaaaaatcataaccatcctagtgggtgtaaagtgatatctcacggtaattttgatttgcatttccctaatgacttaatgttgttgaacatcttttaatgtgtttgctggtctttatatatcttgtttggagaaatgtctattcaagtcttttgctcattttttcaccagactgtttgttgttttgttgttgtgggaggtttttttttttttttaaaaaatctggatactaaacccttaacatatatgatttgcagatattttctgctattctgtaagttgtcttttacttttttgataatatcctttgatgtacagaagttttttatttttatgggtacatagtattaggttggtgcaaaagtaattgtggtgtttgcctactttcagtggcaaaaaccgcaattacttttgcaccaaccaatgtacagggtacatgatatattatgatacaggcatacaatgtgtaataatcacatcagggtaaatggggtatccatgacctcaagcatttatcatttctttgttataaacattccaattatactcttggttattttaaatgtacaatatatttttgttgactgttgtcatcctcttgtgttaccaaatactagatcttattcattctatgtttttgcacccattaaccaaccccaccttttgcccccttccccactgtccttcccagcctctagtaaccatcatcctactctctatctccatgaattcagttgttttaatttttaatgtttttaatttttatgaaatgtattttgttgatttttgttactgttgttgtttatgcttttggtgacaaatctaagaatttattgccaaatttgtagtcatgaagatttacccctgtgttatcttccctttgttttgttttgttttgttttgagacagggtcttgctctgtcacccaggctgaagtgcagtggtgcgatctcagctcactgcaacctctgcctcccaggtttaagcgattctcctttctcaacctcccaagtatctgggattgcaggtgcccatcaccacgcctggctaatttttgtatttttagtagacagagtttcaccatgttgcccaggctggttttgaactcctggcctcaagtgatccacctgcctcagcttccgaaagtgctggcattacaggcatgagccaccatacccagcctcctgtattgtcttctaatagttttagttactatatttaggtcattcattcatttttagttaatttttgtacatagagtgaggtaggggtcctacttcattattttgcatgtggttccctagttgtcccagcatcatttgttgaagagattattctttcctcattgagtggtcttggtactcttgtcaaaaatcaactggccgtagatttttgggtttatttctgaattcagatctatttcataggtatatatgtgtattcttatggcagtaccatactttttgaaagtctccaatctgtggacataggatatcttttcatttaattaactctttttgaactccttagcaatattttgtagtttttagtaggcaagtctttcacctcctgggttaaatttattcctaggtattatattcttttggatgctattgtaaatgtaatagcttccttaatatccttttcaggttgttcattgctggtgtatagaagtaactgatttttgtgcattgctctcataccctgcagctttgccaaatttatttattgttctagtgattttttttcttgtgcattttttggggattttctaaatatagaggcatgtcatctgcaaatatagatagttttatttcttagcttacaatttagatgcattttatttcttttccttacctgactgctctggtaggacttccagtgcaatactgattagcaatcatgaaagtagacgtccttgtctttttcctggtattaggagaaaatctttccattttcaccattaactatgatgttagtttgcctgggttgttgttgccttttgttgttgttgttgttgttcttttcttttcttgctctgttgcccaggctggagtacagtggcagtctcagctcactgcaacctctgcctcccaggttgaagtgattctcatgcctcggcctcctgagtagctgggactacaggcgtgcaccaccacatctggctaatttttgtttaagtgcctctaacagtctatttaccatagtttgtgttctttgaggcttcatgttaattctctgcttaaacagaatgtctttaagacattgaataccaaatttgtttaaaatgaatatccctgtttttgttatttctactaactttttaaaatactgtcaccccatatttctgttaaactattttagaacacttttaaaattaaaattttcatttactcagacttagtgtggaagattatcaggagtcaagtcttatgtttggggtttaaatttgttaacgtttaaaatattatgtgtgcataataaaaataatacattgttatgtgtgcataataaaatatttttatgtttgtgtaataaaaatattaataatttagctatcatcagatatgagtctatgggaagagatggattatatctttgccttatctatgaataaaagatttgctaagtaatttaactgaattgtttgagagggcaggttcttttaaaagcatcttacacacataaaagtattgataattaaaagccactgatgtgaacattatcctagcttagctcttttcattctgtctaaaatcctgtttctttaaagaagattgttcccagttgcttttatctaaatacatagatttctttaaaaacgtttttgattaatacaaatggacaacagaggttatcgaagaagctacaatgtgtcaggtattaataatccctaatacttcctagtaggaagagggagagaaaatgtaagaaatggctcttttgtcatttgggggtttgcattctaattggcaagacaagacccaggcagaggaactcttactgagatttgtgaatcccaaaattatatatatgtaaaattttctggggagagtatttataacttccttcagattttttttttttttatgattgtaaaatggtaagaatcactgccctgaaaagtgagtagcctaacaacacacaacaacaaaatagcgtttctcctaaattgcacagagtctagccatgtgcatgtgtaggagctttgcagttatacatgatagccaaacctcttggtaggacaaaaatttcaagtaactcaagtcatgtactaactttggtttaagatatgccaaattttagctgttttgtaattcagtaaaaatcaaagtacagaatttctatatagaaagaaaacaaatttaaatatcttttaaaaattagttatgagcccatactatggcctactagtggaccttaaaccatactttaagaatatgaatttatgatactgttatataatagcagtatcataggcaaacttccaccagtggcataaacctgtacccatatccagaagctttttgctaacattcctacatcttttcttttctagattagttgagatattatacattttagttttcaaacctcattttctttagtatcacattcctcctcctccctctctcacttcatctacattcacactccagcatttaattctctaaatttactataagcaactgctacagctatcaactattgctatattcagtgtaataaaatccagtagttgtgtcaccctaagactaggtagagaagtttaatttaacatgttaatttttttggctcttaagatgttgcgggtggaatactaactgaatttcttgtttttgtttatttcctttgaatactccttttttagaattagttaatttaattagcatctagctaaagggaaatggcatttatactaaatgttgctgagggactgaaaccaaacagatcacacctgagttaggagcttaatgaaataacctcagaacacataagtaaattaacaaacaagggcttgaatatgatagataagagctattcttttaaagttggggtatgggccggttgtggtggctcacacttgtaatcccagcactttgggaggctgaggtcggtggatcacttgaagccaggcattcaagaccagcctggccaacatggcaaaactccgtctctactaaaaatgcaaaacttagctaggcatggtggcgtgtgcctgtagtcgcagctactctggaggctgaggtaggagaatcacttgaatttgggaggtggaggtgcagtgagctgagatcgtggccactgcactccagcctgggcaacagagcgagaccctaataagccttgttgtagttctgcatacattaaactgattacttttcaaagtcaggtaataatatttgaaataataagataaccatgaagcactttcaagacttaaagtcctgtatctatttataattaagattttgaagtagctaggcatggtggcgtacacctgtactcccagctacttggaacactgaggcaggagagtcacctgagcccaggagttcaaattcaacctggacactaaagcaagaccctatgtctatatttggagtataagaatttagtgcttttttgggggtgagggagattgagacggggttttgctatgttgcccaggctgttctggaattcctgggctccagtgatccacctgcctcagcctcccagagtgctgggattacaggcgtgagccactgtacctggccagaatttagtactttgactaaagttttagcatttttttatcttgcttatttactcccaacacactgaagcagggaaaggaaaaatgtctttgtttttttcctctttttaaaaactgcccaaactggactgactccctttgcagtgatttcccattactcttagagtaaaactgaaattcttgacttggcctgcaaatctatacatagtatgtctccccagcttgcttctcctactactcacaacccttttgactacatctgatttactcccatttttttctcttctatttatatgccaagactattttcatcttagagttttgaactttctataactcatgtctagaatatactccccagagtcctctcatggttgtctttttgttatttagatggtcacctctctaacacccagtccaaattaacataatgcaattagtcattaccataccatccttttttgccttcttcatgacacttactgttacttaaacttatttatttcatcacgtggttttttttatgcttgcttacttccactatagagtgtacgctcaaactaatatgtaaggagaaattgttttgtttttcactgtatccttagaatataaattctagaacatcacttgataaatggtactcattaaaacattgtagaattagttaactgtttcatctaaaagtattaaatatattctgaagaatatctcaaaggatttttggctcatacattttccttaaagcattgtagaattagttaactgtttcatctaaaagtattaaatatattctgaagaatatctcaaaggatttttggctcatacattttgggcttaaagttgtccacattttagtatttccacttgatttttatattttgctagttgttaataaactaagtattaatctcaatatgtagaattaaaatttcatttttgacaggttgactttggcagaatatcatgaacaggaagaaattttcaaacttagactaggacatctcaaaaaggtatgtgaaacatatgctgcatttttagttcaatttgctaccagaatttgtgggaagttgtgttataagtcacttattttaaaagccaaaatttaagagagtaagatttcaaattaaaaatttcagattaaaaagagatgcattaaagttactttattttatttattagtatttttattttttgaaacagtctcatcactcaggctggagtgcagcggcacaatctaagctcagtgcaacctccacctccctggttcaagcaattttcgtgcttcagcctcctgagtagctgggattacaggcatgcgccaccacatctggctaatttttgtatttttagtagagtgagggtttcgccatgttcaccaggctggtctcaaactcctggcttcgtgtgatccacccaccttggcctcccaaggtgctgggattacaggcatgagctgtcgcacccggccaaaattacatttttatgttgagtatattaaaacaacattcctttatcttgtgtcaacttaaaaatcttgagatggtgacacaccatatccctttagtggaggaatgattcttggacagacttccaaggtctttagattattctatttaagtactaccttttggtaaaaaatacttcattttaaagatgaaatctaaaattccatattgtttatgttcatttcataataaaatagcaattgtaaataaatagcaaacttatttctttggcttatcttttaatttgttgcatgtgtgatgtttcgattagaagatgtacgtaggaaaaagcacttagtgatagtataaagggataaaactgagaaaaaatgttgctatgtgttattgtcgtaaacttttaaataatgtgtatctttctacttgtttgtaaactctgaaattgtaatcagtttattgtttttacaggtcttaattttagttcaaatgatttcagagaagtagtaataatagagtaggtttttttccctcaaaattaagttactgacagacataaagttctttttctttgacccaattttttgtgctttctgcttgtcaggttctttcaattttttaaataggctgaattataggtaaaattgaaggagtgaactaattggagatagtatctgtgaagttgtctccatgggatagggtgaggtaggatggagaaacccattctggtagcagctactattacactgcatactaatttgttttggaaatgttattaatatgctggggattcctaccatttatagggaatagaaaattattatatataatttgcattagtatcctttaatatgctatatctgtctatgccaactgcccagaaagcttcaacgtaaactacttgaacagtgaattaaaaagtgatttattttggttttgttatttaagtagttctattctgttctattgtaattattgactacttttcctgcgctttgagacttagttgacaacttaagtctattctctataataatagatggagctatataactatcataatagttctataatagtgatagaaccatataaaggaactatggaagcgaaaagggaatttttagtacaggatgagtcgtaagtatctgtgtgcccacttaaactgttttgataatgagttcgtaagggcctatgctttatgtctcatataaagatttaccagttattttctaaccagcctgtggtgataaaggaatacttatttacttagttatagtgattccaaggtgtacttgagagttttactgaagggttattatcttcacgtgtaataccaaatttcagattactctttctaaatgatgacattttacatatgcaccttattttatgaaaatctgttataaaatctgaaattgtagagcagttaaattaggaattggctatttgtattacaaaaagtacactttgaaaaggcttcaaaggagggtttgtttttgtttttggttggttggttttaaagctttcctggtactttgaaaatactggtttctgtgaaaaacacttttataaagtaaggtatacttagtgtccaaatattatatagacatttgtaaaatgttgtagaacactaaaccttctaaccttcgtattttcctctttcccagtgtttgacttctatatttttcgtatttacttactctttccaataattatcccttccataatctttttcctgctttttttcctagcttttatcaaatttactgagcagtcttagatttctaactttatcttctttttaactaatttacaacataacttttcttttctttgaccttcatcatggaatattttggggaaatggattaacagtaatgctgaaacatactctcatgtcatgaatacccatgttttcttctgagagactattttgggtgagaagaatgagtgtattataaagaaagtggccagtagtacatacagggaacaaaattaagcaagtaatgtcaccttagagcataaatagcagttgcctgcttagaaccgagtattaatttttgagttatacagttaaaaaataataagcaataagttacatgtataaaaataagttatttggcattctgaagcacagttggaaaataggtcattctgttttctaaaaaagattaaacagatttttaaaacacaggacaggcttgagtcaaaagaaaagatgttatcacttctgtcttatcagctccctatgctcctgggtttattaagcagacatgaaccccgacttgtaaatatacagcttctaccataggctggatctgaatatttgacgccccttgtatcctgcacaggaaatataaccagtcagtttacggtttagatttggagcctggcatactcttgcattagcatgggtgactctcttgccctttctcccttcaataaattcttaacattaagcagaactaattattagactaactttcttagcactgaaggaccaaagttcattgaggaagcccatggcatatggacataggagaatagaaagacctgtttactttttcttgaagtggataatttatgacatgctttgtgtttcataatgataatcactataattgaaaagctaaactaaaatatgaaaaagtatatttacctttgaataaatcatgaagtttagttcatattttatgctgttcttcagggttagaaaaataataaatccaaagatagccttactctattatccaatgtgtgatagagtaaggaatgagagtcaggcagaaacctccaaaagtaaatacatggctaaaataaataggtgtttctagttactaccaaaaagtaaatgtaaacttacttatggacttattagttttctcttctgagattaggaaaatcacagcagagcgtcactttttttcctctcaactgtatcaagaattcttttatctaatatttattgttatagttgttcccaagtttaagcagtcgttgctcacccatttattaagtgacttattgccatactctgcctgacacaggcataattcaaattcccattttaacggaattacatattactttttatagactttgaagctttcaccatttttgagtgaacattaattacacctttttgaaagcccagatctatatatacttcctctggagtaataccaccagtaagtgacaaagccaaaacttgaaccattcccactcctatttcaatgactgtacccatgtagttaattcctagaattattttgttgtagattaatagtaagttgattctttgtattcagaaaaattaattcacttgtggctttccttgcatctctattaagtactggactgtttgcttttccttaagttttcttttggtgtgtggcgggatgaacgtgctatttcattttcattacagataaaggagaacagttttaagttaattatttttcatacacattctttttcattctctttcacatactttcttccttgggcattatgttagtgactgttgaatcaactacaatatttctttattattaactaatatattgattttcactcgatttatttttaaaggtcaacaaagacctttttaaaaagcacatttttaaataaaaactcaaataattttaaaatatatcttaaggaattcttagaatagaactatatagtaaaatgtatggagactatacaaattattcctgaaactatttcaaaaggaacaagtaacttttttggttatcattaattatatacaaacttccccagttattacttaataaaagcttgtagttgtaaagagattaatttcctatctttaaaaagttgttaatttgaggcaaagcttctaaatgatcctattttatctacctgtgcccatgtggaatcgtgggttcaaggaaaccaaccaaaaaccagtttgctcttatagttgatcaggttttgatacctgtctctgataagttctaattatgggaaaacaatttatctttgtgattcagaagctctgctaggttgattatatagtcagatctttattctggagttgaagaagatggtgtggatttgctttcaaggattgtcactaaattaacacataaaactaaaaatacaatccctgcaaaatcaacttccttgaaatgtctatatttttaaaaagatacaagttattagtcataataccccaaactgatgagtaaatgagaattttgaaagttattaggtccagtaactatgtcttgagactgctgttactcaaatttgtgatatgaacagcatgtgggtatgttactctttattttcttgtcttcagatttttttgtcttcttgattttaaatatttgattagttggagagaatgtgtttagaaagtgtgacatctcagtatggagtattaaatagtgtagtagggattggctttaatgtgtgtgttttggtgtgtgtgtgtgtgtgtgtgtgtatgtgtgagtgcatttgacttatgagccctgaatataagtgccagaagttttatttgaaaaacataaccaatttgtaattgaaacaggattagtcaagaaccatcagcaccaacacaaatgtatctttgcagaccgaaggaatcagctaaacaatttacagtcatctcaatctctactaaaacaaaaatcacatccaacatgccacctgacaccatttctttctctctctctcctttgctccttgcgatgtggcattcatctctccttgtgcctccgttctgaagagataacagtatagcaacaactctgccactgaaatcctgttctctgaccgatattggcacctgcaaagagaaacaaccagtaacaggcagcagcagcatcagtattaatcttccatgatgaaatctttacaggtcaagaacaagtacacagctcttttctcactccttcacagtggaccatgcaactagttgaaatggaagacaatggattgtctacaagccttttgaacagtggagaatgcagggcgttggctttaggtgaattgacccccaaatattcttgaagtttgatgtcccctttggtctttttttctagaacaccattgtcatctgacttatcaaacccttagtatgaccacaaagaataagtttgcatatgtgacattttttgtcactttaggtttgaatgaaaatatgaaaataatgagcattataatgctagagggcttaatctttaaacctgttgttcatctttatatttatagccatgactggaagaaatcttctaggaattctctcaattaaagccaactacattgtacatgatgtttctgtagaacctgacacaagatgctgcttgtgtaggcagtagttttcagtggaattctgggaaaagtatactatactggaaaaagtcgtgattaagcccatgaagaatgttaaaagattcctgatttcttggagggaggtgtgtgtgtgtgtatgtgcaagaaaggtgccaagaagagtgctggaattctaactttacaatttgtgcttactactattttccatttaaaaatgagtagttgtcccaaaaagatgactgtggtgagagaacatggaactagctgtagatgggaaaactcagtgtttacgttcttatctcttactcacatatggacctgcaaactatcctggctctatttttccatatttataatcacacaaccttaacttggtagtagataatgttcagctaccaaaatgaaaatgtagaggtaaaaggtgttttacttccccagtgtgtgtgtgtgtgtgtgtgtgtgtgtgtgtgtgtgtgtttttcgcccaggctggagtgtggtggcatgatcccggctcactgcagcctccgcttcccaggttcaatcgattctcctgcctcagcctcctgagtagctgggattacaggcatgtgccaccatgcctggctaatttttatatatattttttagtagaaacggggtttcaccatgttggtcaggctggtgtcgaactcctgaccttgtgatccacccacctcagcctcccaaagtgctgggattacaggcgtgagccaccgtgcctgatccacagtgtttaatattaatcctgttgttatacaggcaatggaatttaaaacattttgggaagaatcttagaagtcatgttagccatcagcagggtttgtaactaattcagatttgtaaattcagttcagagataactttcacaaaaaagagaaaacagttgcttggctaccagcccttcccaatcataactgtaaatccatgccatatgcataatgagcatgtagaagactaggtttaaaaggaagcagaggccaggcatggtgactcatgcctgtaatcccagcactttgggaggcagaggccagaggattgcttcagcccaggagttggaaatcttgtctctaccaaaaaaaaaaaaaaaaaaaaaaaaaaaaaaaaaaaaagtcggggcgggaaagcaggaaagaaaactgggagaaggactgcagtacactacacgaaggcattgcacctgtgtgtgatcaggcttggtgtcagccccttggttagtgttgaacgttaatttcactcctataatacagcagctgtaaatatttttaagacaagtgtgccagatatttaaattttgccaatcagttgaattcttaaacatttatttgatgctggggaggtagtttttgttttgttttgttataataaagtagaggaactgacagaattaaaacctgcctgttttaacagtcattccaagttacgggtattaatgcatgtatttatgcatttgaagggagagtaaaccattacccctccacacacccccagaaaaacaggaaatgaagtgtgtagagagcaaaacattgagtaaaggtactaagttaattatctaagctagttgaacacacctgaggtgatacagtatgctctcatcagtaataagccactttagtaattggggataggggtggagggaacatttatataattaggaaagaaagcccccaatatttaatgatttttatcttttctccttctcctacccttctccccaatctacacaattattctcaagcaaaaatatgattatggtgcaatagtttcaaaagtcagacctgctttgtctaggtggttattttggttggttggttggttggttggttggctggcttttattttggttggttcatatctcacacattcatatttagaatatgggaaagcatataatatggtgacataataaggataaattcgaaataaattagtaattttctccttaattgtttttttgcactgcccttccttttaattagctttttttttctttttttctttttttttttagacagtctcgctgtgtcaccaaggctggagtgcagtggtgcaatctgggcccactgcaacctccgactcctgggttcaagcgattcacctgcctcagcctctcaagtagctgggactacaggctcctgccaccatgcccggctaatttatatatttttagtagagacggggtttcactgtgttggccaggctggtctcaaactcctgacctcatgatccacccacctcagcctcctgaagtgctgggattataggcatgagccaccgcacctggcccttaattagattttaatagtgccttttgttgatttcacctttccctttcttggtggtaaactttcagaatggcattataaatcgtttgtgaaattaaaatttaatttttttaggacttagagatgttaacttttaagggattgatattattcacattactaaagtgaatttggtgttaaattttttttttttttttctgagacggagtcttactctgtcacccaggctggctagagtgcagtagtgtgatcttggctcgctgcaacctcagtttcctgggttcaagtgattctcgtgcctcatcctcccgagtagctggggttataggcgagcaccaccacgtctggcttatctttgtatttttagtagataaaggattttgccatgttggccaggctggtctcgaactcctgacctcaggtgatccaccggccttggcttcccaaagtgctgggattataagtgtgagccacctcacctggctggtgttaaaacctcattctgaaccggttttcttaatcaagtagtgttgttacggtgaatagactgttccaagccatattcttctaccaactcccataggttataggcacgctgagaataatacatcaaaatacttcctgttttatcttggctttatgcgaggcagttcttagaaattgagttttttgatagagagaatatgtaacatatattcaggatttgctaaataactttaaactagcaagtttaattttttcaggaaatgtattggttttacatataaaaatgtattttataactttttaagccttatagttttaatgcctaccatatttcaccttttaataattgccttttgaaaaaaatgccattatgagaaatgctccaaaatactccagattcacctaccattttcttttctttttaaaaaacatctccttcacatgggaaccacctatcatttttaacctggaattttacagaaattctacattgctacagcctacatttggcttatagacttgagccaaaggaatattatgttgccataagagactttgattacaaatagaaagcatttctatgctgaagatctggtgagggacaaagtcttttagtgaagttgctgtgggagttatccatacacattttttttttttaattttaactgttagaaggtggtgttttttgcaagttacttaaacaatgagacagtgttgagatctgttgtatacctgtctgacttggctttttatgtgagtattagattttattttaaaatactgttaaaatagctatagtgtgtattgttaaattttccattgtagtttttgtttgaacagaaaagagccatgtccttttattgtgtatttaattgccaaacttacctctctctttaatacagtctgttcttacttatgtctcttcttcattgtaatagcctacagagaccagttcatttctggagatgctgtttgtctctttgtttcttttagattttctctgctttcattaactgctcagctagtgtatgaattcaggactgaaacttggtgttcttactaagcacaacttagctgattggattgtctcctttcagtctactcgtctggcctagttttgctatgagtttgaggattctattctgtggtgaattcagatcaattgtgagcctagttaatcctgtcttctcctgaacccttggaaaaagattatttctgaggatggcccacaggttaatgtcagtctcaggcaaggagaatgtagcctactggatagatctttggaaatgatctgtagcaaagataagttgttcaaactattgtaccctgggccaaaccaaaactgggccttgccccattctctgaggacaaggtgctagacagtattgccctagcatttatctacaagtatgtgtgttggccataacaaaatatcagactgggcacctaaacaacagaaatgtattctagaagtccatgacaagatcaggcagagtttagttttgggtaagggctctcttgctggcttgcagatagccaccctctcactttatcctaacatggccttttctctgtgctccttggagggaggggtgggggaacctttcttctcataaggccactaatcccatcatgaaggctccataacctaatccaaccctaagtacctcccaaaggcctcatcttcaaatgcagccatattagggaataagggcttcaatatatgaattttgagggaacacagacattcagcccatcacaatatatgtactttttcttagtggaatttttagcgtagcagagttacctttcccccagaagtgtgtcagtttgcttgaagtccaagatactgtgaaatactaacttacaagatgaaagacaaatatatttcactgagtatggtgggtttatatctatctatttaagacatagtttcttcccttgacatttccttctaaatacccagaatccatctttttttctctagtgctactgacattttgttgttcttccagtaaacttaacaattcaaatggaatgaaacttgcttgtgctttgattttgtaagatttttatgggacatatttgtcatgtttttagaggcaaaataaaaaaagcttgctttaatttgctgatacatattttactttctttaacaagtatttattttgtaatattgattactaccattgtatagacatctgaagattataaaacaaatgtaattatgttcatcaacaacctatttgaatcttacttatttatgactcagtaaaaattagcttttataaattcactgttgaaatagtctccccatgccacaatttcaaataaaagttaaaacaagtatttattctaataggcttttcacaattttatcagattatttaaacttgcaccagcccaccaaatgttgagtagcttcctacacatgtgacagtcaaattaagtttttaagcagcaaacattagtaacatgaagggaaagagtcattgctttctagattctagtctagattagaattgaatctagattctacatttctagtgtaaattaatttaaattctttcatactcctgggtaaacctgtaggcaagtttcttatctgttttacatggctaactatgataactaagctatgttttgagttttttgtctcaaagctttaaaatttacttcctgtttttatgaaactttgattattgaatctcctaggatatcactttactttttaaaattaaaattaaaaatatatgtgaccgaagctgttaatgaggaaatttcagttaaattaagagaatctatgtagtgtacctattgtagaaaatctcccaatacttgtagaaagatttatcttcatttgaatttattttgaaattttctatttgccatgtaatatcaaatctgcattaaatatctctgcaacaagtcgtggttgaatttcattttaaaataataaccttaggagtaatgtgaagtacaaacaacataatctttagagatataatttgttttttctcataatgcttaaaatattcctctgaatttctgtcttaggtaccggtgtgataagctttatacctctgttttctgtctttgaatgaaatgataatatttatattttcaaagtaaatttcagagttatattttgaggtaaataattttttatatcaaaagataaattactaaaaagaagcaaaggagctgatgaaatatttaaatgcattattcagaaaaaacttctgttccacgtggtctagatttataattctagtgggtacacattaggccaaggtgatctgtatttctttacttcaaaattacgtactaaaaatattctaagccgggcatggtggctcacacctataatcccaacactttgagaggctgaagcaggaggatccgttgagctcgggagttcaggactagcctgggcaacacagtgagaccccatctctacaaaaaaatagccaggtgtggtggcgcatgcctgtagtcctagttactgggaaggctgaggcaggaggattgcttgagcttgcggggtcgaggctgcagtgaactgtgatcatgccactgcgctccagcctgagtgacagagtgaaaaaagaaattgggctagaaactttcactgaaacctggcacaggcttatcctttttttttattgacggcgggtggcggtgggctggagagtggggatggagtttccctcttgttgcccaggctgaagtgcagtggcacgatctcagcttgctgcaacttccacttcccaggttcaggcaattctcctgcctcagcctcccaagtagctgggattacaggcatgcgccaccacgcctggctaattttgtatttttagtagagacggggtttctccatgttggtcaggctggtctcgaactcccgacctcaggtgatccgcccgccacagcctcccaaagtccaaagtgctgggattacaggtgtgagccactgcacccagccctagtcttatccattttttaagtagtattcaaatttgtattgacaaaaaaggggtgggtgtgtgtgtgtgtgtgtgtgtgtgtgtgtatatgtgtgtgtgtatgaatgaatgacatgaatgacatgagtgatatgtgtacttgttttggtggctagtctaaaagttgtatattttaagacaaaaatgtatttatcaaaatatttatattgattattaaatttctttaagatttatttacatctgctctgataccttagagtctactacagcaatctataaattttttgttgtaatgtatctttaggattgcaagtgagtggtcagtttgtgtgtgtgtgtgtgtgtgtgtgtgtgtgtgtgtgtgtgtgtgtgtttgtactccaaatgctgtaaggcgtaggaagaatcattctgcttttttctttcttcctcttttaactattataaaatattttcattttatttgttttctactagtaaattattccttcttaaattaaaatttgcatggactagaaatggctcattttatgttatgtcagttttcaactacctttcagtatatacattataaaaatagatttcttgtagtacagaataaaacccagcatctcattaggtatagattttcatgtggaggatggtttcttcaaataggtttttgccttatctctttccatcttttcggcattgaaaagagcactttggtcttttaactcggtggtactttataatatactattcttcccatcactgtaaaacattgatgcatgggtaaaaatatcttttttatatcgcaaataaattgagcttgttatagtcccctctcttcattttcaggaagaggcagaaatccaggcagaacttgaacgtttggaaagagtcagaaatcttcacatacgtgagctgaaaagaataaacaatgaagataattcacagtaagtcattatttgcatttcacagtttcatattattaaaactacccccgccccccatagagcataaacacaatatttccttcttgggttgtctcatcgtacttagaaaagatccaaagtccttcccatggcttggaaggccttttatgatttggtccctggccaccttactgtcctcacttctcttaaacatgtcaagagcattcccttctcagtgggcttttgtgcttaccatttcctctgcctggatgttcctcctctaaacacctaattggcttaattacttatctcactccaaatgttctttagaaaggccattcttagatcatcctatttaaaatagtagtccctagccaggcccagtggtgctcacctatagttccagctactcaagaggctcaggtaggaggattgctttggccaggagttcaaaaccagccttgtcaacatagtgagacccccatttctttaaaaaaaaaaaaagtctctgcttcttcatttcctcttttaatatcgttaccttgctttatattttctggatgttgatcactatctggaattataaatttattttttagttattatttgtctcctccctctagaatgtaagcttcatgagtgcaaggacttggttttgttcttgctgtatccgtaaagcctagaccagtgcctgacatatggcaggcacttaataaatatttgaataccaaagttaatgttatagtagtgaaggagaaattatttcaaccaaaagtatttcagtaagccatgtatcccacattatgcaagaattgggagagaaatggaaaagtacagcttacagtctgtgttcttaatcagttgtcagaatgagtgccatagatagtatatgttgaagcaattgaaagaaaagaaaatatctgtgggcttgtgggagcttcatgaaaaagatagaaattgagcaagacatagaagtagaaattaagcaaggtactacttggatttagttgatgtacaagagaggaaaggtttctgtttacacttcatctttgactggtcatgtagtttaaagcttcatgagttaatataagtatcagaataggaagtggccaatttctgtgtgaaatatgaaaatcttgcttagaaaggtcttcttgtgatgtctatgtatgtataattcataaatacacagatcattccattgtgtgaagagaaagaaatagttatggaataacctaaattatgtcagattaaaattctaatgaaagccaggtgtgctggcttatgcctgtaatccttgcactttgggaggccagtgcaagcaaattgattgagcccaggagtcaaaaacgagcctcagcaaggtggaaaaaccctgtctctacaaaaaatacaaaacttagcagggaatggtggcatgcacctgtagtcgcagctacttggggaactgaggagggaggatcgcctgagcctgcagtgagcctagatcgcagtccagcctgattgacaaagtgagactttgtctccaaaaaaaaaaaaaaaaaaaaaaaaaagtgaggggccaggtgtggtagctcatgcctgtaatcccagcactttgggaggctgaggtgggcggatctcttgaggttaggagttcgagaccaacctggccaacatggtgaaaccccatctctactaaaaataaaaacactagcccagcgttgtggtgggcgcctgtaatcccagctacttgggaggctgaggcaggagaatcacttgaacccgggaggcggaggttgcgccactgcactccagcctgggcaacagagcaagactgtcttaaaaaaaagtgagactctgtctccaaaaaaaaaaaatctaatagagcatatggtacaaaactaatttaagactaactgttccgaaaattacatttcaaattttgtggatctgacttacattgatgaaaataaaatcaactgttacagctttacagtgtggcttgaaactaagcagaaatttcttatatctacaagtttctcaagaaaaagcttaaattactaaatctagagtcaattgatcttgaaaaaaataataaaatacaatgtattttggccaggcgttgtggctcacacctgaaatcgcagtactttgggaggccgaggcaggcggatcacaaggccaggagtttgagaccagcctggccaatatggtgaaaccccgtctttattaaaaatacaaaaattagctgggcgtggtggcacatgcctatagtcttagctaattgggagactgaggcagaagaattgctttaacccagtaggcagaggctgcagtgagccaagatcgtgccactgcactccagccagagcgagactctgtctccaaaaaataaaaaaataaataaataaataaaaatacagtgtattagtattgcaaagctgactttttttttgaaagtgtacattttggaaccacatttttctgctaagtcctgccttttattagctgttaagcaagttacttaacttttctgtgcatcagtaccttcatttataaaacagacatagttataggacctacctgatagggtgggttgaaaactaaatgagttaatacaggtaagagcataaaacgcacaagttgaacatcctaatgttggaaatctgaaatgtaaacttctctaaaatctgaaaatttttgagcactgacatgacattcaaaggtcttgcacaaaggaaatgctcattggagcatttcagattttggattttcagattagggatgctcagtcggcaatattctaaaaaaaaaaacaactcccaaatcggaaacacttctggttccaggtatttcaataagggatactcagcctatatatggcaagtacggtaaattttaagtagtaatagtagtagtattacctatgagtgattttttttttaattttaaaaaatctttttaaaattggtggttaatttattttacaaaagtccgaagacagtaaaatttaatgatgaaggccagtttataattatgtttaatcatatgtcaatactgtaaaagcttgattataactcccaatataaaagtctgttttttccagagaagtgattcttgctgagtacataaaggattttatgaagctcttggcaatgcagtaattattaggtctttgtgagagtgctataattggtcattgctcctgaatattgagctataaaagttttgtgagcgccaaagccttaagatgggtggtagtcatgcagatagactggtagagaatgaaaagaaatattgaatgaaatttgaaattagcagtggagtaactgagaaataaatagctaggaatagaataagagagtagaacttcagtgtagaaggaatttttatgtgtgtgttttaatatgtctgttttttgcccccacctctaaggttcaaagatcacccaacattaaatgaaagatatttattacttcatctgcttggtagaggtggctttagtgaagtgtataaggtaatgtatgttttattctgttttttttacactaatgtagcaaggatataggagtatgtggttaagaagtacttacgttgtctgggcatggtggctcacacatgtaaccccagggctttgggagatgggagggtgcctgaggccaggagtttgagaccaacctgggcaacatagtgagaccttgtctctacttaaaaaaaagtcagccaggtgtggtggcgcacacatgtagccccagctactcaggaggctgaggtgggagtattgcagagtccaggaattcatggttgcaataagctatgattgcaccactgcactctagtatgggtgacagagcaagaccctgtctcaaaaacaaaaaaaagaagtacttgtcttttgtttattgattatatgtcctcattataaaaaagggtttgttgtggcttctgttgtcttatttccagaatccaaagactgtccttgccacctgcacagtccctgtgatatttgatacctagtcaccattaaccagtccaatacaaagagtaacagctatttaaatcaagataggcaggtagccatttaatacagtacacttatagaaagattgtaccccttaattaaaaaatgtctgaagtattaacatgtcctgaatttatccaaatttctacctatgtcaagtccgtttctcaaatgcatatgtataaatgtagcatttttactccccatgttcactattttatgcctttctttttttttttttttgtactttatgttgtatcttttagcctaacctttaaatattggattcctaaggtcccttttatcattctgtattctcccttaagaaggtttttatcctctctcattcactgggttatctatttggtgtcacccccaggtaatatctagctcacactttcttcctgagttcaatacctcaaagtatgtttgtatacatgacttacctcatgtgggtgcttcataggtactggaaactcacatttgaaatagaagttatcttcctctcctctaaaatgtcttttaacactgcttctgacttccctgacctcagtatataacattgccattcatctgcctggtccctcaagtgaaaaaacacaaaaaccatcgtatgctcttcctttccctttgttcccctcccctcacatattataagcccctagttcctgctattattaatgtcattaagttctcctaaattcagccatgacccttcccttctgtctcttagctcaaggcttcttccggaacctcatagctgattgtcttcttttgggcattgcttttctcaagtcattttgtacactgcaactagagtgaactttttataaaaggcagcctgatcatctgtcctacttgaaagccccagtagcttcccatttgctcttgggatgaagtcctagtgaagggttatatgctcatctttagttcctctaaacagcttccctgaccctctgcatcttctctgatagatttggtgtgcctttttataagctcctttgtgcttcattacgtactggcatagttggttaaaagctttggttctgaagccagacagctaggtttaaatcctgactgctatttactaattttattaatttgggcttcttatttaaatccctgtctgactcattggctccttctgagaataataacaatacctacattatagggttgttgcagtgattaactgagttatcacatgtaaatcatatagaacataggtgctgagataagctgataagattattagaaatcctgcttgttggccatggctcacacctgtaatcctagcacttggtggggccaaggcaggcagattgcctgaactcaggagttcaagaccagtctgggcaacatggcgaacccgtttctactaaaaatacaagaaaaaaattagctaggcatgatggcacatgcctgtagttccagctactcggaggctgaggcatgataatcgcttgaaccttggtggtgggaggttgcagtgagccaagattgtgctactgcactccaccctgggggacagagggagacattttctctcaaaaaaaaaaaaaaaaaaaaaaaaaaaaggaaaagaaatcctgactgttgcatgggacaaagactacacccttctcgtttctgcttctgacttggaaaaattatgggatttgagttaagagaacttcagttctggtatcagttcaaccatgcactattttttgttaacttagataagcattacacgtcagggtcctcaccttcctcattcatcaaaagtgatctttgggctctcttccaattcctgtttctctgattctaataatagtttatccttaagcacttaatgggtgaagtaggcttaccataaggtagaaaagattatcatgatagttcagctgggatctaaaagtcactaaaagtgcagttagcattagcgtggcctaaaagttgttgagcttatgaacttaccatgagccttcataacaaccctctgctactgcctggttgtattttaaataactattttaccctcataggtgaggacttttgtagaagaggcttacatagagattagaaagtgcagattggggcccagtgacttgaactttctatactgacctaaatactagtgacatcattctctaagccctttaaagccctttcatgattgccagttctgttgggaaacaactagacaaaaagcagattgtaagtcaagaagtaaagagttgtattttataccaggatgggagatgttgagtcagttgctgagtgattgccatattaaccttatggaaaggtatacttctactcacctgaaattttgggaggaagatgtgttacatataatttattataatcagtatactctgataataactttttattgcttgcttagttttttcttcaattatcctttactatgattgccttgaattctttatagatttgttccgccttgtcccttatataaacttactttatttttattcttctcagtttctttacacttaacccttaataataatatgtaattagctaatgtttcttggccgtaccatgtattattctaaacacctcatatgttttacccccatttaatcctctcaataaccctaacttttggggctcagagagggtattagcacagagtcactcagctaataagctaatctgattgcaaacagaatattcttaacaactgtgtgctatattatatctgatctcatacttttatagttttgtaccaaagtagtcactttactgcttatcccttcctgcttatttttaggttaaattgatgggaggaaatggggaccttctttctaataaatacgtaagcttttaagtgaaaggggcacctttgtgtgtaaatcacaatggaaccaaaattattaaatgtctctttaatggtattcattgctttttaaaaaaacataagtcatgtaaagctgttaaaatactgatcattctgtgtttttaatttaagaaataggctggtgatttgaacaaatcaagtataaattctttttgagacaaccagggaaaattgaagacaggttaggtattagatgagatgaaggaattattactgatgtagttaggtgtgataatggtatgtggttatttttatttaaatactgatgtgtttactgggagaaataatgtatttgttttaataatactctggttgggaagggtgggatgcaagggtactagggaatagatgaaacaagaatggcaacatattggtaatttttgaaactggatggtaggggcataagggcacattatagtagtctacttgtgtatatgtttgaacagttttataataacgagtttttttcaacagttggaaaaataactgttaggaactttttaatttttctaaaaagtgagaaagaaatagggggttgctaggaaaagatagatttaaaaggttttatccaacctacaaaaaaagtggtacagtcatctgttttcctggctgcttactactagtatagaggaataagtccatattaaaaacaaataatagctttattgttttatttttattcagtatattggcatttataaaatttaatgtgaaaattcacattaaggttttctctgatttattaccatggaatttctgtcttctgataataaaagtgtcattgagctatatatagtcttagcagagaagatcattaataattgtagggtttgtcctaattccatattattgcaaaaattatcaccaaaataaaaaacatctcttcagctattcaattggtctttcatcttaattgtttttgacttgaaatcctaggcttttgacctttatgaacaaagatatgctgctgtgaagatacatcagcttaataaaagctggagagatgagaagaaagaaaactaccacaagtaaatactaatactttatggttttttaaaattgaatattttttgaatgatcatggagaattaatacactgtcttctcatagacatgcctgcagagagtatagaatacacaaagaactggatcaccccagaatagttaaactctatgattatttctccttggatacagatacgtaagtgaatattaaggttcaatttttaaggaaagatatgcttgctttctctttccccatcctgtgttgatgatataaatactctccatttccccattgtgattctgaattcttggatattacttatgtctaatttttttctcttctctgttgtaggttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggtaattatgaaatttgtctaattttttttaaacttgagtatagtttttaaaagtcattcattaagttatctgaaaacatgttttttggtttctcttgtaagacatcagtaaaatactagtaaaattaaaagttattaaagttatgtttttcatgtatgtatcattaaaagaatcttatattttattcttaggaaacatcctactggtagatggaacagcatgtggtgaaatcaaaatcactgattttggtctgtccaagattatggatgatgatagctatggtgtagatggaatggatctaacttcccagggggcaggcacttactggtaagtgtattactaaaaacatcagaatgtctagattggtgcccagtgcttttataataatttagtgtttttttttttatttccatgtagccattaagattactgtggtaaaggtactgatattaagctctcagttgagagggagacttctgtggtcattcctcttttctcatctgttcttaactgcaaataacagcatactggagagagaatgacctggcattaacaagtgacttcagtacctgccagtcagaaactcctaacaggaagaattcattcatgggttttcttctacaatgttagcgtgatgttcatcataaatataaatacttatgttaatataatattttaactattgcaagcaaaaactgcaagcatcaagccctctctgtggaggttatatggttgcaggaattttcattttattttgagacagggtcttgccctgtgcagtggtgtaatcttagttcattgcagcctcaaactcctaggctcaagcgatctgcccacttactcttgagtaactgagaccacaggtacgcaccactatgcccagctaatctaaactttttgtagagaccaggtcttaatttgttgcccaggctggtcttgaactcctggtatcaagtgatctgcctctcccaaagtgcttggattacaggcgtgagccactgcacctggctggtggtttttgtggaagatggatgttttgttggctgtgaatgggagataaatttggcatattctttggacttgactttcagaaatcccttttaaagacttgatatgtctagatttaaatttagatataatcacagattcatagatataaatctaaatgactgtcatcccctcagtatacctacgtgttcacaaaaactacttcagtgtgaattttcaaacttgttaaattcaccaaagtggagaacataaactataaaatttcaaaacaaacttagttctcagagaaaattagtttagcataaagagtgacattttaatggaagaaagataactgcgttcaacttcattgaaacaggattgtgactacaaacataaatgtgacttcaggttttccagaacagtattcacacaaactgagcacatcataaccacttacacacgatgccactgtctgtatagatttcacttttaatgagcagggattagtcatattcatgtattcttttaaagccactttcaaattttaaatttggcttgtggcatttcctaggaacatggataagataataatgtcatgaattttttcttcatattttaagaaaactattcaaactggtaaccccctgaaagtcaatattctcaaagtctttggacttttttcttttagcaacaaggctcatttttttttttaacaacaaaatcttattctaataaaaccaacaaaaacaaagcatcttggtagaatcttagattccatggaagatagcttgaaaaccatgttctaaacaataaattattcttcgtctgcaggacattctcattatttgtttctctctcactctggcttcactagtatagggaaggacaaggaaatttcccttttacagatgttcgagggacaaagagcttatgtttcaggggctgtactggaaggagatacaataatggcattgttctataggaacatggaatgtatttctcatggaaatctgtggtccaaaaattggtttatgtctacagtcatattagttgtttagctatgtacagctgaccttgaataatataggtttgaaatgcatgggtccacttttatgtggcttttttttttccgataaatacattggaaaattttttggagatttgcaacaatttgaaaaatctcactgacgaaccatgtagcctagaaatattgaaaaaattggctggacacggtggctcacgcctgtaatccaagcattctgagaggctgaggcgggcggatcacttgaggtcaggagttcgagaccagcctggccaacgtggtgaaacctcgtctctgctaaaaatactaaaagtacaaaagttagctgggcatggtggccatgcctggaatcccagctacttgggaggctgaggcaggggaattgtttgaatccaggaggcagaggttgcagtgagctgagatcataccactgcactcctgcctgggcgacagagcaagactccgtctcgaaaaaaaaaatactgaaaaaattaagaaaaaggtatgtcacgaaggcgtgaaatatatgtagatacttgtctgttttaccatttactgccataaaatgtacacaaatctattacaagaagttaaaatttatcaaaacgtatacaaacacagactgtacctggtgctatttgcagttgagagaaacgtaaacaaatgtaaagatgccgaattaaataataacttcataaaattaactgtaccacatactgtgtactgtaataattttgtagctacaccttgttgctattgtaaggagctcaactgttttgagtatctgtttaaaacactgtgatgctaatctccgagcaattaatctctccagtaaaaggcctatcgcagtaaaaagtaatctctcgtgattctcaaatatttttcatcatgtttagtgcaatattgtcaaccttgaataacaccagtaatgatggaagtgctctcaaggagcagagaaaaatcatgacattacaagaaaaagttgaattgcttgatatgtaccatagattgaggtctgcagctgcagttgcccaccattccaagataaatgaattcaacaaaaagatcattgctaaaaaaaagaaatttgtaaagctgtcactgcagctatgtcagcaggaacagaaaccttgtacttttttttttttttttttttttttttttttttgagacggagtcttgctctgtcgcccaggctggagtgcagtggtgcgatctcggctcactgcaagctccgcctcccgggtccacacccttttcctgcctcagcctcctgagcagccgggaccacaggtacctgccaccacacctggccaattttttgtatttttagtagagacggggtttcaccgtgttagccaggatggtcttgatctcctgacctcatgatccacccgcctcggcctcccaaagtgctgggattacaggcgtgagccaccacgcccagcgaaaccttgtactttttgcaaaatacccttttatctctaattgaaaatggaagccgtgcacggtggctcatgcctgtaatcccagcacttttgggaggctgaggcaggcagatcagatcacttgagcctgagagatgaagatcagcctgagcaacatggcaaaaccccatctctgcataaaaatacaaaaattagccaaatgtggtggcacacacctgtaatcccagctacacaggaggctgagacaagaggatcatcgcttgagcctgggatgtggagattgcagtaagcccagattgcaccacagcacttcagcctgggtaacagagtgagaacatgtctcaaaagaaaaggacaaagaaaatgcagctttctgggcgcatgatacccacagactgtaatgtgattttagaaaaagcaggccaggcgcggtggctcacacctataatcccagcactttgggaggccgaggcaggtggatcacgaggtcaggagattgagaccatcctggctaacacggtgaaaccccgtctctactaaaaatacaaaaaattagccgggcatggtggcaggcgcctgtagtcccagctgctcgtagtcctagctactcgggaggctgaggcaggagaatggcatgaacccgggaggcggagcttgcagtgagctgagattgtgccatggcactccagcctgggtgacagagccagactctgtctcaaaagtaaaaaaaaagaaaaagatgatatgaccattttaaagcaaaaggaaggtgaaggatctaaagctggagaatttcatgccagtaaaggatggtttaataattttagaaaaagggttggcttttaaaatgtcaagataacaggagaagcagctcccgccaaccaagagttcccagatgctattaagaaaataattgaggccaggcgcggtggctcatgcctgtaatctcagcactttgtgaggcccaggcgggcggatcatgaggtcaagagatcgagaccatcctggccaacggtgaaaccccgtctctatcaaaaatacaaaaattagctgggtgtggtggtgcatgcctgtattctcagctactatggaggctgaggcaggagaattgcttgaacccagtaggcagaggttgcagtgagcgagatcacaccactgcactccagcctgggcaacagcaagattcggtctcattcattcatgaatgaatgaatgaatgaaaaagaaaaaataattgaggagaaaggatagctgcctgaacagataatttaatgcagacagaagtgccctcttctggaaaataaaaatgccacggaggacatttatttgtaaggaagagaagtgagcaccaggatttgatgtaggaagggacagggtaactctactgttttatgcaaatgcaattgggtttatgatcaggactgcccttagctataaagctgctaactctggagcctcaaacagagaagataaataccagctgccagtcttttgcctatacaacaaggaggcctggacaattggaaccctttttttggattggttccatcagtgctttatccctgaagtcaggaagtaccttgccaataagggatcaccttttaaggttcttttgatactggacaatgcccctggccacctaggagcccatgagtccccaaacacaacaatatctaattcagcctctagatcaagaggtcttaaggaactttaaggctcgttacacatgatactctatggaaaggattgtcagtgctgttaaagaggacaccagtagacagaacatcatgaaagtctggaaggattacaccactgaagatgtcatcattgttttagaaaaagccatgaaagccatcaagcctgaaagagtacattgctgcaagagaaaaccgtgtccagttgttgcatatgactttgcaggatttatgacagaggcagtcaaggaaatcatgaaagagactgtggatatggcaaagaaggtggggtgaagggtttcaagatatggatcttggagaaattcaagagctaaaagacacccctccagaggaattaaggtgacttgatggagatgagtgcttccaaactggtgccagatgagaaagtagtagtagaagaggcactgccagaaaacaggttgacattagacagcctggcagaagggtttctattagtcaagacattgcttttgacttttatgacatggacccttctataatacaggcactgaaactaaagcaagtggtggaagaaggattgatactatatgaaaaagcaaaacaaattatgtctgtaaagttgcactgagtgtgtctgcctcccctttcatctcttcccccgtcacccctgagacagcaaaactaacccctcctcagtctactcaacctaaagatgacaaggatgaaaacttttgtcataatccactttcacttaatgaatagtgattttctcttacgatttttcttaatagcagtttttttcttctagcttactataagaatttagtatataatacagcatataaaatatgtattaattaactgttcatgttatcagtaagtcaacttccagtcaacagtgggctattagcagttaactttttttttttttttttttttttgacagagtttcgctctgtcacccaggctgcagtgcaatggcacagtcttggttcactgcaacctctgcctcccaggttcaagcgatttctcctgcctcagcctcccaagtagttgggattacaggtgcccgccaccatgcctggctaatttttttgtatttttagtagagacagggtttcaccatgttggccaggctggtctcaaactgccgacctcctgttctacccgtctcggcctcccaaagtgctgggattacaggcatgagccaccacgctcagcctagtaattaactttttaactttttagggagagtcaaaagttagacatgtggccaggtatgggggctcactcatgcctctgatcccagcaggaagaccacttgagcccaggaattgaagaccaacctgggcaacatagcaagaccctgtctgtataaattttttaaaaaaattagccaggcatggtggtgtgtgcctgtggtcccagctaattgggaggctaaagtgggagaatcgcttgaggcttggagatcgaggctgcagtgagccgtgatcgcaccactgcactcagcctgggcaacacagtgagacccggtctcaaaaaaaaataaaaataaaaatcatacatggattctcaactgcatgggtcagtgcctccaacccctatattgttcaagggtcaactgtatttgatatatttggatagcactataaatactcgtatattttagaatacacatataatattgctcttataaattacctttcatcctcagaaacttaaaatatttagttttgtctctctggtctcaaattcactaaatcctggtggacatcttttcccaagttactttgacgtcaatttctgtggttgctctccttgcatacatacaccttgtgcctggagagagtatagcttaatctttacaagctattcctgtttcagttacacacatagacacctgcgtaaaatacacacttttattgacaaaataaatccagctttttactgcattacaaatgagttattggttatctttgctggttttacttcacggaagtttcatgtgtattttaagagatctgtcaacatcttgctgaaatcttaatgattttagcatagtgaatacaaaactgcattttttaaaaaaaatagtaaattcccattgagcagcattatttgttttgataattttaagtttatctaaatttttgaggtgtgagatgcttgcatccttgtgatggatcttttacttataactggagatgacaaattgatttttacccttcatctattaaaaattatgaactggcttagtgtggtggctcatgcctgtaatcctagcactttgcgaggccaaggtgggaggatcacgtaaggccagtagttcgagaccagcttggtcaacagcacaagactatcactacaaagaagaaagtattagctgggtgtgctggtgcacgtctgtagtcccatctatttgggaggctaaggtgcgagggtcacatgagcccaggagtgtgaggctgcagtgagctatgatcgtaccactgtactccagcctgggtgacagagttggaccctgtatcaaaaaaaattatgaacttataaataggacttacatatttttaaaatagtaattttgaatacccattgtgtttcagacactgctagtgcttgaaactgcacagtgaataagagttccttgagctgctcacggtctggtgtgattgtagtttaatgccataatagaggcattgcaccattctgcagtaacacagagaaaagcagagccacctggggagaagcaaaagatggcttatgggggttgggtgggtcttgaagaagaaaagatgctaagtaattggagtgattagggaaggcagtagtgattgtcatattcaagagctcagaggataaaggagagccgagtggagatgcaagtgaattggttttgactagccaatttggcgggttagggtgggggaagatagtgtgtgcagattttgaaaatgtatgttgttgccagattagcatgagtcttgtgttacaaacaagagatacaaggtcttgttggcagtaagtgctgtcgaagttgtttgaacaaaagaaccatgtgatcaggtgtatattttagggagagaagtgcctacagtttgaacagtggttaaggaggatgggagagggtttcttctactattattagatactgcaaataagaccattgtaatctctttaagtttttgtttcggtaggtaggtaggtggtaggtaggtaggtaggtagatagatagatagatagatagatagatagatagatagatagataaagatagatagagatgaactttatcacaatgttgtatgtgttggctctagagttaaatgataaaagaatgtaaatgctccagaagttcagttgatgattttcactgatgggagtcctagagtttatatatgaataaaattcgtgttctaagattttacacttagaagattttaagttacagattgtcagtagtaaccttttttctctcccacaaaacttacaggtatttacctcctgagtgttttgtagttggaaaagagccaccaaagatttccaacaaggttgatgtatggtcggttggagtcatcttctttcagtgtctttatggtagaaaggtaaattgaattctaccagccttcagctctacagagataaattaagttgaatttttccttcttaaaagcaaaatttcactaacttaaagtcaatttagatccttctaaagaaagccaggcttctcctctatttcttcctaaaatttccatggatcagaattattttaatgtcacaccagtttacttgacctactttttgctttctttcctttttttaagaaaagaagtaactatctgttaacatgctaatatttgtctgctattgggaatactggagtcaatacttttcattatccaccattcacttgacctcctcttacaccccccaccccacccacacacacagtttggcctgggtgggcagtttccccgttgctcatcagggaaataccatcaaacttagtcttatttcccaacttctttttatattgaagttggaagtgcaggttaccataaatattaactagcccacatcccaccccatcccttcatcaataggggaagagaggttaagggatttgtgtgggatctcctcactccaaatccagagctccttcatttaaattcgcctgtgatgcacacagtattttattctttggaaattgtcatagacattttcattactacttcatctcttctctaactgaacttcattgtttattcagaataaagttttaaatttatgtttttatcttatattgcaacagcattattttcttcttcttacagtgtttaatctatgttgaagatctgttaggtaggctttcttggcctgctatcaattatagcttgtttgtatgagaattcatctcaggtttcaaataactgaggaagattttagaacacaagatatttggattttcggttttgggaattcgcttaaacagaaatgatatctgtgtttaaatattttgtgagaaaagtatctcaacatttaattttttttttaagccatttggtcacaatcaatctcaacaagacattcttcaagaaaatacaatattaaaagccacagaagtccagttccctgtaaaaccggttgtaagcagtgaagccaaggtattaaatttttgtaaatgagttttgtgaagtaacttttctttcatcagttgtgctgacaacaaggtaagtactttccagtaagtaaagtcacaagactcgctgctgcaggggatctgtccagcaggggctggtgatttactttcagagaaggagttgcatcagcctctggttgctatagtttttatcttttaagctatggtctctgattgtttatgttcatcagctgctactttgaaaattagggaaaaatcacaagatctgggctcatcattaccttttatgtattattttatctgcttatgttaatactgagatatataagtatataagaaatattaaaagtaataataaggctgggcgtggtggctcacacctgtaatcccagcactttgggaggccaaggcgggcagatcatctgaggtcaggagtttgagaccagcctgaccaacatggtgaaacccggtctctactaaaaatacaaaaattagccaggcgtggtggcacacatctagagtctcagttgcttgggagtctgaggtgggaggatcacctgagctcagggaggtcaaggctgcagtgagccatgacgataccgctgcactcaaacctgggggacagagtgacaccctgtctcaaaaaaaccaaataggccatgcgcggtggctcacacctgtaatccagcaatttgggaggcccaggcaggcagattgcctgagcccaggagttcgagaccagcctgggcaacatggtgaaaccccatctctactaaaaatacaaaaattagcccggtgtaggggcccgtgcctttagtttcagcttctcaggatgctgagctgggaggatcgcttgagaccaagaggtagaggttgcagtgaggtgagatcgcaccactgcactcctgcatgggcgacatagcaagacccattctcaaaaaaacaaaagagataaatattcttatttgaaagcaaaatgaattatttttgtaagataaatatgactcctttaaaaatattttaactgtgctgacatctaaatcttgtcttattttctgtctgtagcctcattgagaacagaaattaaatgaatttagttgattcatgatctgtttgtttaatactgactgaaaagaccaggaggagtggagttgccaaaggcaaagtctcatttagccattcctggttctctccttaggctcttaataggcaccacagtcaccttttagagatctggaatccaggaagggttaaggggttgttggggggatataatattaatatgatacaattatatgatataaattttaatattttaatgtaatatataatatctctatattctgtatccctacagaagatacctttgccaagtactttccctgacttggtgtgggcatctttaagtacattatttgttgcagacttaaccttaaccttgctattgatagcctttccactcctcaaactctaacatatcagtcttgatgtttttttccctcttaatcatttttcaaagtgatctctgaaactttgttaaagataaaaaagataagtcctctaagggatcagattgacttccaataaacagtaagctatggtaaaatgagaatagctaggtatatttttagagaaaaatatacttctaatgaatttcaaagcaaagaaagtgcaaaatagttaccttttaatgtgattatacttctgtttaatggtatgtattaatttctagtgtcagcattaagaaagggaaacaattaccagttacctcctgagaatattttatctgttccctccccccccaaaaaaggatgaacctcaaaatttaatattgggtgaaagaggcctggcaaaggagaacataatttataattctatttatataaaattcaaacaatcaaaactcaactatggttttagaagtcaagataaaggttaacccaggttcgactggggacagagccagtgcctggaactgggcatgagggggattcagaggttctttttcttgatctggttgccagttacatagatgtatttactttgtgctatgcacttaacgatttgtgtgcatttctaaaaatgtgttacacttcaggaaaggttttttttttttttgtaagaggctattctcaaagaaaaactgagtaaaattggtttgagaaaaaaaaaatagtgattatattctgtttatttagcttttccaggagtgtaatgatgcatagggttaacctgggaaacaatgtccctaatgaaagtgtcccttcagtgatctcttcatctaaagaaagtctttatgtcagtaggaaaaaaaaataatggttgaaaatggcatcttaccctttgctaaactgaagtgataacaaaatgggatgagggtgggaggactgtttagcagaagaaaaatgctagaaaaaagtcttcagaatttcgtaagcagaaacaactttccagtataagttcaaatggttgcagtagtaatttagactgtaaagtgaaccactgcaggggcttcaagcagtgagttgcatttggagtgagaattttctagctacagaattttttttttaaggtttgaacttccaataaaatgagatctacttatgtcttaaatgtgtccatccttctgctgattcagttgattgatatttagaagggaaaaagatcattaattgctaacatttcctttctctttttgaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacacttaagtttgagagcatttgagtgtttgttttctttttcttttttttttttttttttttttacacaagacgtggttaagaactgtttgtgaactgaagttcctcatagtgtcatttgtatgagagaggatcatggacaatgaataaatgcacacttctgactataattttgagcagtgaaggaaggatgactgcctgttacacagaaacaggaataccatgttaagatagaggaaaaaaattttgtttatttgggggaacactgtaaataacgtttataatacttaaatacatttggttgttactagagagttctaatatgaagggtagtttttcattatttaaaaacacatggaaaaatatgagacatatttctaacatacgaactatagtgcctggatacattcttcagcatttggcagttaatctgctgaaaccaaagtaagaactgaatgacagtgacagttgtgttttatagtaatagaatgtgagagttagaatctttggacaaagttaggctttgtcatttgcctattcagacttttaccaagttgtacctcgagatcacatgtccgttttctttcactggttatattaaagggagagctattatttctaaatactttacacctttgacaaaatgagctgcttgtgttgaaatcagttgaattcactaaattataatattgccagtgttttcaacacgttagaattgataacaggtatttttcttttgttaccaggccttgttcatcaaaacaggtgacagtgagtaaccaaatgcagaccagttctatgcaggataatgataaattcccttctagctctattgtaaattgttgtacagatgtcatatttcaattactaagtttcagcagcttattcttgtacaaatgtttaaaatatggcttttctaattggatattgtattttttttaagtcttcttgaaggcactctaattgctgctaaatgatgttgcttctttgctaaaaaattaaatgacctagaaggtgcaagttgactgtacatcatagatattaaaaagcagacagtcattaacaatcaagatgtaaaagtgatccatgttggacataattgagtttttaaatcagtttattgggttctagggctgtagaacacatagatactagatttttaatttgttcatggttattctacatttctagaaagttcttatcagcaagatggtcccataagcaaatttcttgtggtttgtacagatttgttaaaatgtgaacgttttctaactgcctcgtagggtagaaaccaatatttttcaggatgctgtatttcactcctgtaaggactttttctttattgtcacattcataatgctgatacttacatgtaagttgttcatgttgcagaaaaaggttatacgtaccacggattctctttaatattgtacagttaaactgtatttctgatgttgcaagccattttgttttttcattgtacatagacacattgtctctttaaaatgctgctgaaattgtagagagtatagccaaaacagtaataaacaatgacagttaaaatgtaaagactatgaaaattacattggaagggagctttcaagatggtaggatattgactaactgagctccttcacttaaaaatcagctgaataaattccttaagtatacttc

SEQ ID NO: 36213 - DNA, 169259 bp, Homo sapiens
gcgggcggctccagacttcacaggcagcagctagcgaggcggtctcgcccggcgcgaggccggcgctgtgctcgcctcggagatcgctgctctttagctgggtgcagaaggcggctccgcggctcgcggacgactggctgggcgcgaatcagattggggggctttctcccggtcccctcccacctcgtctgggctcgcggcgtctccggggaaagccgtggccccgagggcggatccgaggtaagagccccttggcgaaaggcgccggtcccggggtccggcggctttgactttctcgattttaaaaatccgcctttgtgtgctggaatcggagcggtgccaggagccgcgtccgcctcccttcactttgactgctttcaactggtgttggcagccaggtgcggtagggcgctgcggccggaggcgtccgctcgccgggtccgggcaagctgtggggcccgtgcagacccgcgcccagggctccgggaggctgggcagggagggttcgccgtggcccagtgatattcatggtaacctgagcttccgcagatacacctgcgctcatctggtccgtggggcgactgcagaccgagtatcccgatctcggcttattacgttagacttgggatttgtgcgctgctctgccaacccgcctcaaatggggaggggttcttttcaaaatgaccctttagggcagggtcccacccccgtttaccccctcgaattaacatagctaattgtttcggaatcgttgtcaatgcctaatggctgttgactttcttagcttgctccactttactcaccattttacttttgggaagacagacggcctttctccggttgtggtcagttcatgcatttgaaaggggtttccccacccatgtactccctgccctctccgatgttctcactcttactttccttcctaggactacctgtttgcaaaatctttgcaccgaccgttctccggcagtgtttctcaaatcctcctcctcccatagggcccgtagtactgttggaatctcgcggggggcaggacgccgtggttaggatttgaaatccgcagacatctagagcggtgaaggattaggaattagaatcctcctttacaaaatatgtttcagtgaaatgtgttactgcttctcttttcaaggtttcttgccttagatagtaaggggaataggtaaaagagctaatatgttaggatgagttcaggtaaaacttgatttcagatgtgtgaagagtgtgactttttggctttgtcatttttgggaaataggagagttaggattccgggcaatcttctttatattgaaaaagcccctcaaagtaactgtgttgtgtattgcctctagtttattttcattgaaaggactccattcttccacagctccttgggttctggaaagtgagcactagtaatggacgtcatgtggtagtgagtctattggaattaaagtcaatgtcatcctgtctcacctagtatagattttttgtttgggatcgcagttttctaaacatattgctgtagttcttaagttgctggtgtggaaaatttttggtcacgaattcacacttttacttacaatttgacagttaaaacagtatagaattgtcacataaagggtaaggtagaatgtatcacaaatgcaatagtgataatataatgcctttattgcagaatacacagattgagactttgtaagattgcaccacaagtcattcactttatagcagaaaaaaaagaaggaaaatataatttgcttttaattctactattctgagataaccgctgtttacaagacttggtgcattctctttgtaatttttttcacttcccaatgtcattgaatattatatagtaatttccagtaagtgtaatttaacttatactgttagtagccccactcttaatagggtgatgtttcttttgtttcctgtcaggaacctaatgtctaattttgaatattttgcttgtttgtgatcaaacttaaagatttattttgtttttatttctagctttttcctgctttcaaggttttatcaatactgattcttttcagataccagttcttttctatgctatggcataggcttgctactctctactttgtgtttattacattccaaatcctagttattttcttacactctgtttcacaccctttaccctactgctttttattcttctctctactcccttcttttacatacctcttttaattctgcagcaggtcacttgaaccaaggtttgtataagaaaacatagtatccagaataggaaatgataggtttttaaaagttgtctctttaaatacttgaagttctattggatgaatattttaacactgatttatgtaatatttatatacaactcagctttcctgagttgtgtgaaacatacttggtagttacacggatcatcacaaaacaacataagttaatgataaggtacaaacttttggacatctgtagaggtatgtcgggggaaaaagtggaattttaattaaagtattctggctatagtaaatccctcctgggaattattaatactacatgaaattgtttgcagctgttagtgattgaaaatatttttgtaagaaaaattctgcattggaatagttgcaaacattttaagttgaatatatgcaagaaagtttaagggtcttcagtgcttcactacaaccttttcagtattttctagatgtattcctaaatgggatttaaaaaaatagaccttatttctcagaagttttggatttacaggaaagctacaaatacggtgtctatatacccccataccagcttcccctcttattaacatcttgtattattggtatttgttactattaatgaaccagtatcagtacattagtattaacaaagtttatactttatttagatttccttagtttttaatgtcctttttctgttccaggaccctaccatccaggacaccactaaatgtatttcctcgtaatgtctccctaggctcctcttggctgtgacagtttgttagacttccttgtttttgatgatgtttgaggagtactggtcaggtattttgtagaatacatttgcattggaattcatctaatgttttttctcatgattagactgtgattataggtttttggtagaaagatcacagaggtaacgtgccattttcatctcatatcaagggtatatactatcagtatgatttgtcactgtgatactcatctttatcacctggctgagatagtgtttatcagatttttccacttttctccacctttttcatgctgtgctcttagaaggaaggaactgtgtatagcctatacttaaggagtagagagttatgcttccccctttgatggtagaaatctatataaattatttggatatttttctccgtgggagatttgtctcttctcccccatgtatttatttactcaatcatatttattttgttctggactcatggatatatatatattatataaatataaaatctatctatctatctaaatattttgggttataatacaatgctactttgttacagcttgactccagtgcctctttgacatactaccatcaatgtgaattttgtttttttggaagcatttccttactttctggtattatgagatgctctaggttcatctgtatacatcttgccacagtcctagaatcagtcatttctccaaggaatctggatcattttgttggggaatggtgttagaaaccaagatctgggtgctaggtgtgcttgttgctactgtggtatcattgcttctaggttctctcatgtgacaaagcaagaaatacatgtgtgtatatgaacatatctgtacatatttttatgtaacagtttgtatccatgtttaactatgaatttacattttatctgtaatgctaattcattaccacaggtatcattctagccttctccctttgtttatatgtaaacttactccaacagtgagaagaaacctggtttgcaccatctgccatacatttgcttaatcattcatttctatcatagatgtatagcagcattggaattgttaacctgtgctcccatgggaaacaactttagcatcaagagtacagtgtttatgtactattccttttgcttttagtctcacagcttctactcatttctagagttagtcagctaagcacctttcctcctatccttttcagtgagattgtagcacacatttataatacagttagatttctttgttacaatctgcattccaccttgggattccttgaccttctaaatgatttgcttacgtttgcatacattaaagtttactctttgtcctgtgaagttctttgggttttgacaaatacttaatttgatgtagctatccttataggatcatagtatcataccgaataatttcaacacattacaaatcccctgggcttcactcataacctctgtgagcccctctcccagaaaaccacgtatctttttactgtctctttacttttgccttttccagatgttgtataattggaatcatacagccttgccagactggcttctttcatttagcaatacacatttaaggttcatccatgtcttcctgaggtttaatagctcatttctttctatcattatcagatatatcatggtttgtttattcacctattgaaggatattttggttgcttccagtttttggcaagtatgaacgaagctgctatgaatattcacatgcaggtttttgggtagacataagttcttatatccgttggataaatatctagaagtgcgattgctggatcctgtggtaagattatggttagctttgtaagaaattgccaaactgttttccgaagtggctgtactattacattctcaccagcaatgaatgtgagttcttattgccccacatctttgctagcatttgattttgtcagcttttttggattttacccattctagtaggtgtgtagtaatatgtcattgttactttaatttactatttcctaatgacatatgatgttaacatcttttcacataccccttttcatctgtacatcttctgtggtgtgatggctgttcagatcatttgcccactttttaatggggttgttttcttattgttgattttaagagttctttatacattttgtatacaggcactttatcagatatgtgttttgcaaatattttctcccagtttggtttgtctttttattttcctaacagtgtctttgtcagaacagatgtctttaattttaataaggccaacttaccaatttcatggataggcttttgtgttatatttgaaaactcattgccaaggctacatagattttatcctgtgtttttcctagaagttttatagttttgcattttacatttaggtatgtgatccatttagagttaatttttatgaaaggtataaggtctgtgtctagattaattttttttttgcatatggattcctagttgtaccagcacaagtaaatgtgatttttaaattaatagattataaattgcttagaattgaaaatgtttttattaaaatttttattacatgttctgcaaaattacttactgtaaacagttgagaaatgacttagaaaccaatatataatacagcatgtactgtgtgctgagatttatttctagacattgtacataattcattttcctcttttttttttttttttttttactaactcagagatgcttctttgtgaaaatggaattgttagtatagagtaacatctgtcagttcttttagatcttatcatagggaataatagtttgatttttcacaaaaaggatctggaataaaggatttgcagggtgtatgttgagaagaggcagttgatgtatgcaccagctagaaatctgagacttaactatgtggtcttgaatcttttcccatgctattcttcctgctacaagtgacttttttcaagtacagttgacccttcaatagtgcagcggttagactcactgacccctgcacagtcagaaatttttgtataatttttgacttcccaaaaacttaactagtaacccttctgttgactggaagccttactgataacacagtctgttaacacacattttgtatattatatgtatattacattgtattcttacaataaactacagaaaagaaaattttattaggaaaaccataagggagagaaaatccagtactgtattgtacttattgatattgtaagtttttgtttgcttaccagatgactcctctttctgaaaaggtgggggaatggaggggcagggctgggaactgcagctgcagacctcaatctatggtacataccaagcaattcaactttatctctcataatgtcatgacttttctctgtttcttgggagcatttctggcatctctagtggcacgttttcattcaaggtttatggtattgtaccaaacaggatgaaaaatacaagagaacaccaagaaatcattttttactgtgatacacaatttaccggagagatgaactgctcacgcagagatgattaacatcacacagtggactaagcggttactcacaacacttgagctcgctgcaataacaacaggaggtggctatgaaattattacagtagtacagtatgtactacagttaattgtatgcagttaggacttaatactgcatctttacatttgtttacatttctcttgaccgcgaatgatactatgtatcgtgtgtgtgtaagttttgataaattttaattttttctaataaattttatggttactaccataaaatgataaagtagactagtatttatatacatattatgcattcatgacatacctaacttttttcttaatgtttttgttatcctggctacgtggtttgtctgtgtttttattgtatttatttatttaaaaaaattttttgagacagagtctcactgtcacccaggctggagtgcagtggcgccatcttgggcctactgcagcctcaaccacccaggcccaggtgatcctccccattcagccttctgaatagctggaaccataggcatgtatcaccaggcctggctaatttatttttatttttattttttgcagagacaggatctctctgtgttgtccaggatggttttgaactcccaggcacaagcagttcttccaagttggcctcccaaagtgctggtattacaggcatgagccaccacacccagcccgagtgtttttaaattgtcacaaatctccaaaaatttttccaaatatatttattgaaaaaaatctgtgtataagtggacccatgtagttcaaacctggcttttcaaaagtcaaatgtacctctcttttggtatacattttgtgttattgatattgtgatgtactatagtttacatatttgtcctctccaaaactcatgttgaaatttcatcctcaatgtgagagtgttgagaggtgaggcctttaagaagtgattgatccattcatgaattaatggattaaggggttatcatgggagtgggactggtggctttgtaagaaaaggaagagagacttgagtgagcacatgagcacactcagcccccttgccctgtgatgctctctgttgtcctgggattcttggagagtccccaccagcaaggaggctcttagcagatgtagcccctcgaccatggacttcttaacctccataactgtaagacataaattccttttctttagaattacccatttcaggtattctgttataagcaacagaaaacagagtaggacaggattagaaatatttataatgttgcactaaagttagaaccagtagtcttcaagaagcaggtggagcagctcacataataatagtaccttttgtgtggcaggtgttacatacattatcttctttcactgttacaagagccctttaaggcatgcttctttatctcagaattacagataaaggaataggcccagaaagaaaaagtgacttgtgtcacacatggggagaaagggaccgaattgggatgagaaccctgacctgactccaaaatccatgccctttccacttggttgtgctgcccttattaaagaaaaagggcaaggatggccagagtgtccttaattacattcttttatttaatactgtgctatatacttgctcaaattactactgtgccaaacaagaatagcgaaaaagtttgtgtatttaagctccacaaagattcttctagctttgttttctgttgactcatctgtatcctactgaccagaggtatgtggtgatggaacacggttgttttaaagaatgaggatcttttaaaaagaaacatttgtggggaattagacaaaataaagcaaataatggtagcattagctagttatttctttctttccctcattgtatttaaagcttctcaagggcagggaactgagtcagttaagttccctgatgtatttaaggccaacatatgaccatatgtgtcagccatatgacacactcacaaaaggcttgctgaatgaaattagcacttattatcatatttttacataaatacttaaaagggcatgagttttcctcacataggaagttgagcattactacatttcatttgtttattcattcatcttttatcgagtgtttgttgagtatctgttctgtgccagacaccaggaatacaaagatgagtaagacaggatctctgccttttgttgtcagaaggctcagagaatggaggcagccagacacccgttttagtacagtgtggagctgaaggaagtatatattaaaaaacaaacaaacaatggactttggaatcagaccttatctgccttggttttcttatcaaagaggtggaaatgtcaagtaggtactattatccatggaggatgttaaatgaaaagtgtgtatgcctgtgtgtgtgtgtgtgtgtgtgtgtgtgtgtgtgtgtgtgtgtgtgtgtttatcccagcacatagcagaaaggagagcctcactgtggccgagggagtcagaaaagtctttactggggaaggtgatgtttgagtctcatagaatgaatttttgaggcaaagcgagacgctcatctctctccaggtagaaagatgagcatgtttgacatgtgcggaataggttggcatgatgggagtggtgggaaattctgcacattcccacattcagagcttacgggagtattagaaagaactgaatgagcagttatttttcatttttgtaagtaacaatacaatagagtattcattacattgtagcagaagagaataaagataccaaacctgtttaagaattgcataaatcttctcttctagtcacatggccttctaaatgtagctctttatgtagcaaacaaattcatgtgttctttttcagtcctgtgatactcaagtgattatatggaatttaagaaagagaacttgcatgtttttgggtgaaattggaggtcctgtttcaaaccattcttacatttagtagcatagcaacaaaagaatgtaataatctatgaagccagatctagtcctgtttaagcctgtctaaaattctaagccatagtttctgaacagaacctgaaacatactatttaggaatgtactaaaaaataacttgttaaatgaattatgtgcttgataagagatcagagttctataattgaaaaattgtgtttttaatataaggggagaagaaaaagagaaagaaaaaatagtgagaaaaaagattgatagaaggaagagaagtttgtacttaaatgagggagaaacatttttcaagtcccttattgagggctgttgaattatcttctgttaacaccattagaatattactaagttattccttattatagaaatacatgtatattattgagatatttgttggtttaatgcaacaatagaatgtttccagtatctgaagtggaaaaacaaagctgcaaataaaaatatgtgtaaaatctgtctcttttgagaagacattgattacagtttatctaattttctgcaataattttgacatttaaagttgatggtaattttagacctgaatgtacaataagatgattttaagtgctcttttagaatttaaagaaagatatacttttgatgatagagatagaagatacttttaactgctttgctagtgaaaagtctgttacattttgctgggcaaggtggctcacgcctgtaatcccagcattttgggaagccgaggcaggcggatcacctgagtttgggagttcgagaccagcctgacaaacatagagacgccctgtctctactaaaaatacaaaattagccgggcttggaggcacatacctgtaatcccagctactcgggaggctgaggcaggagaattgcttgaacccgggaggcaggaggttgtggtgagccaagatggcgccattgcactccagcctgggcaacaagagtgaaactccatctcaaaaagaaagaaagaaagaaagaaaaagtctgttacattttaaaatcttggtttgccttcttttttggggacttggatttcttgaaattaattttgtgagtaacttggtaaattgatgacttattttctgcctgggcatgcaaactctgcatttgatagtttctttcatatatggaagaaatgaaaacactacctttaagtagatttactacctttattccccccataaaggcatgaacagcttgtttatgtttatatgcatgcgtacataatctccaatttctctttgcagtgtgttttcaaaacttcaactgttttatgacaaactatatgtgtttgggagtttacaaatattattctttaatccaggaatgtgaatttttgaaaccctatcttcagattgagttgtccttactgttttagtgtttatctgtattctcagaacctctgttgcgtggtctgttttcaaaaaagtactgtgtaccataaactacagtgtttttgttttgttttttgcacatcaagatccttttagtcgagagaacattaattttgtcagtagttcttttatttagctcctttgtggggccttgttagattctgaataatttaatagcaatggaatcctttctgtgataaaaatctggtcattggtccaatacttgtagcattattcacatgatactcatgcatgcaaaggtgtgggattaatgcgtatgcctgaagagtgtgtgtcagagtgtttttaatcattgttgaaaatcaccctctgaagattttcgtgtgcattaattctcagatttgcttaaagtattatcacttctattttaaaatgaataatccatggtggcctagcctgaacaataatatgtaagaaaaattggaaaaattataacttcctttaaatttaggaataaggtctatattttttgtatatttgtatgtttgctatgtttgcagaattacagaataaattgtttaaagcatatttctttctatgttattttaatttttttacatttcttacccaaactgttgaaacaaaaagtttcagtcccagttagtacaacatccataaactttgtccacatttcacattttcagctttatcttaagactggctactttccatggtcttgtcaagaaaatagtcttttacaactcttgaagcagataaataaccatgtgggctttccttcatcaccccctttcccaactcttttcctcctcccagctgttccccctccttttgctcgtttctgacaccctttttcaatcctcagatggctttaatagaaaagtatatttttcataactttgatagctttccaattactattctaactctttctcactgcctggtgagatctcagtcatggagagagaagtctgaataaaagagacattcatagtggttatgacagtgaaggttaagtttaggctgctagggggtttgaaacaaaggagggattgaagccttcatcgcctttaccttatttgggtactaagtaagtgattttggaaatagtaaaatctcattatgaaaagagtgaaatctagtccggaataaatgtgttaacagtgcttaactttaactggaatgcatcttaacaccattcagtttttatactgattagaaaggtccactgtggttttggtcatatattagaacatatgctgttggttttttgttttgttttgtgtgtgtgtgtgtgttttttttcattctgctttgtaagtaccccttatcactgtagggaattttagaatttgaattaaaatatatcttgagttatataatgtaaaaaaaaaatttatataggctactccatggcattgtaaagaatcttaaaatagatataaaagtgacttcatcttacctccaatgtccttcctccatctatatctgttatctctagctattttcatcttttctctctgccaggcagttagtagaatagttgaagaatgattttatcagctctcattggactacaggataaaagacctaaaaatatgggataatttaatccaatggctagcaaatacattttgtgttatgtttatggttttcaaaggcattgataaaatcaaactatcattactgggaaatatgaaattttcaataagattccaaactaatagataaagtgataaaatgattgggaaaacaagtggtggtagaatctgatataaaaatagtttggcggtagcaaaaggggaaacgctaaaattctcaagaacccatcagccatttttactaacactgtgctcttcataagctatatctagggaactttgattatatgctgtaaggaacaatatattatttaagtgtatattgaataagtattcaataaataactgcaaaataaaagacagttctgaatgtggaaattcctattcttgcgagattgagccagacatttctagctaacattgacgttattgggctaacgtgggcatcatttgggttttgggtattaggtgtaacaaatgcttgctgatgcatagaggccaatctaggtctgtgttagttcctgagagtgtgcatgtgaacttgaggggaaggtttttagagtaggtcactcacctaagccagctgtttttttctctcttccaaaagagtaccggattgctcctttgcaggggctgacttgagaacatggcttaacttttaaggctagataaactagttcagccagaagtgtattatttccccccaaaattacatttaaaagcttctagctatgatcatttcagctgcttcttcctccctttctaattattcttgctatttctgttactgatatcaaccataccaatcactggaaaggagaatacttgggcaaaaatttcttttaaaagaaaaattgctggagagaaatatgtacacaaatttatattgaatatataataaaatacatatggaactgccctttgtatgtgaaggtgagttttgtttgttgtagtggtgtcagatctggtttgattcatttcagctttttccagtgttctttcttgtgatacgcatatatgagataggaattttgctaaatcattagcaggcccattggcttaatgtaacccaatctagtttcttgatctaacagtcctggaatatacaactttacctaatagaaaataattttgtttcagttaatgaaatttatctgtcaataaagaaatattaaataagtgcctattaagtgctagtactaaataatgagaatactctaattgacaagatagacaacattcttatccttgtggactgcgtgatgttagacacctaaatgaaaagaagcataaaaacttaacagaagcatcaggttctaggtaagggctcaaaaatctggaaaataaaggctaatcttttttgcttttctcgccctctttccttaatatagattcacattttttcctattcaaatgtaatgatattcacattttgtattgtttttctacatatactggtactgtggatttataaaataagtctatttccaaattacatgtattttacaatgattccacaaaggaacgttggctatttatgagctttggggaaaattacagtatatcagtactccctttgaaagattttaaactattaaggtcaatttaagatcagaccagacaagtgtggtttgtgtcatttttatatacggtattcagtattttttcctgcaagcttttgggagtgaagaagccattattcataaaatgaattcatatgtaacaccttaggctgatcgtaaagtgttaaaccttagagatggggaaaattctattgtcttgaattttgaatgtgggtaactttaagactgccatatgaattgccaagttgcaaaattgtttttgcatttcacttgcaagcaaggaaaatgtggactccttctttagtggggccaagcgcattctaacacacctctcaaattacacaccactgaaatgatactcacaatgggtttggctcatatgtttctagttagctactatgaatgaaagattcataactatctgtttcaaaaaacttccttatttgcactgcagggagcttaattgtttggtagcagggtcaagaattgcttttaaatactaagcatgcatggattgggccattatacactgaactaaaaaaaagatttctgtgcacaaagaaggctttagataaatatttgtcaaatcattgattactttgttggctgtggaagaataaaagtccctgagttttcccaccctgttggtaatttggaccaaatattttggtcactattttttatatatatatatatttatatatttatatgtttaaaatatatatatgtgtgtatatatattttatatgtatgtatgtatatttatatttatatatgtatatatattttatatgtgtacatatatatttatatgtgtatatatatatatatgtatatgtataacaaacctgtaacctttcccttaccttgcctattgagcattgtagaatacaggataacagggaggaagaagtcattcatacttactagacagatggttggcgtccctgtggcaaccttgtgatctaataattttccaagttctgtctacctaactgaagagtaatagctgtttactgtttgcttaaataacactaggcctgtatgcaagttgcagggggggtggggtgaaggaggggggtagatatataaattcatctctgcagttttatcaaatctgtaaaagaggtgtagcatacaggcacctcttttccaaaagaaaaaattcattagttcctcattttggttattccttcttattcgtggctcaagcaaaccattaccagagaatcttttttttttaattgatgacacgctaaaaattagttatttttgaagaatttttttcaaaggtagtatttgaatatattggtaaaagatggtggaattattttcctgcttttctgcagtaaattagtttgtacacttctggtgacatttgctcgactatccaaagaagatgaggctgttaaagaaattttaacaaatatttatgaatgcatgaaattgattatgtttattaaagtcacaaaaaatttctagcctttattataaattttataaattgctactgcaaaaatgagagagaattatagttaccaatgtgaattacttttgtttggtcagacattgacttcccctgattgccaccttgtcactctgtttactagacacagataggaacttctttcttcttcctatgatatgcatttgattcatgtcatatgctgtcaaaataatgttgtcctgagattatttgctggaatgataaaactgatgcagactatgtcagctagacttgttaatatcacattattctttctaataagtacttgtacttagaatacttacttgcttctgctgcatcatgtctctcttcttatccccaatgctttttttttttcttaaatctctctccatagtctcttgaaggggctgataaacacagttctaaaatatttcatgtatctatctccctttaacacataatttggtcctgtgcatatgtttaataccagggtatccccattcatttcctccttcttctgaggatgattgaaattttgtggcttcatgattgccttctaattttcaacttgacttaaaccagagcatagtaaaagaaccattaataatcacaattaataacattagaatgtaattttaataattcaggcctctattgcaaaatgtattatggagtcagtttaaaatgtgattcttctctctcttatatgtacctatgtccaagtgtgtatatagtaagctcttggagttcaggtgtgtcttggtgaggtattctgcatatatggaacatagtctcttaacatccttttgctgctgccttatttctgtcttgtttccacctaagattcttgaagagaagcttaatgtctatggtttcctcttcacttctcctacatcagcgagcccactgtggtctgatgctgagcttatgtctgtaggtcatctgccatcttctaaaagctaaaccaaaaggaaaatgtttagtttttacttgattttgctgtagcatttacctgtaaactctttgaggacataaactgtgtctcgttcactatgaatttttaccatttagggtttctggtactttgtagacccgtctatttgctgaatgaatgtatgtttgtaatgatttttgccttcttttaaataaaaagaatattctcttcctttggctcctgtggtggtgctgttctttcctggttaacatctacctctgctttgttacccatctacacttagatgttgattcagaagctctgctacttgggatggaataggtatccaaaattcttcctaagtgaaactctcaagtaagttctagcaccatctgttggcagcagtgagagccaatgctttatttatttatttatttattttgtgcctcagttcatggttttgtgtattctcagaacactcacaagttgaaaagtttctggattttctggaattattttcttagccttcatctcatttcatgttacagcctaagtttcattctctttctagggaacctcagtgtttcgtttagaacagttactctcagttcttcaggtgatgcctttcttgggaactctaactctatttatgactgaagctgaatatcacacaggcccctcagacttcacatttcccaaaattaatttcttgcttttactctggccccctcatctctttctgtctctctacttggagtgacttttatccaaatgacaaccttagaaatctgaatttttcctggactctttttcttacccacctttctgccccacctatatgtcaacagtcattaaatctttttgagtcagcaaatggctgatagagcactctcctcttccgtctctcactgctaatcatgttaactaccttgcttaaaactcttcagtggttccccatatgctcattagggtggtacaaatgaagactacgggcgcccgccactatgccctgctaattttttgtatttttagtagagacggggtttcaccgcattagccaggatggtctcgatctcctgacctcgtgatccacccacctcggcctcccaaagtgctgtgattacaggcatgagccaccgcccccggccttcccctttcttttgtattgaaattagctctcaatactgccacaaagaattctttgtaatgagttagccacaaaaatagttcagttctaggaagaatttcttttctttttcttttctttttttttttaagagacagtcttgttctgttacccaggctggagtgcagtgcaatcctacggagaatttctagcccattagaagaacacatccatgaccccccttctcctttacctgccatatgcaactgattgccagattttgctgctttcacattaaagttaaccctcgcctttgccccttctgttcagtttttcactgtttcaaggctatatgaccattttcttaagctattccctcctgaatgtctctgtatctgcctctgtcctacttcaattcatgttaattactactttcagatcagtcttgctaaagctgagttcagatgatgtcagtccattgctttaaaaactgctaacaaaggtttccttttcaggcttttcacaacctggtgactttctttaattttagcctcactacccgctttcctataaattactcattagccaaagtgaggtactatacactttcatctgtatacttcagttttcccagtctgtgcttcagtgtccctcttgtctatatttggaataactttttaatttatctctatatacaaatcgaatccatcagttaaggtctactttatctgccattgtagaataatctaccttctttggtacctctcccacttaatattttttttctcaggatcgcctaggcacttattttctttcgtgaactgtaatttatatacatgtgtgttacctgataccaggtatcaagctcctctaaggtaggctccatatctgatttttacttttggacaggccttaaagcctggagtggtgcttttgtgtgatagacgctcaatgtgtattggttaaatgatgaaataaatgaattttttcttgcatctttcatcatgagatttgtgccagtaacatcccaactctcaatatgaaaaggaaaaaaatactgaccacagtttttactgagcctaaattgaaatattctgaaaaagcttaatcatggtgacaatcagaatgtactctgttatttaggataaacccttctggcaaacatgcctgtttttcaggttcccattcttttaaatgtgggctatgattatgctctttaacatctcacagatttaataagtaaaccattgttttaaagtattataactttttccacaaaaaactgagctcttagaataaaaagccaacaaagatgatattttttcagtctgactcttttctatcctttcccctcattagagcacaattttcaagatttttgtattatgagtaagacagtgagagctttttgatatttcatgaactaaacccaaaagggcctacaaaaacacgctttagcacattgtttttaccaaatcctactgtaattataaatatttttaatagtatgaataatgttattttttcccttcctttctttttccctttcccttcttcttcttttttttttttttttgagacagggtctcgctctgtcatgcaggctggagtgcagtggtgtgatcatagctcactgcagcctcgagctcctaggctcaagtgatccttaagtcatgggtgggtggatcacttgagtccaggagtttgagaccaatgtgggcaacatgacaaaaccctatctctacaaaaaatacagaaattagccatggtggcatgtgcctgtagtcccagctacttgagaggctgatatgagaggattacttgagcctgggagtttgaggctgcaatgagccaagatcatgccactacactgcagcatgggtgaaagagcgagaccctagtctcaaaaaagaaaaaaaaaaacctaattaaaaaaacatgaaaattacaaataattgtggcactggaactattttgggtattattcaactgctaagaataaaatcagcataactgcagaatacatctgagaaataataaaacatgactttggtcagaaagttcaggaaatttttgtactgtgtccaatttattttgctctgtgatcagattctcgtgaatgctagtgttagacaaaagactgaaaatagagttactatatagagatgttcattgtttggggagaaattcaatagagtcttgaatattctcgtgatgtgcagaataattatatagagattattttaaatcataaatacatcttatatcttaacatcttaaatgttttgctttccagatatactcaagatatttctgtgaaaatgttttttcttaatatttgccaacaagagcgtcttatatttgtgtaatttttccaaagttgagtaataactgtaatgctagtttgcttatttttcataaaactctgagtgattttctttaatatatccttgaaaatgcatttttcatttattttttcttattcttgttgtatgtatatatcaagtgtggcatttattttgagagtcttgataaaattggcaaaagtagagttacaattttatgttaataatgaaagaatgacatataatatttgcctgattgtatctcttattttttgtgtgctttttgttaagcatatgtcaatttattttgccaacattattctatagacagagaactcctgtttttttctttcaggttagttcatgtgatcctggttaatggaacataaagtgagattttatgggtgacagggagagagatgaggcttgacttgggggcatatgggaaaagaagggggctgtctgttcacaaagatttaaatatctgataagaactgtttgccagcgcaattatgaataagtgtatttgtgcctaatttttattttttaaaagctcaggtgattataatttcatctgtaaaatgttgaaagtatagtctgattaaaataatatataagaaatggttttggttctttttgaatcaaaaggtgtgtaaacctggagaatctgcagagtgccagacctctgcttttgtcttttcttagtattgtatcatgttttccttgatattaatcttaagatgacttcatatatgtcaatattgtttaatgttagccatccacctatttgggataggaaaaaaagtttttccctgtgtagatttgtgtggattgccgaatcactactatgttggagggagattattttgcttgagagtaatattgaaaaagctcctattttctcccttcaaaaaaactggcttctgaaaattccgtgacttaatgtatcaagaacccaactcctcaagtgatgttcttattaattaatatttagtaaatactacacacccaacttagggtaatttgttggggaacttatctcactacctctgctcttaaaattcttttttttttttttttttttttttttgagatggagtctcttgcaggctagagtgcagtggcgtaatctcagctcactgcaacctctgcctcttggtttcaagtgactctcctgcctcagcctctcgagtagctgggattacaggtgcccgccaccacgcccggctaatttttgtatttttagtagagaaagggtttcaccatatcggccaggctggtcttgaactcctgacctcgtgatccacccgccttggcctcccaaagtgctgggattacaaacgtgagccaccgtgcccagccttaaaattcttaaatctcatttccctccttttattattattcaatagttaactgtataagccagaacagtttttttaaaaattggatatctcccagatttcttccaactctaatattctgtaagtctttggtttttacttaggttaattcttaactgcaatggaagaaaagcataattccagtttctaaggtaatacttaacatttctttacattattctaaattgaatggaaaactttatttgtaaaataacaaccaaaaatatctattttattctctggggaaagacaactttgtaatatatttttccacttgaaatgtttttgctttgcaaaatcctgttgggaaaacagatttccagacagcttaaaactgacaaatgagtattttgacaggtattcctggaaggagagctgttgccaccaaccatttcaatttccttattctaacaaccatgtttagcagagaagaagacatatctcagtttgaaacaaatatttagtgttgagagaggtgggtgaatataagccttttttaatgtattggaaaaatagggcatttagttcactgttttggaaaatagagtaacaatgaggataataaagtacttctttatggcctaagactgacctgatactgtcaacttcctgtgttccattcagtagggtgttcctagaggagggtttcattttatgccactgtgtcatttaacggcttttttctgtgtgcaacctgttgtggctttagaatagaaagcgtcaagataaaacatttcatagcagaaacatttttctgcataaaattccactggtgaacagtagttactagaccttagtagaactagtctgcttctgtagaaataatttgtgaaaatggtagggatgaactctgttgttctgtccatatttaatttaccttccaatttgtaaacttcttattaacattgatatattttgaacaatattatttagatttccttcaccatacagttattttttgagtagaatattagaagtagtcatgcaatctcttgttcttaggtgctatttgccaggcccacacacattgttagttgctgtcattatttgtctccatcatcattctcaccaccaccatcatcattgtcatcatatatatatatttaaacatcagagatggctatttgactggcttgtggaatttgtgaaaagcataaatctgagaatcttaaaatgtgagacctgctgtttaaagatagagcaaatgtagttatggatacttatagaatttagactaattccttttggtagtaatgactgagtgattttggcttatttcaaagaatcgagttagacatatgtttgaatgaccccatagagtcttactttatatgcttaagcctggatgaaaatcaatttcatttagctttaactcggataagggtttcatggtcattattatattctttttttcttaaaactttccttttttttttttttggagacagagtttcactcttgttgcccaggctggagtgcaatggcacgatctctgctcactgcaacctctgcctcctgggttcaggcaattctcctgcctcagcctcccaagtagctgggattacaggagccccacattagctcccaatgtccagctaatattttgtatttttttttttttttgagatggagtctcgctctgtcaccaggctggagtgcagtggcgcaatctcggctcggctcactgcaaccttcgcctcctgggttcaagtgattctcctgccttagcctcccaagtagctgggactacaggtgcccaccaccaggcccagctattttttatttgtatttttttgtattttttagtagagacggggtttcaccatgttggccaggatggtctgaaactcctgacctcaggtgatccacccgcctcgacctcccagagtgctgggattacaggtgtgagccactgcgccaggccaaaacttcctttctttctttctttttttaaacactaaaacaaactgctgaagagtattttttttctctgttaaaacttttaggccggttgcaggtggctcacgcctataatcccagcactttgggaggccgaggcaggcggatcatcaggtcaggagtttgagaccagcctgaccaacatggtgaaaccctgtctctactaaaaatacaaaaacattagctgggtatggtggcacgcgcctgtaatcccagctactcaggaggctgaggcaggagaatcgcttgaacctgggaggcagaggttgcagtgagccgagattgcgccactgtactccagcctgggcgacagagcaagactccgtctcaaaaaaaaaaaaaaccaaaaaaaaaaaaccacttttctccaaaagtagatatgtgtcaaaaaccaaaatactgttgccttttacaagacttttgtaattcctttaactccctgcagacattttgaaaatcacttctttgtaacactaatttactacagtttacttttctgaagaaatctctctccagtttctgttggccattttttatttagttcttctctacccccaataatttcagtatctcattttcttttaataattaaaacaatttttttttcttactgaaagctactgaagggtacagtttcttgatcctttcttctctctttctgggtgcatctgttattgtttttttcctgtatttatttatttttgccctcagcaagggactatttttcaaactctttaacatctgattgctgtaagatctgttggagtagcatgtaaaagtcaccagttgatatgggtagaaatacaagtatggaattgtgcacccatgacccttggtagtatttatacatgagacttttacttgtagtctacagtttattgtattcaaataacttataaagtgaaggaatcactactaggcatcactttttgggataaaggcttattttgtttcatttaggtacttttttcaggttcttttgttaaagtctgcctggtgtgagttttgatttgcaaactgaaaaagctttaaaatgctaaaaattggctctgctcctttttgtttggatttctctgggaattctaagttggctatgacctcataacttcaagggcttctaaggtcaattataacctgatagatatcattaaacaaggattaatctcagtttatagaaaaattctgactttcaatataaaataattcaatggaaaatgattaatggtcttctgtttttggagagtgatattgtacttgacattgataatgtttagttttaatggttgtagatactacttgtttttttattgaattacttgtattagatcttcattccccagaaagtatgagacctgatgttcttatctcaagatgagagcttaaaggaagaagaggtcaaggttttatttaaattgtcttagctgaacctttccctttccctaagatctagcacctcagaattgctgacgtcagacatagttattgactgaaaagagttaaattgataaagtataatttctggcttcagaggttcagacattactttatctggttgaagtttcatcaagccctgaaaataaaatctttaggttgtatagtcatagatttagagagagaaaagttcttcaaaggcctgttggttttacagtttacataaaatcagtcctcggttctggtaacctttgtctgatattttgcctctctcctgctgatcctggaatatttcttaatttgcctggaaccttgtggacttgaacagattgtctcttgacttgtcattcagctccttctaacttgactgattgatatggtttcactgtgtccccacccaaagctcatcttgaattgtagcttgcataattcccatgtgtcatgagagggacccggtgggaggtaactgaatcatgggggtgggtctttcccgtggtgctgttcttgtgacagtgaataagtctcacgagatctgatggttttataaaggggagttcccctgcatatgctctcttgcctgctaccatgtaagatgttactttgctcctccttcacctttggacatgattatgaggcctccctagccatgtggaactgtgagtccattaaacctcttttcctttataaattagtctcaggtatgtctattattagtgtgagaatatactaatacactgatagaatatttttcaaattccagctttgtgtgaataccatgccgaatattgttgtgaatgaaaaactagtcatagttttcataatagcaagaaatctacttgagaggtaattaatttttgtatacctttgtaaaaaagtatggggacataaataggggtagaggcattggattatgtatgttctgtgtgtgaaatcattctggaatttgtgattttgatgtctagagtacaacactggctatggtatgggaaggctacataaaaatttcataaacaggatggagaaagaagagtgccatgcagcgtgtgcatatatagccttgggagtttagtttttttctaattttatcatctagatgagagcagcatacttttctttataaatactgtttaaagttgagaatctctgagtcttttccattaaggaacagaggccccttgttgtgaagctggcacagtcactggtgcaggatggtaaattgccttgctgtcaactctcctctgcctcttattttgttgcctcaaacatacattgttggaagactaaggcaatgatcaggctctttctgtgttctctgattagtgtactttctccatttattttggaattgacccacatgtgccatcttttagggttgttgaatattgtattccttatttcattgccttgctttgcatttttatttattttttaccaacttggaaagtttaatgtttgaacccagtcagatatcactattaagcattagcatacacactcattttccctcctatccaggtatgattatagtctgtcttaggaaaaaaaacaacaacaagcaactcctatctattttaaaatataagcctgtatgagtaatactaactgtaatcttttatttaatgttttctttttaaattatgtatttttgctttttgtgggtatataaaaggtgtatatgtttatgggggtacatgagatgttttgatacaggcatgtaacacataataatcacatcatggaaaatgggctatctattcctcaagcatttaccctttgtgttacaaacaatccaattatactattttagctattttaaaaatagctgtaaccactatgcagaatagtacaattaaattattattgactatagtcaccctgttgtgctatcaaatactaggtcttattctttttaactattttttaatactcattaaccatatccccacttcaccttcccagcctctggtaaccatccttctatactctctctccatgagttcaattgtttttatttctagattctgcaaataaatgagaacatatgatgtttttctgtgcctggcttatttcacttaacgtaatgacttccagttccacctgtattgttgcaaatgacaggattcattttatgaatagtactccattgtgtataagtaccacatttactttatccattcatctgttgatggacacttaggttgcttccaaatcttggtgattgtaaacagtgctgcaacaaatatgggagtgcagatatccctttgatatactgatttcctttcttttgggtctatacctagcagcgcgattgctggatcataatgtagctctccttttagttttttgaggcaccgccaaactgttctgcatagcggttgcagtaatttacatcgccaccaacagtgtatgagggttcccttttctctacatccttgtcggcatttgttattgtctgtcttttggataaaagccatcttaactagcatgagatgatatcttattgtagttttaatttgcatttctctgatgatcagtgatgttgagcaccttttcgtatgcctgtttgccatttgtatgtcttcctttgagaaatttctattcaaatattttgcccattttttgaatggattattagatgttttcttgtagagttgtttgagctctatatatattctgattattaatctcttttcagatggatagtttgcaaatatattttctctgattctgtgggttgtctcttcactttgttgtttcatttgctattcagaaggtttttaacttgatatgatcccatttgtcccttttcgttttggttgcctgttctcgtgaggtattactcaagaaattttcacctagttcagtgtcctggagagtttccccaatgttttcttgtagtagtttcatagtttgaggtcttagattgaagtctttaatctatttagctttgatttttggatgtggcgagagataggggtctagtttccttcttctggatatggatatccagttttcccagcgccatttattgaagagtctgtcttttccccagtgtatgttcttggcacctttgttgaaaatgagtcgactgtagatgtgtggatttgtttctgggttctctattcttttctattggtctatgtgtctgtttttattccagttccatgcctttttggttactatagctccatagtataatttgaaatcaggtaatgtgattcttccagttttgttctttttgattaggatagctttgggtatactgggtcttttgtgggtccatataaattttaggattgttttttctatttctgtgaagaatgtcatggatattttgacagggatttcattgaatctgtagattgctttgggaagtatggaaattttaacaatattgattctttcaatccatgaacatagaatattttccattttttggtgtcctcttgaatttctttcatcagtgttttatagttttcatgatagagattcttcacttctttagttaattcctaggtatttaattttatgtgtggctgttgtaaatgggattactttttttttctttttcagattgttgtctgttggcatgtagaaatgctactgatttttgtaatttgattatatatactgcaactttaatgaatttatcagttttaatagtttttgatgtggtgtctttaggtttttccaaatataagatcatatcatctgcagacaaggataatttgggtttttcttttccaatttggatgccctttctttctttctcttgtctgattgctctagctaggagtactgcattgaataataatggtgaaagtgggcatacttcctgtgtgccagatcttagaggaaaggcttatcaggttttccccattcaatatgatactagttgtgggactgtcatatatggcttttattatgttaaggtatattctttctgttcccagctttttgagggtttttatcatgaagggatgttaaatttaatcaaatgcatttttggcatcaattgatatgattatatggtttttgtccttcattctgttgatgggatgtgtcacattgatggatttgtttatgttgaaccattcttgtattggtgggatttatcccacctggttatgatgaatgatcttttaaaggtattattgaattcggtttgctggtatttgtttgaggatttgtgcatcaatatttattggagatatggctcatagtttccctttttggtatgtctttggttctgttatcagggtaatactgggcttatagaatgagtttggaagtattaccctctcctctatgttttcagaatagtttgagtaggattcgtattaattcttctttaaatgttttgtagaatttagcagtgaagccattgggtcttgggcttttattttactgggagattttttattacaccttcaattttattacttatttttggtctgttcaggttttggatttcttcatagttcaatcttagtaggttgtgtgtgtctaggaatttgtccatttcttctagattttccagtttattggcatatagttgctcttagtagccactaatgatcctttgaatttctgtggtatcagctgtaatgtctactttttcatctctgattttatttacttagatctttctttctttcttagtatggctaaaggttcatcaattttgtttatttagaaaaccaacttttagtttcattgattttttttatattttcttctttttaatttctcttatttctgctctgatctttatcatttccttttttctatgaattttgggtttggtttgctcttgcttttctagttctttaagatgcattgttgggttatttgaagtttttcttcttttttgatgtaggcacttatagctataaactttcctgttagtactgcttttgctgtttcacataggttttggtatgttgtgtttccattatcatttgtttcaagaaattcttcaatttccttcttagtttcttcattgacccagtggtcattcgtgagcatattgtttaatttccttgtactagtatattttccaaaatttctcttgttattgatttctagttttattcctttgtggtcagggaagatgcttgatactatttcaagttttctgaatgtttagacacttgttttgtgacctaacatatggtctatctgtaaccataattttataatgaaaacacaattggaattctgtttttcctactgaagtttaagagactgaagactttttagtgtataaaggtttaatttgtcagtgctagtatctttcttaatggataaatattaaatacagtagatggtcattataatttttttattgcataaaattagttgtgttgaatcagatcaaaattatggaagtatagctaattgttgccttcaaagcataatatacatttatttggcaagaaactattcagcttcccaattgaattaatagatgttccttttaaaattagtcagttaatcaaaacatgttttttgaggcatttttagtgtattatagcactctgttggcaattatgaaatccaaaagaaaacataggggatataacaataccatattatgaaatattaacacataagctaattttgataatatggtttatataagaagtattggagaagggagaaagtttaattcccctgcatcttttaattaaaaaattttaaaaaaaaatctgtagaagaatccagaatccaggctggagtgcattgaatagtacagtgaacatatatgcttcctccccattcactgattattagcattttacagtatttgaatgtgttcttccctgcccccttgtatacatgtatgtatatttccctgcctccaaccatttgttagtaggccgcagacattaaggcacttcatcactgattatatatctcctaagaacaaggacattctcctacataaccactatatcactttcatactgaaaaaatttagcactcattgaatattatcagctatacagtctattttcaaatttctgcaatcatatgaaaattgccttcatagctcttttgtttgtttaagctaggatctaatcaaggccaatgtgttgcgtttagttatcttgtctctgacaggccttctttaatctgtaccagtgctgtacagtatggtagccactagccacatgtgaaattgaaattgattaaactttaattcagttccttacataccagcaacatttcaagtgctcaatggtcatatgtggctaatggatactctgttgaacagcacgaccatggaaagttctattggagagatctggaatgtaccccacctctttttgtctttgtgaaattgattttttggagttcaggccagttgtcttgttgaatgttctacgttatagatttgtcttgtttcttcatgattagattcaggttgtggcagattgtatctttcaaaactagctacactaagatacttggcctatctcacatcctttttaaaaatgtgactgacattcctgcagctgagaggtggggtctttgctctccttggatgtggacaagggcatgtgactgacaggtgaccaatgaagtaaggtagaagtcatgctatgtgacttaagactggctcactctttcctggtatgctggcactggggacttagtcatcacactgtgaggaagcctaggcggtgtgaagatgttacacaactccagctaaggtctcaagctgacagtgaataggccttcagatgattccaaccgctggcttttgagttttccagttgagtaggcatgaggagcagatagctgttccagctgagatctgtcagaattcttgatgcaaagaaactgtgagagctagtaccttacgctattgttcttctaagctgctaagttttgaggaatttattacagagcagtaaataactaatgcacaggttaaacagtattacaagagtactgcataaatgatggtctgcatttcctgttgcatcacattagggggcatgtaatgtcagtgtgacttgttactgatgaggcttgatcacttaagtggtggccacttcatctttttctttttctttttcttttttttttcttcagacggagtctcgctctgttgccaggctggagtgcagtggcgcgatctcaactcactgcaacttctggctcctgggttcaagcgattctcctgcctcagcctcctgagcaactgggattacaggcatgcgccaccacgcctagctaatttttgtattttttagtagagatgaggtttcaccgtgttggccaggatggtctcgatctcctgactttgtgatctgcccacctcagcctcccaaagttctgggattccaggtgtgagccactgtgcctggcccatctcttcatcttaaataaatacctttacctctttgttattaatatgcaatctgaaggaaagtttaattttggatagaatcagcttccaccaagtttcttgtcaagaacatttcactctacaccactgttttgagggtatttaaaatggtaacaattttagaaatcattttattcagtctctccattttgtagcttgatttaataaatatttctaggtttctattacagttactagggacataaaatttatgagatatgatcattatccacttggagcttatggatgaaaactaacatgaatggcatttaaggggtgtagattgggtaatacttaatttgtatttcaagatgattcaactgaaaggtttttattttccaaaagactaaaatgatgttattatgatgactgtagactctagtctcccaaggctggtcaatgctgttttctgaattattttcttatcacacagaattaaaagaaaacacattttaagtgcactcttatgttagacgttctgttagtcctgtagtttaggggtttgactgtatctttttctgaagatagaaatatatgtgttttaaaatatagatctgtcatgttccaaatttcttcctacgtaaataagaaatagtgagctaaatgaatgtctgtgaagtgaaggctgtcaggatactgttgtatgatttttgaaaaaatataaggtacaatgtattaacgaagtatgctagtatctaatatattgtcctaaatagttgttgattgggtaaattctatatagatgaaccatgctttttaatactggttgcatgcttatgaaaaaaagtggatcaaaggtaactatatagagcctttaaagtttttctgccaatatgaaaccatagttttcttattgtgtttgtttatttggttctgatataagaataattaagaaatacatttttcatttgtttttggtttgatactggcaaatttacttatatttttctgtcccaaattctatttgaatttcttggtagaacatataattgaagacaaagaagaaatatgtccatttatttcattgttatctctttctggtagaaccctgttgtctagactactttgctaatgtggtcagactcatgatacttaatttctttgtaggctctacagtttcacctgttacttgctgctagactgaatatttagcaacattttttcctaagtaactggctacaggaaaaactccataaatgattgaataaatcaatcaacagtttagtaagttaagtcagactacaactgttgccaagtaaaatggtgttatatctttatacagagggaagatgtgattagagctgcttcagaattataggaagatataagagtaatcctatctaggtggggaaggagcaatcaaaatacaaatcagttctggaaagtgtacaattctgagaggcaagttgcgataggaagctctgtatgtttaactctgggagggtgagataaaggtgaaagaatatagaattatttaagaaatggagcaaaactacagagtaaagagttaatgtagggacaggaaggaatcattgggggaagacttttgaatggcagcagacaggaagggacgagggtggagagaaagctaaatttttgagtggaggtgtgggtttgggtacttaggataaagagaccagtttaaggatttgccgaggagggaacccatagaaagagatcactgcttcaggtggttccaagatgaatactttctttttttggatacatttagtgctttacatttgctttttgtgctaaatcctttactaagtttatcatttcatgcaatacctgcaacaacccagtgacaacatctttattttacatatgaaagaaacaggctcagagagattgctcgaaaatcagtggtccttctgagatgtcagaagctcatcttggtgggaaagggggaaagccagagtttcaggagttcagcttaccttgccccttttctcctccaacaacagtatctcagttttaatctgttgaatatataggttttgcatgtaagatttcatgtcaagaaaaaagcaaaggctgggtgcagcagctcatgtctgtaatctcaagatgaatactttcaagtgtcaaggagaacttgattttccaacaacttgaaaacagaaggaattggctgatagactgcagaggctctgaaagtgtgcctctagatgagtgatgtcatctatactcacctttggtagatgtaatctgtattcagcttctctcctgacatctctaaccactaggatcaagctgacctgaccactggacagcattctgggtatgcgcacatcaggccaaggtggtatcttgatttgcagtcgcaaggtttaggcttcagaggggaagcagcactgcttccctttctaccttggagaagtggagtagaaagtaaccaggtggcagaaatgcccagggagcttaatgattgcattggccttgtcacatcacaatatcacagcacacattgctcagccagtccacattcctgtctctaacacttgggggaaaaagagagctaatattgttgttctaattttgtaagctaatatggtagagacttttttgttggtttctttcacaaatttcattcacatttttagtgaaatcttgtggactatttacttggaacacatgaagttgggtgttcaaagaaggaaaaataatttccaattatggaaaaagggtttgagagttctctggatctctttatctatggtggcgtatatgactgttgctctgtttggacagggtctaaggatgaatagctattcacttattcctcacttgctttcaagccatgccaactactaaatcctcagatcagctactaaataaaacaagaatatgttattatgtgactcatccttcttgtttttccccctgtatttcaaatttaaaatggtgtcgtgtgaagagattcaagatttccattcctgcttttccctttcctgccaagctcatgacctctgccagctccatcttttccttcctctgcttacagttttggtttgagttctggattcttggagtttatagaacaagagtcatttaaactcttttttttttttttccaaatggaacaagtgtcttaattgaggtcaggccaacacttagtgtgacagaatcttctcctcaccttccttgggacagagagaattcatgccaaggagaatggtgtgaaactgtgaacccaaagagtgtccattgggataaagctgatgcccagttggaggcacagcacagtgactgttttgccaggctctgttgttctgtttggtcccaagccagatggtggcctggtgggtgaaccattggctctggcctttctttcacctcctcaggtataagatgaaatacccagctgtccctttccttgcatgagtgaccctctggaaacagtaattgccctcattgttacttaatgtttacatgattttgtttaaatttggcttttaaaaaatatggtttattggtagtatgaaagtatcaaattaataaaattcaggagtggaatttatttaacaccatattcgagtttaaacagagcttctggagtgagcatgagagaggaagtgggcagatttgaatgagattgaacgagtatagttcatgtattatatatatcattattttgatcactagaaatacgttcaagatgtgcttgcattagagtttttattacgtgttatcttttagccactttgtaacatacataagatggaaatgagcatccaaggtctccctcaaatggaaatatatccactgaatctgatgcgacttatgcttttgtccctggattgtactgtagtattagttatgccttatctgtataatggtaaaagcaatagcatttacaggtcttacgatttgtccagtctcaactgtagtaggagctatttgaagctatcaagaaggaattctgaaaaagacacaaagaccttgtcattctacagagcttcatcgagatcttccattttcataccagctttgatttctatgattatgatgcattactagtagcattcttacaattttacttaattttggctttattaaaaaatctttttaaaagtaacaagaaacatctcggaattttcttgataatgtttcggagacacataaatgtttctaaacaaagcaaaattactttggcatgttgcaggggacaggggtggtaggggtggtgcatgtcttcctgctgtggccctgtccagagtctcttgttcagccctggatttgcagctcaaagagatatcctaatttctgaaggatctagttgctgcctgagtcacatttctttaagccacagagctataaataaatgatggttatcccacaattgccccttttaccataatgtaactgaaatgatgcaactaatattgttgatgttgttaggaaagtaatggttcttgccttgcctttctcataggattttatgataatgcaatgagatagtggattcaaaggtatttttaaggtgttatgtgactgataaatataaagaggcattacaattattactgttattacaattaattttcctactatttttatcatgaccaacatcatcattattaatatcttcactgtcggggtataacttctcaggcccatctcctctacctcctgagcaggagaagggaaatcatacccattggttattacaattataaagacttttttttctcagataatttgggggctcaatataatgtttctgactctgggcccctgaatttcttttaattccattgctgggaatatttcactcctgctaaaaggctcaacttaggctagaggggccagctctttaggggaatttatttttattttttttgtttttgttttttttttgagatggagtcttgctctgtcgcccaggctagggtgcagtggcatgatctcagctcactgcaagctccgcctcgcgggttcacgccattctcctgccttagcctcccttgtagctgggactacaggcacccgccaccacacctggctaattttttgtatttttagtagaaacggggtttcaccatgttagccaggatggtctcgatctcctgacctcgtgatccgcctgcctcggcctcccaaagtgctgggattacaggcgtgagccaccacgcccggcctaggggaattttaatagctctaattaggagctgctttcttgatatcaagtaccattgctaatgattctgtattaactttgtgtctcagtctgataactggccttctgtcttgcttgtatgatgaaattctcaactatacctcaaatccagtcactgatttcctgtattggcactttgccttggccttagaaacctgcccagaatctcttaatcctccttgattttctacacttttctggctctccacctcccccacgcccatgcctacacacatgccagatttaactcctgcttgagtctcagtgtattttatcatgtaagggagacttcatcagaagtctagttaacgtctaacatgttgtctgagctatggtgtaagtagagtatggtaagaaggatactaaggaggagggaaagtatagaggagggagggaggagagagcgaaatggcatgaacatagcataaaagtacaagggacgggtatattctttcattcactaggttgtgacctttgtaaaggcaaaaaatcttgccccctttttttactgctatgtccctagtgtctgaaactgcccagtattgaatctgtccattaaatatttgttgaataagtgtttgtggaggcacactaattgaccggtttgtctggaggacacttgaatgtgagctttttaggactgggatcattgtggccttgtttattgctatagtgccatatagttttggcaaaatgaatgaataaatgttgggatcagtggcgttgaggctagaaggcagaaattgataatgtggattcttttttttgttgagatggagtctcactctgtcgcccaggctggagtgcagtggcgtgatctcagctcactgcagcctttatctcccaggttcaagcgattctcctgcctcagccttgctagtagctgggattacaggcacacaccactacgtgtggctaatttttatatttttagtagagacagagtttcactatgttggcctggctggtctcgaactcctgacctcaagtgatccgcctgcctcgtcctcccaaagagctgggatttacaggcatgtgccaccaagcctggtgataatgtggattcttgaatgctgaactaaggatttggtccttattgtgacaaggagagaaacagtgtccttctgatcttaacatttacttttactgtctaatgtactaagaattttgttcttgcaatgtactgtaatttgagccgaagggttcagaaagaaaatccttttgatactaaaaaaagaagggatatttttacataagatgcttctttttgagttaatataaatccagaatcttaattggtagatatgtttctaaaacatggtctttaaaaattgcttatatggatagtcaacatgtttacacacaacaatgctgtaagtatgtttctattcagtatcatataaataatagctatggtttcaagtactcagcaaagtgatgaaaagcatccactgttttcattctcactggtctactttggcatcctgtggttggtgttgagcagttgttcactgcttgaggctccttgaatctgggaaccagagtgaatatttccaggtgtcagattcatctcttcatctacctgtacttctggactctaacattgtccatattagaccataaagatgtatacttttcaaacactatgattctggaaaatgaaacctatctagagtacaacccaaatgctcaaattgagtggggggagtttatcttgatagacatatgtaaaggaatttcttttttaggtttttatcttcactgagtgattggactgcttatgggatcaaagcatcttggattgcaataaacattgtttcatgtaaataggagaatttttttgtgtgtgtgcatgtgcatgtatgtctgccataggatgtagtgtaaagccaagcttgcttgtcagggacaattgctttgttagctatgaactaaaactggagttggaattagggcagggccgtggcaaacactcactgagcactggagtggcaggtgtatcctctacagggtgggagatcgttgtcactcttggctccccgttttcttcttatcttcatccaagcacccggcaggtttagagagatagagtccaattctggaggcagttgtcctcagcagggagaaacagaggaaagttatctgaaatcttagacaaaaggaacaaaaggcagtgggcttttaggtttctgaagtgtaactattctacagaaggagattcgtttttcttagatgaattactatagtctactagattttgtttacataaggaactgatttattttgggcttactggtgtgtggaagcacaactaatattccctaactaatgttagaaaacagaaaataaagaagaaaatatctataatctcaacatgtaatcacttaattttatatttgattttaatgaacaatgcaatatgaagatattatgaacaatatgatatatgttgttttgattaggttaatttttcttcctaccactaccactatcataatggttattgtcatcatcaagtatttattgagtcccttctctgagtgaggcatagtcgcagccagagtgaagaagataaacaaaaggcgtgtgttttcttgtaaggagattattttctattttggactgaacatatatcttggaaacaaattacaataaatgatttattcattaggcaaatgattattgagctctattatgtgcaggccctttgcttagcatttgagaaataatgttgaacaagacattcctgctcttgagtatactgtgcagggtaagtgatagacaagcaaataagaatttcaataaattataatgcatgaattgtcaatgaaatgccacagacagcgagtgctataaaaggatattatattaaaagatatattgaaaaacctattggacagtgttggaaaccagaataaatttttttttaattacttgtttcctatattggcccttagtgagagcctaaggcataatcttaaatagtcaggtaatcaatacattttatgacaaattaaggtaatatagttcaacagtattacatttagctcttccaaaagaacactaggatggatcttgacaaaaatagttaaaagggccttaagttctctctagcatcagttgtctcagtatttgcttttgctggagtttaacattaacatttgacaagtacataaagtgctgatgttctatggtatgaaaggaagagaagactatacgttttatattctggattagcaagtgtcaaagttagcattccattatgaaaattaggaaaccagataggctttttttggtgaggcggggctaggcaatggatgttttcgccctttcaggaggatatgtgaataaaagagaaaaagcttagatctgttatacattggatattctgtctttacctgacataaaacttgttgcagaatagaattttctatctagagttattccattttaaactaactgggcatattttcttttctttatatcagatgaaaggaatgaaagctacgtgtttatactttatttgagttgttcagatccagagtgaaaaataccaagggagctgtggaatttctctccctggagatctttaagaaaaggtgtaggtattcagacacttaattcactgaaattgtttctgtagagttttgtgtgtcctactttaaaaaaaaacaagatgtgtaaaaacccagacttagaaaattgatattattgaggataattctttcctttctaatcctcatcactttagttttcctactaggtgaatttatttggtaatagatgaatacttaaaattggtgagcatttgacttaagaatattacttcataatattttaattgatatttgtgaagaatttcgaagttttcaaaacattttacattattatatcatttgcttctcagtgatcttatgcagtagacaaggttggtattatgattatttcccattttgctgttaaggaatctgaggataagaggctctgagatttgactgtgggttattaagttgcggggcttggcacagaccttttgatagcaaattctctgccttttttgcatgcatgaggcattacttttttttgttttgtttttgtttttgattttgagatggagtcttgctctgttgccaaggctggagtgcagtggtgtgatctcggctcactgcaatctccgcctcccgggttcaagcgattctcctgcctcagactcccgagtagctgggactacaggtgcctgccaccacgtccggctaattctttgtatttttagtagagacggggtttcaccgtgttagccaggatggtctcgatctcctgacctcgtgatccgcccacctcggcctcccaaagtgctgggattacaggcgtgagccactgcgcctggctattttttttcttaaattggagtatttgtcctgttttatattgaaatcaagtcactgaagattctggagaataggataatatctctggatcattcatttcttctttctgtaagctgaatgatggctgagggaaaggaaaatatgttttgggctccccccaagttacttttttgatcatttgccactttcttactaatgcagtgttgtagatggtaactgggggttctctatcagttcacaaaaataatttaacttataagattactgaattggtagtactggaactaaccagctgctcctaaaatagtgcattttggtttgaaaaacagattgggtttctaggaaatggagtaagtttgttaatgtactaagattaagcactttctgataaccatattagctatatatagtatccacttcagcttaccattaataaattagaccatgcacttaaaagaaccaaaataaaatcagtttattaactattgagtctttacattagagccacagtttatacaggttaagttttaaagttaatatccaaatgtgtacagcaaataatctctagcaagaaaaataggatatattattgagggttactaggttggctttatgcattgagataattttactttgtagttctggtttgaaaagtttgtttattttctctgaacacttcctgcgtacaaaatatgtattgactgttgaggatttaaaaatatcagaaaaaggcaaagaagaaaggagtcccttgttaacccctctgttttagaatagttttggtaagaaaggagggtgagttcattttataagaagaactagttagtagggcactatggtaactaacataattcaggagcatgcaaacagtagtggacagtaggagtatatgcttagggggatgcttgtagatgagtttgattagctaaattatggtgggccatgaattccaggataagagatttgttgtttttcaatagaagggattccagagctcttctaatccaggacttgcttttcaggtaaggaaaccaaattgagttgctcaaattactgagtagaggaactggggctggaacccaagcttcttgattaataagttaatgtttcttctgttatacgatctcatgtgttgccaatgttggttctgggagagaggaaagcaaaataaaagcagtgctttttgaataaattcttatagtcttagaaaaagaagattgattagaagggggaagttatttaaaattggaagaccagttaagctcattttgattatccagacatgtgatgatggagtcatcaatggctagagtgatgaggagaaaggaagtgccattaaaatcagtgagaaaatttgaagagtaagcttatggtgggaaagatcaggttcaattttgaacaaattagaaatcaagcagaaatgtttgattaggcagatagcaatatggggctgatattcttggtgttaaattatatttagcagctaaagaggattgactagctggttagcatgcaatataatcctttcacacagtgctactgagggcagttgagttctaggaagtctccccctgactcctgcttcaaggaaaaattagttctctattagatgcatcactgactgaaacatttgtttaataaactggtataggcaaactcacctcaaaaagaccaatactggcctgatgatataatcgtatgatgcttctttttctcctataaaggtgttcatagaatgtgcaatcccatgtaaaagctgtgtgttaaagaaaatggtgtaactcttcaaccctcataaggctttgtgagattttatggcatgatcgcatttattgtcatgatagtaattcagtttaataatgttaactagtttcatttggacaacgtatttgccctggtcattcatcctttgttgttttaaacttacatgtactgggaaaccacatataatagctcttgatgtttctactaaaaggcagagaacttgagctattatctagatagtctatgaaaattttaaagatggggcagtgtctttgtttaatttctctttgtgtatttccaaggatttgaaagtgaacaatgggaggtctatattttgctagcaatgattgctacactcacctgacaaaataaaagtgatttctttttctgtggtttaaagaatttttttttttttttggatacatagtcatagatttttggagtcagatggggactgtagagactgtctaattcagggataatacctggtttccatttctatgctgactttataatttagtagtggctgtttacagcaatgttgagaattcccacatctttgggttcagcttggcattaaagagtgtaatgataaattattgatgttttttatgggaacggggagggcccgcacaaacgtcatgtacttgctatcctgatctactctagttcttttgtttttcaggtgaggaaactaaaatctactgaacttagtctataataagcagttaggttgtaaagtgttcttttatactcatttctttgaaacaggtagagtttttctttacaaataatgttaaaaataatggacaattggccaggcatggtggctcacgcctataataccagcactttgggaggctgaggtgggtggatcacgaggtcaggagatcgagaccatcctgtccaacgtggtgaaacccatctctactaaaaatacaaaaattagctgggcgtggtggcacatgccagtaatcccagctacttgggaggctgaggcaggagaatcacttgaacctgggaggtgagccgagatcgcgccactgcactctagcctggtgacagagcgagagtctgtctcaaaaaaaaaataatagtaataaaaaaatagtaataatggacagttaagtttttaggctagttcacaaaagacttttaaaagtatttgttaacgttatccataactacttggtttaattaaattcttgtttgtactattcccataacctttgtttcagcatttatcatactgtgttataattacttaagtttgaaaccagcctttaccacttagtacctgtatgaatttgcaagttactcaaattctacatgtttcaattttcttatctcttgaaataggaaagtattacaacttaccttcatgggcttgttgtaagaatcaaattattaaatatgtaaagcacttaaaaaagagcctggaatcttgaaagagtcatgagaatccttctcaatggtgctttaggcagcaaatattagctggaagtgctcaaatattaggtattgttattcttactgatcagtttcactcactatagttcatccttgtatacttggatctagaacagtgtctgcatttaataaatttctttgaaggaccaattaaataaggaaggggcagaggaagacgctatcacatggtatctcatagggtgaaagaggaaggaagagaccagctcttttaacaaagtgctatttccatgcttgttgagctccactctagaagaaagtttctttttccttagtcgttaagacttaatgttgctgatctctctgatggccagtgatgatgggcattttttcatgtgtctgttggctgcataaatgtcttcttttgagaagtgtcagttcatatcctttgcccactttttgatggggttgtttgattttttcttgtaaatttgtttaagttctttgtagattctggatattcgccctttgtcagatgggtagattgtaaaaattttctcccatactgtaggttgcctgttgactctgatggtagtttcttttgctgtgcagaagctctttagtttaattagatcccatttgtcaattttggcttttgttgccattacttttggtcttttagtcatgaagtccttgcccatgcctatggcctgaatggtattgcctagggtttcttctagggtttttatggttttaggtctaacatgtaagtctttaatccatcttgaattaattttgtataaggtgtaaggaagggatccagtttcagctttctacatatggctagccagttttcccagcaccatttattaaatagggaatcctttccccatttcttgtttttgtcaggtttgtcaaagatcagatggttgtagatatgtggtattatttctcagggctctattctgttccgttggtctatatctctgttttggtaccagtaccatgctgttttgattattgtagccttgtagtatagtttgaagtcaggtagcgtgagcctccagctttgttcttttggcttaggattgtcttggcaatgcgggctctttactggttccatatgaactttaaagtagttttttccaattctgtgaagaaagtcattggtagtttgatggggatggcattgaatctataaattaccttgggcagtatggccattttcacgatattgattcttcctatccatgagcatggaatgttcttccatttgtttgtgtcctcttttatttcattgagtagtggtttgtagttctccttgaagaggtccttcacatcccttgtaaattggattcctaggtattttattctctttgaagcaattgtgaatgggagttcactcatgatttgactctctgtttgtctgttattggtgtataggaatgcttgtgatttttgcacattgattttgtatcctgagacttcgctgaagttgcttatcagcttaaggagattttgggctgagacgatggggttttctagatagacaatcatgtcatctgcaaacagggacaatttgacttcctgttttcctagttgaataccttttatttctttctcgtgcctcattgccctggccagaactttcaacactatgctgaataggagtggtgagagagggcatccctgtcttgtgccagttttcaaagggaatgcttccagtttttgcccattcaatatggtattattggctgtatgtttgtcataaatagctcttattttgagatacatccaatcaatacctagttaattgagagtttttagcatgaagggctgttgaattttgtcaaaggccttttctgcatctattgagataatcatgtggtttttgtctttggttctgtttaaatgctggattacatttattgatttgtgtatgttgaaccagccttgcatcccagggatgaagccaacttgattgtggtggataagctttttgatgtgctgctggattcggtttgctaatattttattgaggatttttgcattgatgttcattagggatattggtctaaaattctctttttttgttgaaatgcaaattaaaaccacagtgagataccatctcacagcagttagaatggcaatcattaaaaagtcaggaaacaacaggtgctggagaggatgtggagaaacaggaatgcttttacactgttggtgggaccgtaaactagttcaaccattgtggaagacagtgtggcaattcctcaaggatctagaactagaaatactatttgacccagccatcccattactgggtatgtacccaaaggattataaatcatgctgctataaagacacatgcacacatatgtttatagcggcactattcacaatagcaaagagttggaaccaacccaaatgtccttcaatgatagactggattaagaaaatgtggcacatatacaccatggaatactatgcagccataaaaaaggatgagttcatgtcctttgtagggacatggatgaaactggaaaccataattctgagcaaactatcgcaaggacagaaaaccaaacactgcatgttctcactcataggtgggaactgaacagtgagaacacttggacacaggatggggaacatcacacactggggcctgtcgtagggttgggggaaggggcgagggatagcattaggagatatacctaatgtaaatgacgagttaatgggtgcagcacaccaacatggcacatgtatacatatgtaacaaacctgcacgttgtgcacatgtaccctagaacttaaaaaaaaaagacttaatgttactgatctggatgtgatgttgcaaaggcaacagtttgattaatctaagctggagtagctaatagtttcccagtggactttacgctttaaaagatgatatgtgctaaccaatcacctctctcctcttggtagtatttttgttgccctcacaaagtcagggacaggggcaggctcgataaattgcagggccaagaacaaaatgaaatgtgggggttccagctaggaaagtcactttccccttctaccccaaactgcagatggtcaacctacaaatgatcctgccaggattcgcttggtacctgaattgggggtgggcaagaggaccccactgagtcacccacctaaagtggcatctcactgctggctcaggatggggatggccatttcctctctgcaacccagtttctgtccctagtggaggggggtggctggaggcaggactgcacatgagtcacagtgctaagccaagctctgttaccccattggactttatatacaaaatgcaaattcaaagatacagttattaagaatttaaagataattaccacagaacaaggtcctggaccttttgagcccacgactctatgcagctgtactggctgcctgcccatgaagcccaccttggtgaagagcattttttagatatacccctctctctgggtagggtcttctttgtgggcagtccaattctgcctgggaatttggactttaggacaactctccattattggtcagtttcttggctgctgctgctttggaacatacaggtcactaaaagcaccattttttaaaaaagaaattgaccttttttctatcattaccaatccacgtagatgtactcaacttaatggttgtggacatgatgcattagccacatttctcttaatttcgctacagggaggtattattgtttctattttacatactggagactgaggctcagagtagttgataagtacctttcctgaagtcatgtattaattggcagagctgaaatttaaacttgggagagactgtcttattctttagcctgtactggctctcatgtaaattttagcattaaatctatatgacacatatgttctagcagcagctttttgcctcaggaacttcctatttatttatttatttatttatttatttatttatttttattattttttattttttctagatggagtcttgctctgtagcccaggctggagtgtagtggcatgatctcggttcaccgcaacctacgccttctgggttctagcagttctcctgccttggcctcccgagtagctgggattacaggcatgcaccaccacgcctggctaatttttgtatttttagtagagacggggtttcaccatgttggccaggctggtctccaactcctgacctcatgatctgccagcctcagcctcccaaagtgctgggattacaggcgtgagccaccgctcccagcctacgaatttcccatttagtgaacttagtgtgtatgcttgtaggtgctctagagtttttaagccctataaagattttagttattaatagagatttggtcctttatgcaataagattgtgcatctaggagtttgatttttttttctagtgttttgctcacaagatttctagtctgctccgattttttctttgagcatgctttttatccttaactttgccgtcacctcggagtagcttcttttggttagtattctctgtattcctgagtccctgtgtgtcagagaatgtaagagttgaaaatggtagactcccacaaggaaacaaacattgctttttaaaagctcattaaaaactatctaaagtgacctcaagggacctttagaggcttctttgaaaagctttgtttactagtagccttctgtactagtcagagttctccagagacagaaataataggatatctatttatggatggatgggtggatggatggatggatagatgataaggggcttattaggggaactggctaacacaattgtggaggctgagaagtcccacgataggccatctgcaagctggagaaccagggaagttgatggtgaaccagggaagctgagggcccaagagcctgaggagctgcaggtgtgagtctcagggtccaaaaaccagagaccctggagttctaacatccaaggtcgggagaagaagggtgtcctgactatggaagagtgggaagaaattcacccttcctccacctttttgttccatctggtcccccagtcgattggatgggtgcccatccacattcagggcagcagatcctcctccccaggccaccgactcacacgccaatctctcccagaaacaccgtcacagatacacccagaagtaatgttttaccagctatctaggtattccttaatttagtgaagttggcacccaaaattaatcatcacaccttctgtttaggaatgtcagtggtggagaatgtggactgtactgtctgacagatgtggctcaaatcttgcctctgccctatgatcttgggactttaaacattttttgtaacctctttaaggcctcagcatcttcacctgtaaaatgggagtaatactattctcaggttattgtaaagatcacatgaactaaggtatatgatgtgttttgtgttgtacctggtacatagagtgctatcagtgagtattagctattattatagattaaaggatctaggcttagaatagtaacccagggatgtagtctgtgctatattagagcaatctgcatagacatgcctgcatggactaaggggtcagaataagaccaaatgaaagtctcttgagagtcgtgtctcaggtttggtagatttagctccaccatggactgtttaacgtggcacgcttaatgatttaatctgaggtccttggagtgaaggtgtatgcttgtaagtggattcaacaaacatttattaagcacctgctattgccaggactttgtagctgctggtattacaaaaaaaaaaccaagttggcctgtgtccttttgtagtttatattccaactatgagacaaatatgcaaacaaatgactgatattaaatacaacacaagtgctttaaggtacttaaaatgccctagggcataataatgcagaatgccctagggcataaagtgagttggaaggaagttgttctttgttaatattttatcttcagggctaagaatgttcttattatagaaggaccttcagtaagttcaatgaattattttgatatttttagtatagattgatccttcaaacaccaaacatattgaaaatgtaacttaactttgggtatttaagtgacagaagcccatctttaaattttcctaacaatattatttatcctttatcttcacaacttaggtgaataggagttataggcaaaatcttgttaattatgtgaagactacctatatctgcaatgtgcaaaagggtttcttagccactcagggtgggtgtgtttctaaatgatcatttacatctatgggaaatatagctggcagttgagaaatgagtctaatattagttagaataaaagtgatattaattagaataatagttagatattcacaattaaaatattagctactatgtattaaacactatctaccaaaaataacactaggaaatatatctatttcggtagtttatatacaaaattaaaataaaaaatatttctgtgaagagcgaattcccctcatttactatttgtttagctaattttaaagtttgtataaaaagtggaaaaatgctactctttcttagtttctgagtttttaatgacaggagtcttagggaagtttttcatgtacttacaaaaaacacctgaggaatatagagcagatagatccaaatcataaacatgtattggtaaatgagcaaaaatggaaaataattggtgtcgcgggactgttgaaacagatttaataatatttaaaaaaaagtcactaggatatgctttgagaactatattttctacaacacagtagcatcattaagtttttaatatttgggtatataatagttagcatcatgggctctgaagccggactttctgttttcagttttagttcttcacttaccagtgtcactttgggcaaataatttaatgtcttcatgcctcaattttatcatctgttaatttaggataataatagaacttccctcatagggtcattgtgaggattaaatgagttcatatacattaggcacttagagcagagcctggaacatagtaagctctcagtagatgttagttgttgttgttgttgtcattatttttctttgtagaaaggaggagggatggaacttctgatgcttatttttaatctatgttacagagtcttccctttggtatattttttctaaactattttgtttgtttcagccttcttaaagtcacgttttgcaaccctttctgaactaaagtgtctaggctttgaacttcagtagctggtaatgtcataaaaggagaaaattaaacattatatgtcttttgtttaacctctattacggcaccaaatagtattacaatttattgatatttatggtggtattttctactgagctgtgagctttttgaaagaagagacctacactattgtgtttagtacactgtctggtactaggtatgaggcctgagcccctaatagttgttctgttaactatactaacatctcatttatcaggtttacctaatagtgtgcttttcaaattcaaaaacaactgagtttcctagctgtctagctacatgaattaaagtatgttactttaaatatgaagattttatttttttaagtatttaggataatttttcttataagcattgagcacatcccatccttcataagcataatgtaaattcatcatcatgcgtactgtttattggggctgtaatatagtgtctccatggagggtattgacatatgcttggttgtatggttctatatcacatactctgaggatgccttatgcattttttctttgcatcttatgtattatttttctctcattatcataatacaccaatttctttcttctttctgccacatctagcaaccctagcttcctaaattcaaatttaatgcttctaacctgctgcggattgatttgcttactaacttcattagaacctatagaaaaagaaagatttattaataagatcttaaccaagcttgagggcatcttctgtgagtaaaatgcagaagttcagcacatagatagagggtgtgacatctatttagctagccatataggttttacacttactttatgacattgctgaggttgtcatatatgtgtggcctccaggcaagtgattttttattatattaacctctgtacagaagaatgaaattctcttcagtatttccgtagtgttaacttatggcgttggaattcaaatccagatctcctttactccaaagtccattttccttggtgctagactcatgttataaaaaagttaatattgttaattattacagttcattaaagtgacatgatactaggatagtttttggtttaaaacacaaactcggcccggcacagtggctcatgattgtaattccagcactttagcaggctgaggcaggaggattgcttgagctcaggagtttgagactagcctgggcaacatagtgagaccttatctctacaaaagaatttaaaaattagctgggtatggtggtacgcacctgtagtcctagctacttgggaggccaaggtggaaggattgcttgagcccaggaggttgaggctgcagtgagctatgataatgacactgtacttcagcctgggcaatagagcaagaccctgtcacaaaacacaaaaaaacacaaactctttgtctttgtcctattattggcatttttttctatataagtttttaaaaatattgccaattatggattgtttaaatatttaattgatagatacatattcaacatatattttacaacagtaagttacacagatataggttacatttaataacatgcacttttaaaaggtctacaatttaaataacctgattactatgtttatttgtaggctttgagctcaatatacatgcacatctacatagaagaagtacttaaatgtgcctattttacttacagtttataaaacgctagaaaaatattaaaaagattcaaaattaagtagctttgaggcatttaggattagacatggattcaaatcatagttttaatcttagaatgttagctttttcagtacttcctagggttactgtaaggattaagtcaagtagcattaacgtgggatgcgccataagacaatatttgatccttcatgatctctttcctcttcattttttccatctatataattttgaatcttgataaaaaagagggagcaaaaaagtatagggaagaatgaaatatatttcttaagcaaaagcaactatggtttgcatattgtgcttcaaaatgaatatttttcttttatcattttgttacatgcagaatacctttaacttagccttcattggactaaagtagaaacgtaagaattggagcttattttcatttctgaggtgagttcatttgtagaaaaattagtatacttaaatcagtctactgtttctttggaaactttgtcatttgcatgtacctgggaatactacagttatccatgaaatgctgttagtgtgaagtcgtggtgagggttccaggctaggcattcggagctccctgtcaatacctgggctgtgctacagatgcccttcagtgttgtgaccctagttccttgacatctttgtgtcagtttgcttatttttaaaatggaaatgatatggcagttggccctgcttaccttccagcttacatattataagaatcaattgagatcatcgatatgaaagtattttattatgaacaatgtaaggtagaagtattaatatcgtgaagtgtcacagtgagttaaatgggaattaacaaagttacgtgcagagaatcttttttgtttttttttgtttgtttgttttttgtttttgagacagagtctcgctctgtacggagtctcgctctgtcgcccaggctggagtacagtggcgcgatctcggctcactgcaaggtccgcctcccaggttcacgccattctcctgcctcagcctcccgagtagctgggaccacaggcgcccaccaccatgcccggctaattctttgtatttttagtagagacggggtttcaccgtgttagccaggatggtctcgatctcctgacctcgtgatccacccgcctcagcctcccaaagtgctgggattacaggtgtgagccaccgtgcccaaccacagagaatctttttaagcatgaaacttttgaatgttattgtagcctaatgcccctggaacagtagtaaaacagggccatcttatatgttgtttctgaataaactggcaaacaaatagaagaaaaggaagaggaggaagcagctgaggaggagagaaaacaaaactaaactgattatatggtcttgaaagcattgacatttttagaactacacatcacttgaaaatttttgaaggcattgttaatctataggttattaaaaatgaattttctggccaggcatgatgactcagtcctgtaatcccagaactttggggaggctgagatgggaggattacttgagctcaggagtttgagactagtctgggcaacatggagagaccctttctctacaaaaaatacaaaaattagctgagggtctcactgacttgggaggctgaggtgggaggatcacttgagtccaggaggtgaaggctgcagtgagctgagattgcatcactgtactccagcctgggtgacagagtgagaccctttttcaagaaaataaaaataaaaatgtattttccattaaaaaccagcttacattattttcaatgtttttacatttcttgctgtggagaaaagcctagtcccttctctagaattttaatcattcatctggatgccttgatatatgtggtatgatgcttagtaaaatggaatggatatttcttctatctccattagtttttctgtttgtttgtttttctttttacctgcctttatttctgttgttgttattcttcttccatccaccaagaacatgtggtcctcttatctctgggctgaggtgttttcacatgtccttttattctttcttcatctcacaaaaggtatatctaggctttttaaaggtgccaagatactatttaatgaacaatatgatatggattggctctgtgtcctcacccaaatctcatctcaaattataatccccagaatccccatgtgttgagggagggagctggtgggaggtgattggatcatgggaatggttttccccatgctgttctcacgatagagagtgagttctcatgagatctgatggttttattaagtgtttgacagttcctccttcacacactgtcccctctcacctgttagacgggcttgcttccccttccccttccaccatgattctaagtttcctgaggcctctcagctatgcttcctgttaagcccgtggaactgtgagtcaattaaacctctttcctttataaattacccaatcttgtgtagtatctttatagcagtgtgaaaatggacgaatacattatatttctttccagtatctgttttgggagaggaatgctggtcagctgctagtaaaatcatctccatgtactccattatttaggtatcgttcaattctagtgtggtagtcatgactacctaggtggtcatttttgtctaatgttgcagctgctatttctgtgtcttagtctacaagaaaacgttatattttcctcacatagcttacttattctgttccttgcataatgaccgaggtggctgtattcaaagccttaacaatgattaacaacatgtcctttaatcttcagcgctagctcaagagttttattctcctgtggccactgtaacctccaaactatgagtaatctggcaagtacttttgtgttctctttattgcaaatcatattctttttcatctttaagaaatgttgtttcttagtaaacagtaggtcatttatttgacttctccaaaaaataattgactatttaaagaaaaatagttttaaggaacatttaccagttgcttttttatgtagatagtgagtgtaggatgtagcagataggccgggcttcatagtcttcactgtttagttttgggcatgcatgctctctgagccttaaatgttatagttgtaaaaggggtgtagtgttgggattgttaggattaaatgagatagtgtatataaaatgcctcgtacattgtggagcacaaagaagttcacagaataatgtaagtattgttattactgatatcttctcctcattgttgttgtcattatcaccataattatgtgggaaaacctaaagggagttttgtactaatgggctcaaaatggaatgcattgttgatgaaggtctcgatacagtagatcaccttgacaaattgtgtgtagtcatagtttctttgatacaccattcatctcgttaagatgagaatgtccagccagccctagagatatgtcaacatttctggctgagattaatatagacttatgaaaatgggttaattggtcactaatgagctgcattactgggaatagggttagagttttatgaaatgcgtagtttcactttagacttacctactctcaggagtaggcagttatttaagtagtagccagtttgaaagaaaaaaatctaccttttcagtttgtttcctttttatggataaaatgaaaaaattccatcctgaaatcagattttaaggaacagatatatatagtgattaaccacccagcttccttttgcctacacacacacatgcacacacacactttatcttctgtttttcattcagaatatgactgcacaagctgtaggggttagctaacagcacactgaacagctttttgctgccagtttgggggatgattgaaattattgacccttacacgaagacaaaatgaaatatttttatgcaagaatactagaaaaaaatcttctctattcagaaaatactttagctcttagaatctttagcatgaagtcacatgatgtgaaaaagccaattaaaagtcaattaaggccaggcatggtggctcatgcctataatcccagcactttgggatgccaaggtgggtggatcacctgaagtcaggagttcgagaccagcctggcctacacggtgaaaccccgtttctactaaaaatacaaaaattagccaggcgtggtggcaggcacctgtaatcccagcttttgggaatctgaggcaggagagtagctcgaacctgggaagctgaggttgcagtgagccgagattgtgccattgcacttcagcctgggcaacacagtgagactccatctaaaaaaaaaaaagtcaattaaatatttttaatggtggaaggcttattaaagttttatattctgaatttgtcttcaaaatactttgaaaagagaataaacatttccaaggctacaggaattctgtttagaggatttggttaagctagctaaaaacctggatagcagttgcccatgacattttaattattctatctaaaaaagatgaatttctatgtcatatatagatatgcctttaaggtactatgatatatatttttgactgaactttttgcacaagaggcatttctgaaataagtaaatgggatatttgaaatgtcatctgtgaatctatttttaaagcagtatttaacatctaatagaccttgtgtgctattgtagatattcttatttatatgtaaaggagggcatgccatttgtatctcttttttttttagttatatgggagatgcaattattttctgaggggagtgaaggaaaagaagggctatattataatttgaggacatagttattatgggagactctcttaaggaaccaacaagaaaggaagtatagatgagcagcggttagaaactagtcgatactgataacaatgtatagtggtcctaataggttcgtaattctcttaaaaggaaaacaggaagcaaatacagagaagattgagtagtcatatgccagggtaaagagaaggcccctgccctcaaagagttcatagttttatttacaaactagaattatctatcttaaagtcccatcgtttttaagctgcctgcagacaattatagtctagttctagtgtatcttgttgaatctttatttttcagaattgtcttcaagtacctagctccatgcttacagtttatactccccaatataggttaaattaaactggatggaatcaagtgctaaaaaaaaagtcatgcttttattcttccagtgatggacagcagaagttttagagtaatcaagatctgaatttgaaacctggctctgccacttaacttatgtggtcttgggcaagtaccaaactctgagcttttatttcttctgttgtaaaatcatgattatcatacctatttcataagttagctgaatgggtaaatgactctgtgtgtgtgtgtgtattacaaaagtgtttatcaaataactgtaattatcaatatggttatcaaaactaaggaaaagttgagatgccccaaagttatagagatgggagttgatataatggagagggttccaggtgacgatggacttcagaagctacacaggtgaatttacagtgttgtgatagccagtacggagccattttaggttcttgatccctagaagtgtattgtgaatagttaaatcaaaatgtatttaaacaggattaatcgagagatactattcaagaggtgtgtggggaggtacagaccttgagagttaatcatacctatgtaaacattaatgaaggcactgtacatatcaaaataaactgtattcctgcttataaaaagtacctcaacatatttagacagattgaaatcatacacgcattctgtgaacacagtggagtcaaactagaaatcaataacagaaagataagtaaatctccaacattgagaagataacacaacacacttctaaataatccataggataaagagaaaatttcaagggagataaaaaatacactgactaaatgaaaatgagaacagaatatatcaaaatttgtgggacacaactaaagaaattaaaaactaacagaaatgcagaatgcctttgattcctttgatgccatcagtagattggagagggctaatgaaagaatcggtgagcttggaggtagggcaatagaaacttccctaaccgaagccataagaagaaggaaaaaactgaaacagaatatttaagaattgtgagacaattacaaaaggtgtaacatatgcagaatgggaatgccatgaggagaagaaagagagaaaggatcaaaagaaatatttgaaataataatgactgagaattttccaaaattaatgacagacatcaaaccacaaatgttggaagctcaaaattaatgagagacgccaagctcaggacaaacaccaaaaaatctacagacaggcatatcttattcaaattgcagaaattcaaagacaatgggaagattttgacaggtcggggggtgacttcaccttacctttaggggattaagggtaagaattacatcggacatctcttcaaaaactatgtaagcaagaagagagtagaatgaagtatgtaaagtattggaaaacagaaacaaaaatcacttagaattcagtatccagtaaaattatccttcaaaagtgaaggaggagtaaagactttctcagacaaaagaactgggaatttgctgccagcacagtgccttacaagaaatgtttttaaaaaagatggatttacaaatattttctgctagtctgtggcttgtcttttcattttcttaacagtgtcctttagcccatttttattggcttgaatattttgctaccaaagtttgatattaacatatattgtgctttaaatatttctagaaatagcatctctgcaacaaacattttcagtttaaacttattgaaagtctcaggaatggagtgttgttttgtgttcaagtaagtcacaaagcataaatatttcactgaaatgtaaatagtaaaatctgtgattttaggccttgtattttcatgtaaaagatatatgctatcctcacataaatatggtggtattaggagcaatgcctgactcttcaaattctattaatgactcagcacccgggagagtgttccttattattgttgctgtgtttgtgtaacattctctaaggttctttgtagtgaggaacagatgacccttccatgagtcgggatccagtgttcttaaaagggccactgctgtagtttctttaagcttcatcttggattgttattagcatggcaaggacactggataagttatatacacacatacacccacaaggcaccccccctggtttgaaaatggaatctatgaattggcttccgtgcctgcttttattgccatggtgatgaataatctgctgagttttatggttggcatgattcttctggattaggtcacttgtgttttctttctataataccagtcgactacgcttttggtaacagttaaagttccatcactaaaaagctagtaggtagaatgcaaaactaatgatttagtagaattagctacatcaatgctttttaatctgttgattattccctttcagtgctaagtagcaggggcttactcatttcacagggctttaaatctttccattgcagtcagacctggtagggaattattctatgctgcagttataagtttttcatcatttattaaagcattatgggagaaccatcttgataaaagcatcttagtaaaggaaactagacttatttattttattttattttttttggggatggagtctcgctctgtcgcccaggctggagtgcagtggcacaaccttggctcactgcaacctccacctcccaggttcgagtgattctcctgcctcagcctcctgagtagctgggattacaggcacgcgccaccacgcccggctaatttttgtatttttagtagagacggggtttcaccgtgttggtcaggctggtctcgaactcctgacctcgtgatccgcccacctcggcctcccaaggtgctggaattacaggcgtgagccactgtgcccagccttattctttattttaatgagtcagaattttaaataccttgctttactgtatttacaaaagttgtagcaatgggtcagttgtcttaagttaaatttattagtatctaccaacattaaaggaaatattaaagtgtttcaattatgtttaaaataaaacacaagaatgaggagtgatggacacaagtaaaacaatgaatttgggatgataaaatgagttgttgatttagaaatatatactatatgccaaatggtcagatctacttggggatatagtgagagttaatctacttcgaatcgttgcttctaaagcaaacccagttgtgtaaagtcctacgtataaaggtagatattaaatccacgagggaagtaatcagaaccccaggtgcccaggctttgtaaaaaatttaaacagtaaaaacgtagtcacttgtacttaacttagatttaactaaacaaattcataaaatttcctgagtggaatgatggtttcagagagctagtgagtttcagaccttgaaaaaataccactcactgaactgtagtcattcttaactgtttaacaattgaaatctaagttgtcatatgtttaaattagtacagttctggttatgctgtgtcttttccaactcataactttcagtaatgaaaatagctttctatttaattagcctgaattaaattttcctctctcttccttctacatcactaatgaaagtggagtaatcatttctgcttcaaggatgactatatgatttcatttatccctaatatagtacacactacatagtaggcactcggtaaatctttattcattctttcaggaggcaaagcaggaacagattaactaattaccagctcagaccaagttaagaaaaataaagctacagattgtcatttcaaaatttgcctctttttgctgtctcactattttaaggagtgcccactatatcactaatatctctggcaagaaagcattccatgtgtatgtatgtaagtgtgtatcttcattttttgctgtcaccacacagacatcaggctttttcacaaaatctgaccccctcccttgaccattttttataactacctggcatgtatcactacagagcttttgttctggtccttctacttggactttggcagatatttgaactcttctgagccagtgctttcctcttcagggatttgtttttaagattttcttccttgccaaccacagagactgaattttatatcccacagatgagtctgagatttccagccccctccgtaaatcccatcactctgtcactcttgacagtgtaattatcccttttgtttcttgctgctttcctgcttgtaatctttgttcctcaacatgtccttcatctgaaaaaaaaggcacccaatccttcttgctttgtcagctctttaatttctcttgtgaaatagtcctcagatatcagctccccacaaaggctttctggaggagaagtggcattttgcttccttaaatctttctgtctattcaattttcatgagtgactgataactagccatcatattaaagtcttctgatcttatatttaagtatgattttttattagatttatgttttgttcagtgtttatgctgttcagtgtatgcatgtgctatgtgtacacttttaatatgtgtatctatacctgtatttgtaaaacagagaaacctaaaggccaaattctgcatcttatttttgaaccaatcaagcagcctactgatgtgagacaaatttcaacaaatgcttaagacacacatctgataaatatataataaaacttgtatgttgacagagcttgtaaatttttaaaattcatatttttccatctttttgttcatttctctgttatttgatgatgatgagtcaggattcttttaatgagataatgagatctttacaggtctaatgtccaaggttgatactgtggtggtgagtgaatcaccatatgatgaagacccattgtgtcaccgtattttagaatttttcataaggtaacaaaggtatgagaattaggcaggacaatgtaaatgaagtgccgtgtaaactacaaaatgtatgtgcacacccatgcagattttttttttttttttagtttttttccttttttttttgagacagggtatcactatattgcccaggctggatttgaattcctgttcaattcttctgctcaagtgatcctcctgcctcggcctcccaagtagctgggattacaggtgtgagccactgcaaccagctacatgacttttccggagatctcttgagggtgatttcaggtgatacacagttagtggtatgagataaagcacattgctgctaaaattccagacagtccccataaacgagtagaaattgcttcagttatctagcaggtaagtatcagatttgctggcttatcctgatttattgacacagatctgtggactggtggtatcctattggaatgcagaatgacatttaccttgaaaaagaaagtggatttttttttttcctaacaagatacctaggagtgagtgatctgtggatgttgaatttttttcattgtgacataattcaaaatgacaaagtgaactgaagacttattattttcatgcattgtatgctattttaagttttggagaaaagaacttcggagatcttattagtctgtttttacactgctgataaagacatacccaagactgggtaatttataaagaaaaagaggtttaatggactcacagttccatttggctggggaggcctcacaatcatggcagaaggtgaaaggcatgtcttacatggtggcaggtacgagagaatgagagccaagtgaaaggaaaaaccccttataaaactgtcagatctcttgagatttattcactaccatgaaaacagtatggaggacactgccttgtgattcagttatctcccaccaggtccctcccatgacatatgggaattatgggagctataattcaagatgagattccggtggggacatagccaaaccatatcagagattgaaaagttttaaaagtaaagtgatatccatacttacagatattgagatgtctgtaaacagtctcccttacaaaatagagcaatgctaagataatttgtgtgggagatatgcatatgtatatcgtatgtctttctaaaatattcatacataagactcatacaaagtgactatttaatatgtacttattataccataacagtcaaaatttgaaatagaactgatctgaattagtttatatgatttgacaacacataaaactttgataaactttattcatattaagaaaagctactttttctttctgggtctaagtctcatgtttacctaatgttgaagtctttgaaagaagactttttggtgatattttacatataccttatacataaagtacacagtttatcctgggagtctgagatgaggattgaatattgacatcaaattctgaaagttcataaaccttaggattcactgacccaaaggtgatgttttgatttcatattaagaagccatagaatttttctgttaagtcaatgaattctagaatattcaaagtcaataaaagataaagaataatgacagatgtctctatataaatgatgtaatgatgcttttgtactagtatagttaacctgttggttatcttcaaatttaattctgtatttacagtaaaaattaaggtgaccttctgggatttgagaggtagcatgaggttagtgggtaaacttcatcttcttaagtataaaatgactttacttaaaagttgatcaaaaacttttggttttggattaagtataattagaataatctatggaggtatacagtaaggattaccacttcatgagatttataaaaagataaacagatgtggtttttaacttaaggatgttattgagaatacagaaagacataatctataaccttttttgaagtgtagatatagaataggtctacgttaattttttaaattagaacttgacagtgaaaacataaatccaagatgtatgtatattttggtcttcaggaaaaatcttatgcatatttgtaccttatacatatacaattaaaaatccacgctgatgactaacaaatgattcctattgatctaaaaggaaaaagatgaaaaatcagcaagaaaatattgaaaactttaagaggaatggttttaaagaaaggataccatcactactaagcaaagaaatagtaattttttcctctatcagattgaaaaagatatatatatatttttttgagacagggtctcactctgttgctcaggctggagtgcagtggcacaatcatggcttactgcaacttttacctcccaggctcaagtgattctcccacagcagccttccggatagctgaagctacaggtgtgtgtcaccatacccagctaagtttttgtattttttgtagagaggagatttcaccatgttgcccaggctgggttcaagtgatgcatccccctcagcctcccacagttctgggattatagacatgagccaccctgcccagccttgaaaaatgttttttttttgtttgtttttttttttcaaacaagtgatatccagtgttttggtgagagtgtgagatagcagaaaaaaaaatctactggtagctgggtgctgtagtctgaatgtgtcgctccacaattcatatttgaaacctaatcttcgatgtgatagtatgaagaagagatggggccttttggaaggtgattaagtgatggagagccctcatgaacgggatttgtgccttaaaagaggtgagaaggaaccgtttgccccttctgccatgtgaggacactggtagaaggaaggcaccatctttgaagcagagagcaagtcctcaccagacactgaatctgctggcgctttgattttggactttccagcctttgctgtgaatggcagcacattacaaattacccagcataaggcatttttgctatagcggtctgaatgcactaagacagagtgtaagttggtgtaacatctcgggagggaaattttgacagtgtattaataatttagagatgggcatatccttttacatagcatcttctttagaattttacattaagacaacattctggaataggcataaagatttatgttcaaggatggcagttgcagattgtcttttatttttcagttgcagatttttatgataaatattagcaatgtactactcaaggctcaaggaaagattagttacataatttttggggggggtaattgtttaaaataggctgtagaacaagcttgtccaacctgaggcccaggacagctttgagtgcggcccaacacaaattcataaactttcttaaaacattatgactttttcttgcgtttttttttttgtacctcatcagctatcgttagtgtattttatgtgtggctcaagacaattcttcttcttccattgtagcccagggaagccaaaagattggacacccctgctgtagaaggcttcaatgagaaatcattcatagtgcaatggtctttttgttgtgacttctcaggatactttgagttaaaagattataaaaccagacagacagtagccccctttgaaaaaaaaaagtatgtatgcattaaaaaaaaactagaaaaatttataaaatgtgaaagcatttgtctctggctagcaggatgactcatgatttttgttcttaaaatagttttgtatgttctaactttctgccatggatttacttttatgatcagaaataatatttataatatataataaaaattttaaaaagtctgatatttggtgctgaatgaaacactagaaatcctgtaggcacttcttatttctatttgttgtagtaaagtgtgcttttattacttttaagttttcaggaaaatccttttaacttgatgcgcaagacaaaggcaaacaagattgttgtctttcacaagaaatggaggataaaatgtactattccaaagaaggaaaactgatgggctgagatgtagagcagtgtgccttctaactggagagctgcctgggggtttggagatgaaattttttatctattggttcacagaaccggctgcttccagacgattacttttttgttgagccccacaaacctcgttcttttagctgagtattatgtagtttttccagtattgctttctttccctcattacatctaggaaaacagtttggagatgagctactggagttaaaaaaatctatttggttttatttgtcaattaaaaaatctatttggtgtgtgttaggtttatttttgtgagtggggaatggcatatgactgtatattacagacatgggtgggtttcctacagattgtgaatgggaaaagtttgagttactctgttgtggtatttgtgttatagtattttcttgctttcttttcactctgagtatatgtggacatatttttgattgccttcacctattatgtgccaactattgtactaagtgctggggatacagtggtaaacaaaggctggcccttgccctcaagaagtatgtattctaatgggacagacagggcaaaaataaatgacatgcaacatcaccaactgtagtaagtggtagggagaaaataaaaaataaaagcacacagagattaatgcaagagggtgggttaggtttggggatagataatctcatacagcactttaaatatctgggtgtgcttctctgagcaagtggtagataaacaggcttaaaggatgagaattgctaagaaatggagaacttgagtttcaggcagagggagcaacatgcccagggagtccacagctggggcaaagtgagcaaggaggtcatagaagaaggaaagagacaaaactgaaaagtgaggcaggggacagatcctaaaagggcttttaggtgacagtaagaggctttgattttactatgactgcattcagacaacactgaagcgttctaagtaaataacacgaccagatttaaggaacaccccatttgttgatcactaagtgtatgattatttgtaacacttagcagaatgtgactgtcaatggacctcttttacagtatgctttgcttacatcagtagtgtgaccattatgttcttagtcaccctggagtaaagaagagttattgttgggcatgatggcacatctgtaatcccagctactcaggaggctgaggcagaaggattgctgtagcccaggggttcaagtgtagcctaggcaacataggaagaccttatctcttaaaaaaagaggttacaatttatgttacctcatctgatcccaagtgttatctagcaagggggaaatatttgaattacttagaaaactcagatgtgattttttaaatctaccatttattacttataattaatcaggtactatgctatactcttttcatatattatttgaaaataatatgtgaagaagatactattattttcattttatagataagcaaacagatttagtaatgtggccaaagttgtatagccttaaagtatggagttgggatatgagtctgttttgtacatgaacctgaattctttacaactacattctactgcctatactgatgatttgtttgtcacataacactaaattgtatagccaggaaaataattaaggtttagatttcaaatccatggctttttgcccataacataccacctcttgacgtagttggtttaatctgtttttcatagccccatgtcaaaaatagaaggggattagataccatttttagaattacaattaagaggtcttaaactataatctaaataaagattaagacttggttaggagaataagcattttatcaattgaaaataaacttgaaagggatccttaatattttgcccacccagggtaaacattcactgcactaacaattttcagccaaaggccccagctaaattctgccacctgggcaaactctagtccaatgatattcaaagaaattaaaccgttttaaaaactgatatgtcctctggcaatttaatgtgagtgtatcactgtggcattcagcttcagatcatgtgttgctgtaatatcttctctttatatgactgcatttctgttgtgtgtcactgacacggcttgtctgatttcaagccctttctatcactcctatttattggtaacatacaagcttcaaggatcatttgatgtgcaaatttaattgcaggttttacttttaaaggatgacataagctatatcattttaacaactgtttgcacagctttttctaaactgctactcagaaaacaggcatttttattctgtgtattgtaatgcttcctgacttgtcaaggctgcttgctcagtaattaacttatatgtaagtatgtatgtatgtgtgtatatatatatatatgtatgtttatatatacatatatatgatgatgttttgcagtgcttcaataggtacatgctttggaattaaacttgggcatttcccctgattttttgataagaggacaccttatcagcattcacagttccttttttgtatttactgatttgcccctttctcttccttccttcctcgcttccttcccattgctatatagcacatgattatagataggagaggttaagtcttgctacctagctaatgtgataatttcctgacagtatttcagagttaaggtaaaaatactccagaaaggattgatacttctgtaagaaatgcctttttttttctctaaatggcacttaagaacccggaagcactcatgattttaataagctgaagtagtcctgtcgttttgtttagagtttaactttttgtggaaaggacaggctttgaggacattgtaggtttaaaaatgcgttttacaaggaccttctagacaattcttttgatatacattcaccaacatgtccagctagctgatttggtagaatatgagactcttgatatgcactcatcaagctaattacaggggatgggagttccatttgagccaggtgaaatgaggaaagtctaagtaaaatcttcataattatgggaaatattgatactacatgccaaaagctttcattttccctgcttcaattctttgtacctattgtgtttcagcagagtctgtatttaaatgggaaattttcagcagaaatgggaggctctataaatattgttattcaataatttgtaaggtgaatttgcagatgtcctcatagtgactcataatttttccttattcgtcattaggttttgtgactatttggttatttcttttttcagaaattttatgttgaaaagtgtaaaactgctagttactgtattttagccaaaatctaattaaataggttttctccttttaaatttgaattaggaaaatgttctggggtattggatctgaatgagactgtacaaattggtctcattggtctcattttacaggtgaggaagcagaggctgagagaggttaagttactcaccaaaggttatagagctattaagtggcagacttggtgcacaaacacaagcttttggtttccttgtgctgaggtcttaacactttacatctaatctttagttataggacatgaaaggaaatgagaaatcactttttccaccaatttttttgtttcttgctgtctttttaactgaaattgccaaataagatcatgtcttattggagctgtacagtgatttctaggttgaaagtgacatttaaaatccataatcaaataagtttgtgtggtgtttcccttaatgcattcctaaacattgccaatttaaggcaaaactaccattttgttcatttatattccctgttacataattttgcggttcatttttctcaaatcaatattttcctaacttagactactaatgccatctatacacttaatttaagtatggtctcactcttctaaataacttctggaaagaacgtataatattggtcctgctatttatatttattcatgccaagaagtgtccatttcatttcttttttctttctttctttctttttttttgagatggagtctcgtgctgtcacccaggctggagtgcaatggcacgatctcggctgactgcaacctctgcctccggggcttaagcaattctgctgcctcagcctcccaagtagctgggattacaggcacgtgccaccgcgcccagctaatttttgtatttttagtagagatggggtttcaccatgttgcccaggctggtcttgaactcctgacctcagatgatccacttgcctcggcctcccaaagtgctaggattacaggtgtgaaccactgtgcctggctccctttttttgttttttctacctttaatcctagctctacagccaaacaatagcttcaacccatactgactcattgaatgttttaacaaattcccatcatttacatgccaggcatgtttgtccttttgcatgactataattgtagttagatatgattctcccaaagataagtcatattgcatctcctgtccctctccaggtaaattgttaaagcatttgattgatcattgtatccatacaaatttaactaacttagcatgtatgtaattgaaatttgataatatgtagtttagagtatttctttagaaacttcttttgggtttcttactctcactgaaaaaggtattaaagttaggagaaggattggtttagagaagacaaagcagatagtggatcttataagaagaaggaatgaaggaccgatgaggaattggggttgaacagtacaggaactgaaagtgaaattttgcttatacttccaagatgaatggattgtgacattgttgatcgattctgcttggttgtcctaacaatttatgtaagtgacctcacatcattttggatctgatgatcttagcttacagattatgttacagcctattttgtctgcctctatatttgtagttacaaagtatgggaatgtagggcaaggttaccagtaaagatgtgtgtgtgtgcaatttccagcttcaagagctttggaaaaaagtgcagtaaccaaatctgtcacattcgaaatatataatatttcctgtgactacttctggtaaactgccctatcatagaaaactgaaggaatcagcaaatacccatgagctttgcttagaattgttccactatcattgatatcctgtgtatggatatgaatgactatggatggtttcagtccatgccatttttttaatatttggacaatgatttgtcatatatcagtctgtgccagattagcctttcataagacttcattatcatctttactgatagataattcaggagccaaaggtatatcagaattttgtttaacagcagggtattaactgtacctgttaacttactattaggaaactgtctgtttccaagcagcaacattttttggcatttggcagacctatggaccatttttaagagacagtatcttaaaaatgacagggattggaattgggatactctctcagatttctttcagctctcaagtttagtgatactttgaaatgttgggttggaattttatgattatagtgtttattttgattatattcttcgttttgaagggttttcttcttgctacttttaatactgattttctcatcgaggaattatattagtactttctgctgttctctccattggtttcaagacttaatattattatcctcttctcactcccttcagtttctgtgtcctgccgtgtttttttttttccctaatgtccttctgttgcagtttgggttccccagaaagcagattttgagatggaaattagtgttcgggaaagtttattagaaagtgttcttgggggccaggcatggtggctcacgcctgtaatcccagcactttgggaggccgaggccagcagatcacctgaggtcaggatttcgagaccagcctggtcaacatggtgaaaccctgtctctattaaaaacacaaaaaattagctgggcactttgggaggccggcagatcacctgaggtcaagatttcgagaccagcctggtcaacatggtgaaaccccatctctattaaaaacacaaaaaattagccaggcgtagtggcgcacaccagtagtcccagctattcgggaggagaatcacttgaacccagtaggcggaagctgcagtgagccaagattgtgccactgcacactccagcctgggcggcagagtgaaactccatctcaaaaaaaaaaaaaaaagaaaagtaaagaaaaaaaaaaagaaagcgctcttgggatcagcccctgtggacgaagggaaggaaggaaacactgttgggccaagggggatgttgggctgccatgtagtctcaaataaaatctgaccctgtggggtgcttcaaagctgagaggccacctcacccttgtccccagttggagaaaggggaccaaggctttgtcttccacatgtcaaccaatctttggatgtgggcttccctgggaagggagtgtgatactgggtgaagtgaggccatcctgaaagagctgatagttgaaggttgtctgcaggcagcaccacagcagttggggaatcagtccttcagtcctgaaaggagatgtgggtggcatgtcacagtttccattcaatcttttttgcaggggtgctggagatgggaaggaatggcccaggggatgggtcagaattttcaggaataaggagttgcagcatacagtggtcaggagcttgagagatggtagagaacaaaagtggatgtagaataggttctgccaggcaattgacttctgacattgactattgcttttctaaatacattttaaaaattctatttatagtgatgcttttcacttttaaagttatagaaacctgatgaaaactctgagtgcactatacagagaatgtatttttgttttttacccatttcccatttgccccaagaatactgcactggcaacaagcagcacttttttattctaagtgagaaatgggttaaagagatgggtcctgctcagtcacacaggctggaatacagtggcgtgatcatagctcactcctgggctcaaactcctgggctcaagcagttctcctgtctcagcctcatgagcatctaggactgctggtgtgtaccaccatgcttggctgattgctgaattttttgtggagatggggtcttggtatgttgcccaggctgctcttgacttcctggactcaagggatcctcccacccgtggcctatcaaagagctgggattacaggtgtgagccactgtacccagcctgtgccatatctttattcaaatataatttggttttataaaacatacagattttttagttttatgttctttataggctcttttttctctctccatttctttaataatttaaatatacttttttggtgtcttcatattaaaaatcagttgagcactcaattttctgtttggcatatttgttaataatcacagtaaatcattttctccatattttgtaatctctaaatttataagctcatcttcattggggattgttttttgttttgttttgttttggtttggtttttctacccaaagaaatcccgtggggccttgtttacctctcatcactttaaaatagttttgtgtttgtttcttctagatactttacagatttcactggcccaggatctaattccttagattggagattcttaatttttttacctaggagattctcatacaaataagattcacatttcaaaactgttgtgtcataggtttaggattttaatttcttatagcatttatagcatttcccctgtcctcttcacccagattctcagagacaagctctcttaagtcttaatatgactatgagtgaatttctcctccccgacaccattttttaactatgaggatagacctttgaagacagccctggttttctggaagaatctcagtaccaactttatacctcgtgtgcccagggcctccccttctgtccctgcataagtatcaggactgctttagagttgtgaaggtttaatggggctggaaatccagcagagtgctttctctcttgagggagcactttcttctgttctttctccttcaagaggcatcttgttaccaatttcaatctatacttaagtgctgaagagactccagtgattatccccatagctccagtgttggccacagctgacagtgtatgcttttgtgcttactattttggccatcagttctggctttggtttagcatcagggaattatctttattgcaagtaaagctatgtatttaattttgttacacttattttcttcttttcttagtgtctgtagtgggaagtcttcatgagctcagttggccatatttctgtacctggaattcccgtaagttacttattaactaccgtttctcagattctacctctctaaaatgggagtaataatggtgtctgtgtatatagcgttaatttagaccacacagtaagctttcagtcaatgctagccagtattattttcaccatttaaaacttaaaaaaaaaatcatcttaggcaagagttggaagtgtagtggtagctgtgtttacttacttaacaagaggaggaaatcttagttaacgccctagagaaaccaaatcagaaattttgtttggtacagtacaatgccgaaactgacgcttagagtcccaccctttctgacgttgtgccaaaggtcacttggcacataagtaaactgagtggaatggcctctcaatattgcctggacgattgcttagaggagtatttcctgaactgtgtgggtaggtaagtttgaatttgttaatattttctttgctaaggagggctctcaaaggcgtaattattataaagggtatttgtagaccttgaaacatgtagcaatacttttagtccaagtaagccctttgattgctttttaacttcccatttagtattccaagtggattctgaacttggtgaaattagtggtaacccagtctcctcagggtcttgcctcctgtcttctggcttacagaggtggagattcaaaggatttctttcctttaggtcatggtatttaagagaataattttcccctcatattatagctaagaagaggtctgttgactattacagattgggaatccatgggcataatatacgaaatgtttaaaaaattactttgaacttaaccttatatgcaaaacattgattatcttataaatattaactgctttggattgtttacacaatgttagttgtactatgaaaatttgcttattaaccaggtttagacttcttaggttgttcttggctttgagtccacagatttaacactgccaaatttctgtgtaaacattttgcttgggacctaaaatacagttgaatatgtgtatttaaagtttttttttttaaagcccatgtatattaatggaacttgtaaatgtttaaatagtcaattaatggaagcttttaagaaacaactctttcaaaatattcaattttataattatgatgttttaaatatcaaacttgagttagtgacaaacatgtaattcataatatataaagatctataagtagttcttattgatttattacatttaatcttactcagaaggaacttttttgttattattctgtcactaataattaagtgcaaggctatttaaaaacaaataagagctaataacattgtaacacagactagatagagagcaaaaataaataactgattaagttactgttttggtcttgggaaatgtggtaggttcttgagtttaggtgccatggttatggctgttttgatccttttttgaaatacattcttggatgtgttgattttcttgtaatgtcactattatttcttaagacccttatatactgtaaagagcattatcaatttacacaaattttaactacccatagaaatattgtatacagcttttttgtagcataaataggtgaagttcctcaagatgtttatggcctggtatattcttacccttgctataaagctttggtcagctttagtggccaaactctaaggcaaatggcagtattaatgtggagtgtaaatctccatatatgttcttggaatggtatgtaaaatattttgttccctgatccacctgtccccacctttagtaagatacccttgtgtctgcagtagcttgagttataaaagaggtttccgtttttcagcaactagacttggaaacaaattttttcagtttaacttaagcaaattgtatataagaggaaatgactatggaggagatacgctgcttagtctcatttctatgtaaatagttctgacataaattgtatagagaagtctcctttgtagtttacttttcagtgatgtcatttgtcattaaatcgtcaaggtaggtatgaaccttggagttttaaggtgacaaaaatgaactcattacactttagacttttggccaggttctgtaacttatgcctgtaatcccagcactttgggagactgaggcaggaggattgcttgagcccatgagttcaaggccagcctgggcatcatagtgagaccttgtctctaccaaaataaataaataaataaataaataaataaataaataaataaataaataagcctggcatggtggtgcatgcctgtagtcccagctactcaagagactaagttagggaggatggcttgatcccaggagactgagactgccatgagctgtgattgtgccattgcactccagcaagggcgacagagtgagactgtcttagaaaaaattctagccttttaaataatagtgtagttgaattgtataaatattttttgaagagaatataataaggtaggttatcatgtagtctttttgatcatttatttataggatatttctaatgtaaacaatccagtattttaaaatttccttttttttagagtttgtttgtgtatttgttttgacttgtttaatttgacatgtaagcacttaaaaattgactttccagctacatgaagaaattatacgtcggttaaatttgtggcatttttatacagaatcgtgtgtacaaaatatattaactaggtttgttaatttgattagaaaaaacttgtggtagttttaatgctcaatatattttctaaaatgcaaaagcaatttgtgaaatattgtctctctgtacttggtaatgtaagatctgagctgaatgaaatgtgagtttcttaagcttgtcttagattttgtatcaacatttgttcaagagcttggttttaggaacatttgtgtgcattttcttgattattaaaaattctttgtgtcatatttagatgtaatttagagcaatattatttaactttgccaattatattattctgatcactagatttaatgctctggtaacaactctctgacaactcattattactctagtattagattccattggattctttatcttccttgtttctaaaaaaatgcctttcctcattatgcaagtaatttttctttatttcaccatttatacagttggccagaccaaatgacatagtgagtatcccttaagccaggggtcccccaacccctgggccatggttcagtaccggttggcagccttttaggaactgggccgcacagcagaaggtgagcagtaggccagcaagcatcactgcctgagctctgcctcctgtcagatcagcaacatcattagattctcataggagtcgaaccccattgtgaactgcacatgtgagggatctaggttacgtgttccttatgacaatctaactaatgcctgatgatctgaggtggaacagtttcattctgatccatcccgcctactcctgccttggaaaaattgtcttccatgaaaccagtccctggtgccaaaaaggctggggaccactgcgttaagcagagccgtgaatatcaatcttggacacaaagcctgggattgtgggtggggaaagccctcccgttgctctggcctggcattccaaagactctttcaattctcttaacttattcaaagcctggattctaaaagccaattgggctccctttgcccattcataattcatgctacagtcttctggctaaaaattgtcagtagagtttccatttcccattatatgaaattcaatgtccagtgtgtaacttatcttttgagtcgtgtatcttaatgtatggcttaagcttcttctttatgctttacagtttccatttcctgcctttttttcttgacacgtggtgtaattagaaagtctctccctcatattcaaaatttacctcatccttaaggtttactgaccactgccattaaatttttcttggtttcaccttcttttttctgcattttataccagtgttttgtgttccatcttctgttatatttatttttacatgtgttatattttacttcctttctaatgactgagtttaactgattgaattacttaaagtctatctcttactatgatgggttagaggtggttttgtcttgtttcttctaggttgccttgcattcagtacatgcttattataaatatttggttactgaaaaaaatgaagtgatatgacagtgttattgattacaagacattttactcctttgttggaatggacatttggggacaggggatcaactggaaatctaaacaagtgtggcatggctctctgaatcaggctgtccccagcagggaaagctgatgaaacaattaaggctgcagctaagaaatgttttaaatcatgttgcatagtggctcaatactgacaggcaaaggacagctcttactagggaaagactttggactgataggaaattgaagagaaacacaggctttgtagatagtgactacatttctaactcagataacattttctgtgagttcatagtgtgagaataaatacagtcaattctgctgtaatgattgttttgaaaaatgggagtttttattctttcatgattgatattaggcaacactttgagcataatgcaaatttcacttttgcttatgcgtgatttcacctgagaaatagtaggcgtgcacagaaaatttcacccaactaaaatgagctgcctaggctacacaaagtgtacatgcacacatctcagacattgcctggctgtctcactttgccacatgttatgagccatattcattcatattttgtattataatttcccctccaatttcagataacccatcttgcaccacttcccaataatttacatgcaaggcttgtggctgcctggaatagaaatatttctttcccacaaataacaattatgttaacatttttgagccttaactatgtgctaagcactatgataagtgcttaacatggattatgttatggaattctcacaaaacctgatacagtaggtattattactgtctttacagatgaggaaagtgaggcttagaggggttaattaacttgcccatggtcaataactcataaatggcagagccaattcttgaatcgagtctgatttagatcttagtgttctcttactttgtagattacagataagtagctttcacttgtgttatttcatatgcatttaataactgtctctgattggcatcataggctgtttcgatccctatgatagatgaggaaacaacgctactcagggtaagaatgcacagatcatcataggcagagcaataacaggaactcattctcatacctaaatcagaatttttttcctggggcttatacataaaaggggaagaaaacaattagagaattagagatagggaggtgaactgaactacaaaaagaggatgaaatgattgtgttggaagttggggaacaaaagaaggtgagttataatagtacttcagaattgtaaggagagagtctaatgaaaaatgaacactaggggacttgtaactctgtggtacataaagcctaatcaaattcttacaaaggaattaaaaccaccaacttcattacaagattgtggtaagagaaatctgatcatgagcataaatcactagtagtaatacgctcagaaatcagagggaagagcaaggcgataccagaggaagacttcggaaggatttatttgtatttgttttgtagcatgtgattttttttttttttaaggtagtgagttaccttacaggcccttacagataagcaagtacttgattagtgtttgttatactgaaagcttaataaatagtaaggagagtagttgttcagttgggtattgattaaggtgaagtaataggaaaagtaagggtagaatcgatgagtaatgatgaactcaaagcagagggtcagcaaactctagccattgggctgttttctttctacaagctgagaatgctttttacatttttggtaggttattaaaaacaaaaatgaagaatattgacagagactgtatgtggcccacaaagcctaaaatatttataacctggctctttaccgaaagtttgtcaacccctgacctgaaatacataccatgaagaaaaaagttagacttgttcccttttaggaaattggattaggtactgtaaagtgtaatatttcatggggctacattttcaaacatgtgcctttttcccacatggaggaaagaactgtcatgtatttagcctgctcttttgctataggggttttgcatacttcgattgttcttaaccttgagagatactataaccactttacaaatgaagaaactaggctcatagaggctaagtaagcctaaagttttacatttaataaggactgaaatgtaagcttgtctggcttgctaactagatatcaaatatgggcatttgtataaatttagttagtatgtaaaatagaaaaaaaacttgtacacatagacaatagagtaggttggagaattgtgtcattttattacaaaatttgcccaaggaagaatatctttggataagttgtaaaaaaaaacataaaatataaagaacagaaaattctagtctcatattaaaaatgtaatattcacctaaaagaaagatgagattcaagatgtttttgaaagaaaatgcaaaatacaaaagtgtgttttgcttcaatagaaagtataccagctagtactttatttttgaaatgcagatattaagcaaatattggcccaaatgtctaacagtaaagatttatgaagagaatttcagagtgctgtgaaaacatgtaatgtagaaatctaggatagattgggagtcagggaatggtttcccaagaaggggccatttaagctgagatacaagatttagataggcaaagatataaaagataattattctagacaagtgtgataggcctcgaggaaggaagaacttggcattgtcaatgctgcagtgcttcccgccttgccttttgaatcccaggttccacgcaggaaaaggcaaggccaggctcctcccctctgcaaaggtgcaaacttgctcaggctccaccccagtgcacaggccggcaggagctttgccagggatcccctcccacttagctgtctcaatgggagggaccattttacaagatgtttaccatactggtttgcagaattagagagagtaaccttaggtgaggagaagactgggatttggagacagaaggaaagaaaatagattcagggtcattcttgaatgttagccttctttgagttaaaaaaaaaatagctgataggtggtagcagcaacacatgtgcctctgattgtacaagaatttaataatgatacttgtgtatgttttacataagcttaaactttagtgaactttagttaatgatatcaaacattgagggttttaatgtctttctactggatatcataagtctgtttttccttacgaaaagggtaatattggctagccgttgaggttagtgtttgctaagagttggaagttttgaacagtgaggaaaacaatgtcactgggctcatttccaagagggtattctaactattgcagtcaacaactgatttgccataaaatgtcaataactttttaaaaggaaggtacattcatgtgtttattttgctttttaaatgagtgttaagtactttaattagcatcattttataattattgatattttgtatgggatttaataatggattagttaattatgaaaacaagatctaaatgttttcttctccaattgccgttaaaatttgttgaaatcaccttattgaacagattttttttaaaccccttggagtactagtgggtgttattttgttgaatgaatgttttacccaaacttatatgcatattagattgtttaaaagctcaattaaaaagtgaaaaatagacactgaaaattttttgagtgatttcacatgtgttcatgaaacaatatatctattacaaatcattgaatattttaaaagtaatgtcatgtattcattttcttattttatctcctcagtagactgagatcagtgtgtaggggtgaagcaaggagtcctactctgtttgactaaggtaaaaattaagaatcagtgagaaatggaatttgcaaaagtgcctgccagataatgttagaactggaccagaaaataggagttggtataaaactagaccagcgagcttttttttccttcaagatgcagttcagtttattgcttttgtaaattagagattgtgtttcttgatctttattaaagtagaatacaatgttaacctacttcaaattttaaaaaatatacacacatgtatatgtatgtgtgtgtgtatatacacacaggattttaaggacagttttttgtgtgtgtgtgtgcatgcgcacgcatgccaaggaaattgttaatcttctagtacatccccataacagaggcagctacaataagatctagtctttgccttacagaccaggtggctttacctgataggctcacagacattcagtagttcatttgttcctcagatttctctaattattgtgataaagttgatattaaatttaccaacttaaccatctttaaatgtatagtttattgtcattaagtgtattcacattgttgtgcagccatcatgaccatccatctctaggagtttttcatcttcctgaatggaatctctgtgccccaaaacaataactacccattctccaccttccacagcccctggcagccaccattatgctttctgtgtctttgaatttgactattccaagttcttcatttaaggagaatcatagagtatttgtccttttgtgactggcttattttacttagtgtaatggcttcagggttcatccatgttgtagtatgtatgagagatgtctgtttccttttaaaggataaataattcccttatgtagatgtatgatattttacttattcatctgtgaatggacaacacttgggttgcatctaccttttggctctcgtgaataatgttgatatgagcatgggtgtacaaatatctagtctctactttcagttcttttgggtatacacccagaagaagaactgctggatcatatagtaattctatgcttgatttttttgaggagctgccatactgttttccacaatgactacaccattaaagggatattttaaatgaacgaacaaaaaaacccagcaggaaaaccctctattcttacagtctttggaattttacaatgaactttctaaaataggatgaagatagcttcattggatttcttgtgtaactaataattctaggaagtgtggtctctgtccttagaggtaagtggtgggcagatttaaaattaatatatcggtttctctttggataattacggagtttggagacattaggggaataacaaaggtgagtctaagtttttccaaaaaaaaaaaaaaaaaaaaaaacaaatacatagagcagaatacaggtgggaagattcctatagaaatgaaagagacagatacaattatctcaaataatcaactttgcttcctgaaagtgtcaacttcgttctctgatctagtctgccttccagaatgcctgcatagttattttcttaaacattagtaatatgattgttactccttaccatctcctaaaagattaagtccaaattcctttatatgctctacaaggcccctcacaatctggcatcaagcttttcttcatcacatcttcttttcatatattctgtattgcagccacactgaatatctcactattccctgaaattcatgtccttccatatcctttgtatatgtctggaatgttctctaattacctgtacctgtaccaactggtgcactcctcactgtctttcaagacctgatgttactgtctcttcctatatgaaacctacaagcagcttccataggtagacactttcctagtacattgttcatacagtaataacatttactaaaatgcattgtaattatctgtttgtatatctatccatcttgctgaactgaatgttcccagaggagagaaagtatgtttattatatgtcatcatgcaaagcacaataccttgtaggcataaatgtccaaaaaataccaaatgaacttatttttctttatttatttttatttttatttattttttgagacggagtctcgctccatcaccaggctggagtgcagtggcgtgatcttggctcactgcaacttccacctcttgggttcaagcgattcttgtggctcagcctcccgagtagctgggactacaggcacacgccactgcacccagctaatttttgtatttttagtggagatggggtttcactatgttggccaggatggtctcaatctcctgaccttgtgatccacccacctcggcctcccaaagtgctgggattaaaggcctgagccaccgcgcccagcctcgaatgaacttattatgtggttttgctcactctattgaatgtttacctttaataaccattacgtgcataagctagaattcctttcataatttcactattattaatatactggatatatatgtattggatataggtaaaatattaagcatgcaatttttttcttcatatttatatattgtattggatatgtgttttggatataggtaaaaatattaggcatgcaatttttttcttcatatttaatatactggatatatgttttagagataggtaaaaacattaagcatgcattttttttcttcagtagtttgctgctgctctatgaagatttccagacactgatctcatagacattcatacattaccccagagtcctcttatcctaggagaaagtatctcataatccacacttaaatgttaatgacataatacattattactcccagaagtgtttgtagtttaaaagtgcttcctatggatgaaaatgcttaactcaaaagaatgaattaatttccagtgctagaattttattcaccttgtcgcctgtgtaaacgatagattttaaggaaataggatgatactctctcaaccctaaaatcacactggacaggcaggcttccaagagcacctctgaatctttagcatctccagagtggtgttaacagggggaatatattctgtttccttaggctgctgctctaagcactttgcccttttggaataaatttgttcttcttatactgcctcctaataatctgcacggcagagaaatgtggtttatctcatggtgcttagcctgactcacaaactacttaagaatttctttttcacatgtgtagtcatttaatatttaaactagtttccatgaaccagttataaatatgagtgaatacttattagctgacttgacatctaaaaggatgtctttctactgaaagcaaaatattgtaagagtcagatgtttgaactctttttagtctagattactcaagaggaaacaaacagcaagatcccatttaattgcttgttattttgaagaaggaaatgttatgttatttttcttcccctaagggccgtgtccagggcagtatcattttggtgtttttataggtctgtgagatatttccaatgtttcgaaactaaaaaacaagtgagattgacataaatgtatctggacagtgtaatgtttcaaagcttatccaagtagttgttctttcagattgaagacttggtattatttgtactaaagtcctattgatataattagttacattaaaaattttaaactaatggatgagaaggacatacctgaatccaggcatggattatgtagatgtgaaatgttaatacatatctgtatatgtgtaattgtgtgtgtgtgtatgcttaagtgtgtttaagttactatcaagtattctaaagggggatgagtcacacatacagacatagcatagaaactgagtttgggcttttgtgttggtctgcctgtgtctgaggctttaccatgtactaactgtgatactgagcaaggcacttctgtgccccagtttcctcatctgtaaactagagataaaagtagtacctgccttttagagttatgcttatcaattgaattaatgcatgcaaagaacttacaacaacgtttgacacatatatggatttaataagtgttattgtttttgtaaattattattaaatattggtgacacagttgattcagagagagaaaagaattaccttttaaaaaagtgactattttgaagccaaagatattagttaatttagcagattgaagtcataaggttgtttatcattaagagactatggtataaagatggacacaggtaggtagtagtttattctttataatataccttacattaccaatttttgactatttttaaagtctcctttctcctgaccgtatgtttatgaaaatgttctttactttgaaacctggctgggtttagaaaatatatgtcctttgtctattttgtgatagacttcaattttgtctaatcagtgtttgaaagaaatggcacttgtatggacttccttccaagaaaaacattgggtgtttcaggaagtggtcttggtgagtcagagcatagtactttttcctctgagtcagttttgaacctccttgatataaataggcatgcttttaccaaaagttctgcttttcacatgttaaaatcatcattgatacatggctacactaagagcagtgccttcattggtttttctgctcagttggcattgaggctcttttatctaattgtgactgtagaaattctgtggaataaatttctttttaaattttcaatttaattctatacttctaaattagtttctgttttcacaccaattttgcttcagaaaggagtggagtcaggtgaccagttatgtaaattttagaggaatttatattggtgataatatacactttaatcattagaattctatgacttctcttttagcccacacatataactctttatagcacaatttcagttcagggattattttgcaaaagactgtactagtttgccacacctcagaattgtttagaagatagaaaagaatacgttagagtggttcttcataaccacattaaaaaacattaaacatgataaataattgccaattgactagatattgttaacgttgagttggttagggaagagtttctttttttgttgttgttgtttttgagatggagtctcattctgtcccccaggctgcagtgcagaggcatgatctcagctcactgcaacttccgcctcctgtgttcaaacaattcttgtgcctcagcctccagagtagctacgactacacgttgtgtagcaccacgtccggctaatgtttgtgtttttagtagagatggggtttcaccatgttggccaggctggtcttgaactcctgacctcatgatctgcccactttagcctcccaaagtgctggcattacaggcgtgagccaccgcacctggcctaagggaagacttttaaaaaggggtgggaattgaggaattgagaaattgctagatgggaagtataaagtagtggaaagggcatttagggtaagaatagacacttaaagttgggtcagtcaagatatgctcaggacagtggtgggaatgagggtttatatgtaggagtatttgagagaatatggattactggaaaaattatgtaagccaaaattatggtcgagcctcgaatggtacactaaagttgtatgtgtgactacatagttggtaacattgtttaattgtcatatatttctcttgagttgtaattggttgaatacaactggtttttagtgaatttcattttataactagtatttaaagaaaacttctctatttctcttaaatatatgatcctgcaggaaaataaaggaactgagagatatagatgtcaaatgatctgtgtgtgcttttgcatataatcctcataacaatcattctcattttacaggtgagtaaaccgaagctgagataggataatgacttgtctaaggtcacagagagatgttagtcaggatttacacttagggctgctcatcttcatactattttcttttcactatggcaaaataccacaataaaagctctgggacatactcagtaagtttttattatttccaatagctgtgaaaaagcaactcaaaggtatttttcttctgaacagaagtattattttcttttaggaataggtctttggactctaggaaactgccttgtgggtaagcttgctctcctcctcttggggagcagttttctgtaaggtttgcaggggcagtcacatcggtggagggatcatttgtaggttgtggtgagccatgctgtggatcatctgtcctttgcccatttatattagtagattgatggtcatttacattttttcaaatctgaagcatctgggccttgattagttggaatctttgattttcattcttgacatatacaacaattacaagaatatgctacattgttttattctatttccttcataatggggaagcagtcatgtggctcttggcaaaactgaccttgcctgaggtttcaacagaggcagttgagattaaacaccattcttgtaaacactgaatctcctatctcctaaatttcaaactggcatcctggaaaaatttctttgttaggatctggaattgaacagctcagttcttaggagggcagggaaagtcatcatgttttccccagctaaatagtttgaatgtgctactatgtgccggtacgtgctattcctggggcttcttagcagctaaattttttttttttttttaaagaggatgaagatttatttttccactccatttgaggaaaataaggaagttggctggcaataagagaggtcaagatggagaggctggaggagagagatgtctgtttactgtgtggatgaggttaacttaaagagcgggggttggggagtctagttgacactgcttgttcttttccttgagtagttctcgttagaagctagagctgctgaattttttctgttttaacttacttggttaaaatatttattagtaagattttaaaattacttttagaacattgttttattctgtcttttcttataagaagatttgagataaacatctccatttggccaagtaataaaatattcacaggcataattttttataaaatattttagaaaattgtagagtttttccatttttcctttattaaacagtttcagaaagccttttaaaatacatatttctttcataatcattcatatgtccccatgctttgtaaaacatatgttgcctcaaagttggatataagagtgtcaattctagttttattgatagcttttatacaactggaaatatgttcccatagagaaatttctgtaatagacatgaacttcatggaacaaagtcaaggtgatgccatgctcttttggaatttggtgattcttttgtcactttagtgtccattgtctttattctggtactatcttggcctttatattgatcctatttctaataatcctgatcatctactgcttggactccctaaactttcagaatccagttccctttttttcttacttatcagtaaagctagattatcagttcttttttatacagatgtaggactatcatctgtaatttttggcaaaagaagaaaaaaatccatgtagttctttttagaggtcatgtgagcatgtgatttttgggtaaaaaactctagccattattttcctctatgtggcaaagtggttgaattttatcccacatctactattaattacctctttgacagtgaacatgttattaaactctgtacctagcttattcatctgtaaagtgggaatggtaattgttcctacttcatgaggcagttgtgacaattaaaagaaaatgacacatgtaaagcagtgcctgctatgccgtgttttctagatgtgagccattgccgctgctgctgctgttctgcctcttcctcttcctgctgtcactgctattggcagtttgtaatagtttagttttccttcatgccctgattttgtaccaccatttggcttagaatgggggacagcagttatgccatgtaagtgatatccagtttatttaatcaagagctggagttaatttggggggttatttagacattttaatcagtttgtgcttgtccctcaagttttcccttcttcagtctataggccattttcccaaatcagtttgtgcttgtccctcaagttttcccttcttcagtctataggccattttcccagttggttagagatgggaactgtgggaatagaaagaaagaaatgcaaatgctggccttacgataattccctcttcaaatctcctcttctttctgacctaaaatagcttacttacccaaacaaatctatctgaaattcccaaacaaaaatctatataatgtgatccgggaacatgaaggttctttggtcactctcccttccctgctaatccaaacaccttttttcacttattaattcactataaagtggtgtgtttctgcttggttttaattccacatgcccgagtttaggaatgtaattcctggcaaatatttttgggggtttatagattgacactggcctcaaagtggacatgtaaaaaaagtcccatttcttcccaagtggaatagtagttcaggtgtttttctctgaccttctgattcatcaagtccatgtttttgtttttttatttgagacagagtctcgctctgtcgccaggctggagttcaatggtgcgatcttggctcactgcaacctccgcctcctgggttcaagcaattcttctgccttagcctcccgagtagctgggattacaggtatatgtcatcatgcccagctaattttttgtatttttagtaaaaatggggtttcacgatgctggccaggctggtcttgaactcctgacctcgtgatctgcctgccttggcctcccaaagtgctgggattacagttgtgagccactgcacccggccaagtccatgttcttaaacttggaaagtctctaaagttagtgttttatagattttactgttttatttttgtgtttcttcatccctactgtcttttattttgcttatgttcaaactgctacctgaaatataataaataatagcattctcattcagaattatttttacatattttttgtcaacagagtactgtttcaccttgtcttgaaacattaaaaacactttcaataaatgcataaattctttgttttaaaggtagactaattatcctggattttaaatagagaaatcctgagagaacattttcagaatgaatctctcagtcccatacttttgagaagttcatagctaggtttgatgcagtctgtgtttgtatccttataaacgctatctgttttatttttactttttaataaattaacagaagttgtcatatttattctttttgcaacctccgcctcctgggctcaagtgattctcctgtctcagcctcccgagtagctgggattacaggtgcctgccaccatgtctggctgatttttatatttttggtagagatggggtttcgccattttggccaggctggtctcaaactcctgacctcaggtgatccacccacctcggcctcccaaagtgctgggattataggtgtgggccaccatgccctgcctcattttcttatttcatgctctcctccctctagattgtaagctccatgaaggtaggaaccctgtctgttttgctaaccatgcactcaatatgtagagctaccctgtctagtgtggtagctgttagtctatatgtggttattaacatttaaatgtaaactaatttatatgtaataaaacttaaaattcagtttcttagtggcactagccacatttcaagtgctcaacacttgtgctcagctactgtattgagcagtgctaatatagtgcatttctattattctaggaagttgtatgggactgtgcgagagcactgatgggcacattctggttacgtagtaattatttgttaaatgagcgaatgaatgaagtagtactcagattggcaggtgccaattaatgttgaatgaatcttgtttgaataatcatgtttaaaagttattttagtttttaattaatccatgttgacatttccccagccaacttcaaaatactggatttatcattagtaaaaggaaagtatataatagtggttaaaagcacaacttgttgctgatgtcatggccaaattacctttacttataactctaatttaaagtctcagattctcattaaaatgagaataagaagttctttttacctcttaataagaagtaagataatgcatgtaaagtgcttgcacagtggctgacataataaaatacttaatgagcattatttttacaataatgaaatagtgaaatatgtctaaatttacctcattcgtgggtgatttcatggttatgaaaaaatttactgctggttttgagaacttctattataatttcacaattttcaaaggtaatgctattcacagtcaaagcttatatttactgacttttaaatatgaaatataataggctcaattattttttccattggaattaacttttcttcctttattttttaatgactatgtaagcaggtaaactctcaagaagagagtttcatactacttttataggcaacttgaattttaaaactaatgtacaaatatctctgcttttgttttggagtagtccacgaataatttgttcccagctgtatcaatttaaatgggcttctctttgggaaaaaattaataaagaatggataaagtagtggttatttacctaaggatgaattccaggttttatttaggcacctaactctgttatgatttaatttctagaaaagcaattaaagcaagagcttttcgtgaacagtaatgtctgatttaactggggttattgcctcacgtccatgctttagcgtattgttttttctctgggatttgaaaacagaatttgttgttataataacaataggtagttaaacatatactaccaaaataccagctgactttatcaaatgtaaatttccttcatttttttttgtgttactttcactctggttgttatggtacctttgtttttagtataaacttgtactcatatttcatagtccacctgaacctctcaagttcacattagaggtgacttgaatttttcatctgggtttttcattgacaaatatttcttaatgtttagacaatgaaaatatgctacagaaaaatggcagactaagcatatacatttgtttcattttttgaaaaattttacttgaagttctgggatacatgtgctcaatgtgcaggtttgttacataggtatacgtgttccattgtggtttgctgcccctgtcaacccatcacctaggtgttaagacccgcatgcattagctatttgtcctgatgctctccctcctcttgccccacctccatctgacaggccttggtgtgtattttttcccctccctgtgtccatgtgttctcattgttcagctctcagttatgagtgagaatatgcagtgtttggttttctgttcctgtgttagtttcctgaggatgatggcttccagcttcatccacgtccctgcaaaggacatgttttcattcctttttatggctgcatagtattccatggtggtatatgcatttatttcacttcctccaaataaaataacagtaaagggatttttaaatgcagaaagccagtgagacaaagggactctataaagcctgtggataattgtgattaacctagaagtccttacatgctgaaacctaagctactattgagagacattgagaagcaaccttattttcatttcagaacctccaactgactcaacagtgagagtgaggctaagaatagtaggatttattagtcatgtgtttaaagtgaacttggatcccagatgcctcctcacactccagtaaaaccagtagtttattctgtggagaatgtgaactagagaactcggttggggataccaaggtacagacagagggtgaaagatgaaatgaaatgcttagtaaacagtaagacaaccctggctgacttcttccacttattgccaaagttttggcagtcagctttacattctctaaacatggaatgggaagatacttccttggagaacctgactgatctatgcaaaagaccgatagacactgatggctggggtctgccagcaggacttctgtgcagtgaagcccacttgttcacaagccccacccatggacactgactttcttgccacctttttagggcttcatcttcaatatgagtaataaccagtaatcacctgatatttaaagcaattcagaagccaaaacaaacctagcgaaaacaaggaaattgtcataaagagacaatgaagggagaagaaaacttaaaaatattatcatggatattctcagaaagatcagagaatatactgtaatcagaaaataagtatagacactaaaagaaaaggaagctttaggttctaaaaatgtactcctgaaaaatggaactgatagaagaaataagaaactcaaaatgttttttgaatataaagaagaggaagctacccagaaagtagaaaaaaaaattacaaaatgaaaaacaaaagagaaaatacaaaagtagagacttagaccaggaggtcctactctgagcaactgaattttttagaaaaaggaaaagtatatatagcaaggaaactatcaaagaaatagcaaaagaaaatttcccggactttaggaaaatgattttcaagtttgaaaaggcctattgtgtttccaatatgctgaatttttcaaaaaacacccatactaatgtatagcaccataacatttcagaacatcaggggtaaaaatgaagatcctagactccagacagaagaaaacagacaggctctatacaaaaaattgggagtcagagtggcccctaacattcagcaggggtcattgaagacagaaccacaagggcttcaaaattatggggcaaaaaaaaaaaaaaaaaaaaaaaaccaaacctctttcaatctacaatttgaaaccaagacaaacggtccatcatgtgtaaaggtaaaataaacacatttttcatcatatacagtttcaaaaatgtacatttctaatgctctttcttaggaagtccctgaagtatgtgccctaccaaaataaaaaagtaaaagcatggaaagagggaggtccaggatccaggaagtaaggctccaagacagggggaacgtgaaggggatacacaaggtggtgaggaatgtggatcccgtgatgaaagctcttcggagccttagagagtaatcagttcagagtggagcagtcatatatctgggaaagaagcctgcagaaagacagaaatgttagagtaatgatagaatgggtggtgcttcaatgtattgaaaggagggctccacttctggtggtgtaaagtaataaaattaacgagggggacataggatcactaagagttggggggaaagataattattaacaaacagaagacaaatatataaaaatggaagggtattcttagtatactgtgaatagcatttacatagattcaataagtaaacactgaattttagtctcacaaaaatgtggtgtatctgtaattcgtcctctgtgatatgattctcacttcatctccaacctcatccctcataacttcctgccaaactgctgacagtttcctaagtgtccaaagccatctcctgcctttgctcttctcttttgccttctggcttactcagctcctgcatcacagcctgtgaaggaaggcagttatgaaccgaatgtctcccgcttccagccctaggcgcaggccttgcatactgtctttctacttgccacattgtactataaatgatccttttgatgtctctctgccccattatactatatatttctaaaagtcattatctttcttttttgttaatttttttttattggtagaaatgggaccttactatgttgaccaggctggtcttgaattcctggcctcaagcaatacccccaccttgacttcccaaagtgttgggattacaggcatagtaaatcactgtgcccagcctctcttgccttttttggtctagtcattctttcagggagattttatcctctagatccacccctaatctagttgcccttgaacttcacactttgctgtcttctattgcctataatgtggtcttttcttaaagatgctttttctttcccctaaaatttctttataagcagtgaagcttcaaggaaagtttgtcctagcttttctgtgagttggatgaggtgctagagatttgttttcttagtaggattacctactgacaatctggcttgttttttttatattcagccaagtgtagacagttagtggaactgacttttttgtttggtcttgactcttctttattgcatcactttctagcagcctattaggactgcctctattcttgaagataaatgaaaaatactattttgaaaagagtgcatttttatctttgtgggcaaaatgttaagaggcataggataataggaagaaggaacagttaagaattgagggttttaacttacctgcttagtcgtgaacttttcatagacataaagttatacattttgctcttgatacagtctgatacctagaaaagtatacaacgtattctgttagaaagcaattacattcccccatataatcattctgctggccattggatctgtaaaaccatgtattactaaaatagagcagacaaattgaaacaatggataatccttgataagatataatacctctgtgttcccttatcaaaacaatcaatgttagaatattatggcaggcaggaagagaggaagttgagataagaaatagtgactatcaataaaatatatgagaagtagtttgggggtagtgtaagtatgtgcattataatacactagaaagatttagttaacctttaaaaaaatagaattcttatgctttttaaagagtcccatgtggtttaacaattaagtttttacttgtagtaatattcgggagatgtatttatgatttagagaagtgggatgaatcagtacagcagttgcctaaagataccattttccacttcgtatgttgtaagcatttataaagatatattgtacactttagaaaagattgatcctcttaaggagctatacggaaatgcagtgagtcacctgcagtattttgtttgctgcttaatgtcctttgctctaggtgatgcagaggaaggtaatcatgtggtgacagggtggttaaatattaaaatattatatctcatccttgggttacagctcttcttgctgtacctgtaatgttttatgatttactatttttagatgccatttaatacaccagaatgaaatttgaattcaggcgtttcagtctcattaaagatgatattaccaatgtttctcttctcctggtccacctccttccccaactcccagcctctgctaactaccatcctactttctacttccgtgaatccaacttttttagagtctgcgtataagtgaaatctctgtgcctggcttatttcacttaacaatgggtacacagtttcagttaggagaaataagttctggtgaccaattgcacagcacagtgactatagttaatactaatgttttgcgtatttcaaaatagctaacagagagggttttaaatgttcttaccacaaagaaatgataaatatttgaggtgttggatatgctaattagcctgatttaatcatttcatagttatacatgtatcaaagcactacattgtacactataaatatatacaattattatttgtcaattaaaaacaaaacaaaacttttaaaaaagatgtttttagagtatgtttttccatcttcccacccagctggtttatgtcaggccctggtaggtctttttctgtttgcttttgtaaagtatgttgagctgtactaatttagcatgtggtgctgttatggaaaaaggatatttagcattaaaaatatatttaatcctagttttctcagtaaatactcttcctttccaaaaactagcatttttaataccttattttaagaagagttgattagaataaagaatataattgcacatccgagcaaataaaactgaaaacttttggcaagcacacagtggtcaaactatcacacaatggtgtaacttactgaaaaaaaaaaagggatataagtcagtcagatcagagtttgagttctgcttctaattttagcttcttctgttactgaaacaagaaaagttcctttgtccccctcgcagggcatgcaatgtcggtgtggcttgtttcttcagtgccccgctgctcagacctctaggggagcatgcagactggcaggctgtgaggttccaatcccacagcagtgtctaggagtgaatgtttacagatgaagcccccgtgggcgagtgttacagggtgctcttttagttttgctgtctatagacagcttgtgttaaccagctcaattagatcctctaccttattgcaaggacagggggttttctgtatcctggggttattgccttggcgtatgggaagaatcggatcacacgtgggcttagagaatgagtgcagggttttattgagtggaggtagctctcagcagatgggggagccacaagggagaatggttttcccctggagtccggctgcccctgctaaactccaaattccgcgtcattctgctggttagtggcctgcagcatgctagtgcctgttggtgtgttcctctgccgatgtgcccctctcaatgtccagctgcttatgtgcctgcctgctaggttctcagggtgtttataggcacaaaatgggggcgtggcaagccaggctggtcttgggaaatgcaacatttgggcaggaaaacaaaaatgcctgtcctcatctaggtccatgggggtggagccctaaccagtgaccccgccttcctctacccagcacttcctttccccacttctgtattatttaaagggaccactcccttcccttccgtatcattaccacttaggcaaatgacttaaccgccttgaggctgtcatctcacccataaaatagagccaataactagctgataatgttgttttaaggataaagtgaggtgatatttgtaaaatgtcttatgaactgggggctcattaaatgttttctttccctttctcctttgtgttcacttctgcctatgattttaccttagatgcaaataagacattacttttcagtcattcatggtactatgtgattttattaagcttcaaaataccacacaaatggcagtctgtttgtttcaatttcttcatctataaaatgagaatgaagaatagtacttccttcaaaaactaatgtcaagattaagacaatagaatgcatttagcatgatacctgatgcagagttaaaactcaataaatagaagtgattctttttaaaattagcatagtttcccaagtcagtaaaatatcaaaacattttgaactgagatattagtaatttccatgtatagtatagcatccagtagtacatgtgtgctgatgatgtcatcatagcaactcagggaatagacaagaactggagggaaatataatagtagtattagaatatgtctatgcctcttttctttattagcccttcctatgaacaccatcacaatagcaaacataattagtgctaaagtagttctttctaaagttgcatattaaattttgttataagtagttttcttcagccacttgttaaccaaacaacattctgatttgatcatagacttttcccaaaattatgttctgatttataaacagcttaagaattttgtcataaagaaagaggaactaagttaactattttaagtgattttattgtgttgacttaaaggcataaaactactccatttacattgatactggtgttgagaaaatactgttcttctatatggtctagaaattgtgataccttcacaggcattaaccacattattgttacaagaacttaatatccttattagttttttgagtttattcacacataaaaattctttgttaattgatatttgaaaaaatagcatagaaaaatacatggtgccgtctttaccaatggtactggaaagagatattaaaacgtgattgctctagaagacattgcaggagacaaaatgtgtgatgatttaagaggtttaaagaagattttttttttaatgtttgaaacaaaatcattgttagacaatgtcacaaagtattggtggaaattaagtttcactgatcttttagtgaaaatcctaagtaatgataataccccctcccacttggttgtaacttagactgggagacataaattaaattaaattgaaacctagacatagatgtttcaatatcatatccaaacacacaaaaacacacttctgtagataaaaaaatctgtgatattttctgagaacacaagtcatttgaaggacagttaaatatgcagagagttactaattatgtggcagcaagattgggtaagtagttttctaatattgagtcatgactacatactcatctaccaatttgaaaattgatatgagatgcaagcaagagtaaagaaaaggaatctaaaacttatatttgaggatcttaaaaccttctgatacaaatttaatttgctgagttaaccttatagccttgtttatttcttcttagtcattttttatatattccatttcctttctttttgaaaattatagtgtgttacatttttcattcgcttaacttagatcttaaatttatcatttgtatccttctaattgccaaagaattttattttctgtagaaaataaagataaaattatagtaactacgacttactaaaagtgttttcataaggaaattgatgctgttacttaaaatcaaatatagctgacccttgagcaaatgcagggattggggtgctgacccccactcagtcaaaaatctgtgtataactttgactcctctaaaacatatactaatagcctactgtctacctaagatcatataaatagttgattaacgtattttgtatatgtattatatattctaaaataaagtaagctagagaaaatacttaagaaggagaaaatatgttcactattcatgaaatagaagtggatcatcatgaaggtcttcatccttgtcttcatgttgagtaggctgagggagaagaagtggaggggtcggttttgctgtctctgggtggcagaggtggaagaaaatttgcttgtaagtggactctgcagttcaccctcctcttgttcaggagccaactgtaggtggtagctattatgatggctttagtgtatactttcagcagaattatgtagttagtgtgattaactgcatttgtgagtcattaaacttaaaagcgattaaaaaaacctttgtctctttagtttttaggttgctttaacagtttataaaaataaaaacacttaatttttcagttagagttgatcattattttaaattgtgtatatgggtataaactgggtatgtcttaaaagcctaatggaaaaaaagacaaacatttgtaattgtttcctccgcatggtatacactgcaatcgctcaaattgggtatttgaaagcctccatatttgccacatgagccgccgtgataagtgaaactgtgattgccaaatgacaaaaagtttctatatttaaaattcaatttagcaaattgccattttctatccccttttctaatgttctcttattctaacagatcactattttaaaacaaaagagagaccatgcatttatttgattgtcatgaagaattaaacatgaaaagatgagatgctgtggctatcacttttcattaaaaccagctgctgtggttttaaaacgcaaaccagatcaaaatcagcacaaaccctgggggtttaatttatatactgaatgaaccagcttgctttgaaagaacacttctttttttttcagttttggaagaaacttgcacatctatctcatttcatctttacactagcactgtgagctcggaagacgaagaattatctctattttactgacgaggacattgagacagaggccagaggcttaattgactttcctagcccagttagtgccaggaatagtgttaaaattccagactatctctagttccataatgttattccaggcctctgttctggcccaaattatagaacgtagcaatgatgtgctgcagttggatccttagccaatcgtgaagaatttaggaattttgtaagctgctgttaaaccactgactgcttgaaattggccatggtgggaatatttataccatggaaaacaataagcactacaaatcaggccctctgccttgtcccaccctgagaattggtttaccagcacaccactgattgtatccaagtgtaaactgaagaaggaaaacaacaaaaatggagcacagcaatgtaatatacatgtaattttataagtacatgcatgtatagggcagaggccgatctttctttgcttcttaatttataaatgtgcttttaagcagtggataggaaagcttaaattaaagtccagtgttttgagggccattcttacccatttttttaagaactaggtcaagtcccagcccttccagaaagtaatgacagtcttcatggccttttccctctccgaacttctagcagatttaaaatagagctacatatgttgggacttaattccttactatttgttttacatgaattaactttgtttccctaagaatacaataaactctttgaagagtgggacatggatttccttctttctttctttgaataaatatttaatgaacacctattctgtgcctggtacccttcttcttatttgaaaagcagaagtcatcaaacaaaaattcaagccttttgggggctaagagtttagtgaagagtcaggtattaatttaagtaaaggaaaagttatgaatgtgataaatgctttgaaaaattgtctatagtatggagagtgtctgatagtgggattttatctatccaggacggtcagtaaaatcttcccctgaggacattgtgattgaactgagatctgaagaatgagacagaattaactcgaagtgaccagatcttgaatattatttctttatgtaggctttctgtgctcttccaatcagagttaagttctgttattatttgcatccgtgttatgatgaatgttccctttgtaatgataagtacaacttaaaattttacacttattcattatctgtttccccccactagactgttggccctatagttgggaccatgtctgtttggttcactttggtggtcccaatatccatcacaggacctgaaacttaataatcaatatttgttcatgctttcacccccttggcccataaagctggggtatgtcctgcctaactcacagttattgagaggacatagtaatataatatatttgaaaagacaaaattcagaaaactaaggcaggatccaggatagcttagtgacacaaacccggagaggaccaaatatccaggagtgaaaagaaacaaattgggtacagcaatgttatctagaagaaagaaaaggccattccatttggtaaagaggaagttttactaattatttgtcttgtttgaaggaagtttgttcaatctgtaaaatagatttaaaaatggtttttgaggttaaatatctgatattgatttttaaagttattttcttgtgaaaagtaaaagaagtgtgtaaatgaaaagtttcttgaaaaaaggatgtgtccatgtgcatttgtgcatttgacaaagcacatgttgtcaaatgtgctttgaaggaaagaagaaataaaagaaggaagggaggaaagaaaaccacttgtaggcaaaaagactgcaaggtaactgttacctggttctctgtaaatgatagggctctgggtgatactttttgcttttgtacttttctgtatttctcaactttttaaattaaatgagtttatattacttttataatggaatagtaaacaaaataacatctcataaaattgatagttgattatgagtttgggcagaatgtagaattatgtctatatgctttgagaactcagaactatattttagatttttcttttgttcacctaaatctgcttataattttagcatattaattttaaatgccagttggatctttgtttaaatgttcatctatacctctggggcctgagctctttgagggtggagatctttatctttgcatttctactataattcctggcagcaacacatatttgttgaatgaataacttttgaaactgagatgtcttgacctttttattgcctttaatctatgtgtctttctttttttagaacacacaagtgaaagacacaatgaatggtcatatttctaatcatcccagtagttttggaatgtacccatctcagatgaagtaagttgaaaagtttatatttaatatgttttgggggaatttgatttggtgattttaattgttttatatttttagtgaaaagattactttcgttgtgtagttcagtagttcattcctcattaatatgtaatatctttgttacaacacatgttattaaaagtttactatgtctgataagaataagatggtaaagtaaatagccttatgataatgatattgatctcacacttggaagatgtttctgtttcattctagtactttatgcattcttgcttttcatggttgaatatataatctacttcagagctttgaatttctgtggtgcattctgttattgttatttataaaatattggcatttgagaagggttaaatgtcatttagtataaactaatcaagttatttaccactgtgtaaaactagaaaagatcaggcaaactaacaaaatatttccagtgggtccaggtataacttgaaatcataaccctgacttaattggccattgtcttatgtattacgattaatgttattatttgacattggccattgtggtatatattttactcatcattttttcataacaggtaatgtttactattttgagagaataaaataaaatgtaattcttaatcatgatgctaaaagccctcaatctgccacagcttctccagtcattcgtctattctgggaatgttacattaactgcatctttccacagacactgtgctatttcttgagtcagttccacgtaccttttcctcacttgattctctgcctgtttatagagcttctttccattcatttagattctgcttgtgtcaatgcggtagtaaagttttcttagatatgttgatgaagagttagtccttctttgattttacatgtcatatctattagttttacccagatatcacattctattataattattttatgtacttattttattgacagcaccctgtttccccctcccatagtccttattcttctaggttttgggtcttacaaaaatgttcactgaaaaaatgagtaaaattcaaataaagcactatttatttcacataacatattagtagcaagaggttagatagcctcctgcatagctgggattacaggtgcctgccaccatgcctagctaattttttttttttttttttttttttttgagacagagtctcgctctgtcaccaggctggagtgcaatagcgcgatcttggctcactgcaacctccacctcccgggttcatgcgattctcctgcctcagcctcccgagtagctgggattacaggcatgcgccacaacgcccggctaattttgtattttcggtagagatggggtttctccatgttggtcaggctggtcacgaactcctgacctcaggtgatgtgcccacctcggcctcccaatgtgctgggattataggcgtgagccaccgtgcctggccatcagtatgttcttttaaacacgtggtgattatagtgcattggaatttttattttctagttgagtttctgttacttatattggactttaacccaacacaatgacctttttatattattattattattattattattattattacagtggctacggatcatcacctaccttttcccagacggacagagaacatggttcaaaaacaagtgcaaaggccctttatggtaggtttgtttatttgatagggtataattttgtttctaaccactttttacaaattacattttcaaactcatggtttgaacccacacatttaatattgtttggaatgaggcagtgatagctaaataaggattattttaaagaagagtttttataaaaactaccaaagccatgaactctgcttgctgttatgcattttagaactacagatgaaatgtattgcagtgctttcaaaagtcctatgcatggtgccaatgccctaggtggcttttcccatttactacttgtaataatgtttgttgatctttgtgactgatctagttggtggtgggctgacaggtgacagaacgttttcctgatagctcttgaattttggggggtattattacagtatgtctaatagatgttatataatttctttatgcactgcaaaatgattatgctttttccctgatcttacttccagtgccctctctggattgtctcacatatacatactattttttacacttcagatacaaaatagaagtcataagtaacaagaagtcgaggactcctgaagtttgccacatatgtttaggatggcatttatttgtatagggtctggatggccacttttattgtataacaataaagaatgagaataatattgtggttaatagcaaagactctggaaccagacttcctaggttcaaattcagttatttattatctgagtgatcttgggcaaattaatttacctgcgtgtgcctaattttgcttatctgtgtaatgggggtatctcacagggttgaaatgagcattaaataagttagtacatgcaaaatacttagaactgttcttggcaagtagaaaacactgtatgtgtttgctattattattgttgatattatcgatattatgtgctataggaaccaacagcattttctaaattgtgaaattctttttttacattatctagatctgcaacttcttggctgttgtaagaataaacaattctaaggttttgtgattgtttttctacctatgttagtgaattggcattatcactgaaatcagacattcataaaatggatttaataccatacatgcctatactttttatagccttattaatctgattgttgttggtttcagtttattaagtattgtgacattattaccatggtctaatagttatgaattgtagatctagagaatgtattcaataaatattttgtcattaatatgtgtacagaacaggaccaaaaatatatgatccctgactttaagggacttaaagtctggagaataacttgaagataacagaaaaagattttttggataagaataaaataattcagtctttcatttctagacagatatttattaagtgcagtatttattaagtatgctatgccatgatcttcatagtctttatttctatgtgctttcattcatttcaaagatgactaagagaaggctgttgcctatgtgccattttggtgcaatagactagtaaacacattgttataataaagggctaaatgtgcttagatagtagtgtgtaggaggtgcactggtgagggttgatcagaaaggatttaatagaggaattgagccttgagctgagctgtgaaagttatattgtgttcttcagcatttcaggggtcggaggatgctacagacagtatgaaacccttttaagcaggactatcaatgctgtgaaggtggcccatatttgtcttgttcacttcaggattccctgtgcttactggcatagtggctagtatataatttatgctcagaaaatacttgcagaatgagtgtaatgaattaatcagatgcaagcaatttggtgttaactggagagtgcatagtggtgcattgggaaataagactgaaaaaatgaacgtagaccacattgggaagaattatactaaggaatttaggcattgtttacaatgaatgagcagcctttgatgttttttactcaggatagtaataggtcagatttgttctggctcactctggtagtaatattgaggatgaatttgatgaatatggatggaaataagtgaatcagagatttaagtaatatggcaaattagacacctaatagtagcctaaagacttttaataaggagaaagagtattaatcctgtcagaaataccacagatctaaaatctaatttcagagagctaagaaagaaataagaatagaaaatagaactcacctgtaaattttaatgtttatgttgtattagaagcaactttgtaaaatcttagatccaaggaatgaaaaatcttacttttttttttttttttttttttggagacagagtctcactctgttgcccaagctagagtgcattggtgcaatctcggctcactgcagcctccgcctccagggttcaagcgattctcttgcctcagcctccagagtagcagggactataggtgcatgccaccacgcccagctaattttttcatttttagtagagacagggttgcttacacctgtgatcccagcactttgggaggccaaggcagatggattacctcaggtcaggagtttgagaccagcctagaaaatctttagcttttaagcagttaatttttattttcccccttttacatataaagcaaagtgaggcccccttttcaagttagatgattatcaaagtcacataactttaaacttgataccactgtaacaattttgtatactgtaatgaaaatgagcagtgtataggtacaatgagatagaaataaatggattgaaaggggcaaatccaagaagcatttatagggaagagagaagtcttagcaatggattgggcttagaagtaagatggctttaaattgcagatgtggtttctttcctctttgtttctaatacccaccactgtctctcaacacactgcacaaagacatacacacagtaccttccctctgagagttctcagaaaatgcctatggaatgaatggacagatggatggatgacaagggagaaatatgttcatgttttgaagatagctttgcaataaacagattctagttgaagtttttttttaggtagctttgggagtgtttagcatcccagtctgcatagttttaacttatgtatagcatctgttatcacatgctagaagtatgcatgatataacaacatggaaaagagacaggcttgagatccggccacatgggaaaaagcagccctaaatattcagaagggagatgaatctgaatgatttggtgtaaaggtaaggaatgcagcccccgagtttcacagcgcataagctaatgtgcacacacatgatcctttgtcaccaagaagagattatatgtatcttcaaaacatgaacatatttctcccttgtcattcatccatctgtccattcattccacaggcattttctgagaactctcagagggagggcactatgtgtgtgttttgtgtggtgtgttgagagacagtggtgggtattagacacaaagaagaaagaaaccacatctgcaacttaaacagtgtgtgctggcagtgtctcttcttaactggaaagttagtaaagaagagatttatgatataatttgttttctcacagttgatgcatcttatgtaaaatttatccttttacaattttaaacgagttgaaatcatgttccaagaattaatttgccttcatgggtggtacatgaacatctttgtaataggaggatactgttttgtgcactggaacatgaatgttcacactgttttttacgcactgaccacagtctagatactctgtctgaagtttcatgcagagtttttcatgagaacacttttcaggtctgacactatagtgggcctcctgggttgcttctactgaatgtgctcggaaaggcagcaggggttttggaggccagaggatctgaatcatggtactgctaccaaatggctgctgtctttcacaaatgattggccccagtttcctcatttataaaataaaaatgataataattctgtggtaagtttatatgagaaaacagaagtaatgacgccatcatgggaatggggagtggtactggagagtcactttctgtcctgggtcctcagattcatcaagattctcaaatgtaatattttgatattacctccaaatgatgttagacaattaattatagtgatattttgacagaatcaagaggtgactttcattatatattttaaaacttatattccatatgtcactccctataatgctctagaaatattttttataagtggtataattgtattgtgaactatgcttgtatatgacaataaatttgcttatttgaggacatattaatttattcaaggaaaatggtgaaaatatgctgccattttaataacttgattttgccatttttaaattaccatacaagaaatttctgagccagcatgtgaaagactctgcatcattattgtcactgacaccgtaacacttacttaggaagataaatattaatttctctctcctccagttataacagtaacattttacttagctactgttatcagaatactggaaattttatatttttttccaactaggctgtttgtcaaagcctttaagcactaaaatttaaaattgtttttaagggaaataattgtaaagtatattaaatattcccttcgcttgggtgtggcagctgtaatctcttcttggggacaaaggatcatgcatatgcacattagcttatgcactgtgaaactcagggactgcactccttacctttacaccaaatcattcagattcatctcctttttgaatatttagggctgctttttccatgtgactgggtctcaagcctgtcccttttccatgttgttataacacgtgagcttctagcatggcttctggtatctgtaggctgggaaactagataaaaaatgttcttagtgaataggttctaagtggggacttgagagtcttttttttttttttttttttttttttgagatggagtcttgccctgtcgcccaggctggagtgcagtggcgcaatctcggctcactcctgggttcacgccattctcctgtctcagcctcctgagtagctgggactacaggcgcccgccaccacgcctggctaatttttttgtatttttaatagagacggggtttcaccgtgttagccaggatggtctcgatctcctgaccttgagatctgcccgcctccgtctcccaaagtgctgggattacaggcgtgagccaccacgcccagccgagagagtcttttccactagagtctgtatgttaaaatatgcacgtgttaatgtatagacatggtggcatctctaacaaacgctcagaggacttcatttatttaagtgtgggtattattctatgttctgaatagatagactttccagaaagctaacttctctttaaattagatattgcttaatttggaatgtgatcatttcataaattaccaactgcttaaagtcattttatctctagaaaactcatttcattgaattaccaattagtaatattttgttgtcattaccaacacctacagttaactttgagattttattattgggaggacaaataatattgggtcagtatgatagaaaggtactcttttaagtctcattttatttttattttttgagatagggtctcgctctgttgcccaggctggagtgccgtggcacagtctcagctgactgcaatctccacatcctagttcaagtaattctcctgcctcagcctcctgagtagctgagattataggcgtgtgccaccacacctggctaattttggtatttttagtggagacagcctttcgccatgttggccaggctggtcttgaactcctgacctcaagtgatctgcctgcctgggcctcccaagtactgggattacaggtgtgagccaccatgcctggccttaagtcttattttaaccttaagtttaaactgctctgtgatgttaacaagtaggaaaatatatttctgtttttctatctttgtattttcttctcaaggaggtgttggtaagaattgagtataagtaacctataaactgcatggtgaatttctgtataattgggtttactataaactttagttctacacagtgcttgattcaactcttttgtagcagtgttcctgaatttttcttaacacatatccattccatatgttgtccttttcatacctagctttctttctcttcttgtctatctcctgatcttggtttggagctagtctctctgtttaatttttataattaaagcccaagcaattttttacacattcaagtagtacttaagagttaaaacctgtttctcttttgcccatccttatttacagtgtgtattttacttaaagaaaacattgaaatctttttttttaacagaacaaatttttttttgaaattcttaagatgtaaatggcttctaattcattaaatagtatcaggaaattgagctaaatgtttgagtcaaaagttcagcttgatagaatgtggcagaacagttgactcaaaaagacagttcggcagttttcccaacttagctgaaaattttaaaagtcctttttacctcatggaatcagccattttaataatttgttgaacaggccaataaaattagttcttaatgtagttttaaagaaatgattttatttttcataatggtatgttggttcggatactcatttgtcaagctgtgattgtagttgcctgatattgagagcttgtaattatcactcagtgctcctcactgattcccattaagcacctctcccctatggaatagatatacttagacactaagctagtgggaaaggaattctcccttactgtggttgaaagtttttgtaagtataaagtaatatgagttctagcccattgttttatttagagagaggaatactcagcagctgcttttatgttacttttttcttgttaatggccaaatccttactctctaaggaacatttttgtttttagagaaagagaaaaaaaattctaaatattagctgtatctttgaatattagccgtttcaaatgttatattatgcataaacagcaatgcatgtgaaagggaattaagtgtaaataccaacacctggatgctttttatacttgtagttcaactaattaacaaattaaatgaaacctaaatttagtatttctgatctgggagttgaatatcaatttttgcaatagtgtatgataaaattgtatgtaaatatttttcatcgttggttactgaattcatgtaattctgtctgtttggagttgtacattctggaccatgacataaaagctaatagacaaaatagtgaaacacaaccagtggttctatagccaagtaagtttcatcctacctctaattgattctgagcgagaaagagaggcaggggccagaataggaggggaaatagacttagtcttatgttaggagttgagcagcttgtactactagaaacctaaaaccctactgccatgtttattcatgaatttattatttaatataccatttgacgatatttacattcttaatttggaaaggaaaatgttctgcttgaagagatagtatatagtagatgagttgcacactgttttataaagttcattccaacatgcagccaaggatgagaaccactgttagcaaaagtggtgaatttcattagaggattcatcttgagtagtgttgagagattttagttaggctttttatactgttttaaggctttggtgagatttctagcttaggagcctaattactatttataccagttcttgtgaatacatgtgattctcataaaaaagaaatgtattataattgccttttaggaaatgtctttcaaaattgcctattaaaatgttaatattaacctttatggattgacttaaaaatcactggaactactagtttatttataagtccatttatggcatttatacatttttaggatctttaaaaggtagtttcttatacaacttatttattgtacaacatagagaaagcagcttaggaattcctaaagtggattcttaatttggaatattagaaatgacaccatatcttctaggcactcagagtgatcggttaatgtcatactgtttaaaatgctatcagatagtttttcttctcatttctgtaaattatgtttctgtgggattgggaaactatgggttaggaaatcaagaggtcagggataaattcttaatacttcataatgagaatatctaaatagaaacacacagtatttcagatcttcaactgttgtatttgccaataaattacctgaaagacaaagcatttgaacatccaggagctgccatatcatgactgggtgtcatggcaaccactgccatttcttttctgtcctaaggtcagatcaaagcaagccgagccctcctgctctgaatctatcgtggacagttgtgttagaatatggtgaaccagtgactctgaaatagtgattatttctagatgtggttttgtgaaatatattcctgaattatatattgtattacaagagtcataacggctgtcacagggacaattatcgatgtgttaatatctcacactgattaatcctcaacaactaatcagaaaaatcacagtcgctcactttttaaaaatatgtagaatacagtcatgtaagtgaaggtttatgttttgttatattgggagagaaaattttaggtgaaaccagatctttctttttgatgacattattttggtaggaccagatggatcatacttcctcaggtcatcatccaaacaaaaaaagaaaggtagcacagagtgaattttgtagtgcatctgtttttattaagtaattttaatgctgcaaaagcaaaaatggagtgtattggaatatcagagtaatattgatacaaggacatggagattttaatctaaattttaaaagtaaatataaatgaaattcatatgtgttgtaaaatgaaaatttattaagttttcttaaaattctgtgttaatgttctgagtctgcatatgtatatatgcactttatatttttgtacttgctcagcttttatgttcagcagaactttccaaacaacttatctattatagaatatctatactaactaaaagaaataggtttacatttacaaaaaaataggttgttgggaaagctaaggtatatctatatgtcagaatgttaatggcttaaaggcctttaggtttgaccttgtttaatccttttattttacagtaagggtgctgaggcccagggtattaagtttcttgcccaaatttagtttcctacttagtgacagagccgaagctggaacaataaatcttataattccctctcagagttatttttcatcatagcattctgtttagaagaaatagggcaactctgaatttacaaataagcaagttgcttgattagaaaagtaacaaatagtgctcactttggcagcacatatactaaaattggaatgatacagagattagcatgacccctgtgcagagatggcactcaaattcatgaagtgttccatattttaaaaaacaatacaaattttaaaaagagagtaacaaataccaaatattgccgacatacattttatattttaatgttatttttttggttttgcagcatttcagaaaagaaaattaaaggtttctttttgctttttaagtagtttggtgcaataactttctacctgactttcttgtttttcctatcagcttatatttataattctaagtatcacatttgtgtgttttgtagatgtgtgaaaactgttaatatttaatggcaagccatgtgattgaatcatgttttaaatctcctctaacactatcccaatttggatattgcaaaaggagatgttccttgtaatgcctattattttaataatgtagtctaactcatataatacagtatctatgacaatatttgcaattacattttgatatcagtgcagtaacagatgaaatttataagccagttgtaattgacttgtcaaacagtaggtccctgactgataaataaaacctttagatgaaataactttttttcttataatatttatactcttgttaacctttggaattctaaaaatggatagtggatcaaattgttcttgcctattatttagactttcttgtggtttttagatttactgcgaataatgagtgttttcagatacaccacacaatggcaacttgtcagctactgtatttatatgtgagatagactagttttagagatagccacatgataccaacatatgaacttcagtctattaggggacaaatcatggctttttcaatttctctttcagaacaaaggaagaattatgcacgggacagtgtcagcagtgtgtcagatatatctcaataccgtgttgaagtaagatgctttggtgtttgctagtatttagagtgacccttgaggaacataaaaattggaagttaaatcagaattctgttttatttcattcttatgatgtattttaagttgcattgacctttttgtttagattttttaaaacagatattacatataaagtatcttgttagtctgtggtctattttcataaagaatgatttaaaatcataactactatccatttatccttgccagtcttatttcacttataatagaataatggcttttactttgtactatagaatcttcttgaaattaagcctttgctagtttcagtgagcaatttagtttttagtttaactaaagttattgccagttctagttaaataatggttcttttttagtttttgccctcttttacgatatttgctcttgattggaatttatctggttgacctgtgcttataatagaaaatatttaagcagggaagtaatttttaaattgctcttattttcagttttctacctatgtcaagcatgcttaatcaaatttaaacagttttgtttcagtaagtggttttagtggattgaatagtttgacagttcctatagactagaattgtgctgttgctacaatcagtgtccatagttttgaagctcccatacagatagcctgctgtttaaatgctgctatgttcagcatttaaataaccataatagagtgtcaaataggggaaagtttattttaagagaatattatttaagctgttaagaatttgttttaatgtcatgtttatgtagttcaacatggctccgtatgaaacagatttaggtatcttatgagtcaaaacaccatttcttctattcaaaaaaaaccttggttggctttattctctcattaaaatagtcatgaagttttaagagtactttgtgtttgtcgttctctgctagctgacctcaggttatttgattttcttttggaaaatgtatactaagaggttgtatgtgtttgtatgtgttataaatctttttcctttttgccaattgtaagcacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatcaaaggcaagtgtgtaaaatttatactattttattttcaagaaactccacaaatattaatgtttacaatcatttcagattgtttgaaaatggatggaagtttgacaaaataaaatgttcactttatttatagaatgaactggagaattttcctttaaacacaatccagcactgccaagctgtgatgcattcatgcagctatgattcagttcttgcactggtgtgcaaagagccaacccagaacaagccagatcttcatctcttccagtgtgatgaggttaaggtaaaagaatggtgaaatttttgtttcttctttaagcagattgtctgggagcttttgaattacctattttgataatatatctgcatattagttactagatttttagtttctgagcatctcgtaaggaaaacaaataccttagtatcttctctaggatttccatggcaagtaaataaagaaattagggtgatgttaatcaaatcagtagttcacacttgtaatcccagtgctttgggaggccaaggctgtaagatggcttgaggccaggggtttgggcccagcctggacaacatggcaagacccagtctctactaaaaaggttttaaaaattagctagatgtggttgtacacgcttgtagtctcagctactcagttggctaagggaggaagatctcttgagccaggagttggagattacagtgagctataatcacccctctgcactccagcctgggcaacagattgagattgtgtctcttaaaaataagatgcattctgtttatttttttaaagtgtagataatatattaaattcacatcaaatgccttaaacttataattaaaaattgattgttcagaaatcttgctttgtggacagtaaataatcatgtaatttgaatttattctgcactaatgacatagcatggattactgcaatgaagtacttagacatttcccacgatattgatttaaagttcaccatttaattatgtgacttgattcattgctcaggatttgtaattcccagatgatatgtgaaaatagttgagccagtaataacaggctatatcctgaaagtttctatttcaaagtacagtgtaatttcaaatgattataatttgtgatgctttattggaccttagaagttatcttcaaccttgaatgtgtttatttcctcagttgttttctttaaaagagaaatcattttgtgttaattggtactttgccaaagcagtgatttaacattttgatgatatattataaaatatccatgtaattttattttataaagaaactctaggagattagcacagttacttgatcttttctgtgttttttgacatttaaagatgatagataaagtaagattgactgtaaactgtattttataattttcttctaatttcaatttacgtcatggatgactttctaaaaaccttcttctaaaagaactggcatttaggtaatttgtgtaagtgatattcatcagatttttgtatagtgccttttgaaagtcatagtatattataatttttgtaaggttagatatattcagtcaataaatattaaagggaatattttgctttaaaaatatagtgaaatttaattcaaacatttttataaaccagaggcctaagttgaaaaacatttcaaatttgatgtttgtatctgtgttctaaaaagccccccccgggagctaaaagttactatgctgtgaaaagtttctggattttaggtttgggaacaaatggcttgctttacttgatatggaatggtaatgataatggattcaaaatgtatttactgaatatagttttgtcctaaccccaaaagctcacataccacgaagcactgtatgcatttactcattagtttcatactctgcatatgagacatttttcgcttggctggttaaaaatatagaggcaatgaaaaacgcagtttcttttatatggctcattgtgcaatattgcttttgatttttaaagtttctttattataggacttcatgcaatgctcctgcccacctttgcagtaaaatttttcttagaaatataatagccccagtataagaagttgaagattcctaggcatcttcagttttcattttgggtttttttaaataattatttttaattaaatatcttttcatcttcagttttagtatcctatgtaacagaaagcctttgacacgatatttgtaatgtcttattgaaactaaatgctcttaggaagtcacactggactgggatgcattggcctctcatttaactagcaatgtgaccttggccaggcccttttatacaagtactcctcagttttattaattagaaggaactgatgagatgctcttttaaatatcccatcatttctaaagttttatgattatcgatgcttactgtaaaagaaatacaacatacatatttgagaaaacattacagagaacagggaggcccaaacatagatggtgcatctcatcaacattctaatatagagtaatgatcactggctctaaacaaactttgcaaccaaacagaaacttcgtatctgctaatctcacgttgctccccaagaaaaatctaactgaatgttctggaaaagtagtggaaaagttaattgtttgcagaaagttaacttttacctgaagtgacaaaataaagtggttacccaaaggggtaaaacctagcgttggagtttatcttatgggtgtagtagatttgccttaaactcaaagatttgttttgctgggttaatgggtgtccagtggatcttgaggatgagaaagggaaggaactctgttctatgtgtgggagcctctaaccccttaatttctacccaattagagatttttactcagtttcatttttagcgtgtacatatcctttctatcattgcctttattcaaggatagtttccctttaagataatcattaaaaatttcttcagtttttaaaatcttatcattatatagttcaccattataaaaaccacaagagtcatgttttgcaagatttttataaaaagactttttacatcaagatacttactgattcagacaaggaacaatccctttttctgttttaaactacatatcaagactcagaaaaatccataaactttcaggtaacttgtgtctctttgcaggcaaacctaattagtgaagatattgaaagtgcaatcagtgacagtaaaggagggaaacagaagaggcggcccgacgccctgaggtaaaagcattgaaagaaatcaaggagtggaattgatttgtttctaaggcttttttccccaaagagttagaaaaattattttctatggaagtatattattgtattgtatagatcataacctgtagtctcaacacatttgttctcccaagtttgtcagtgtgtttactcctcttctctccatatttttggtctttctctgatatggcttcacttgtgttggaagtcacagagtcatgaaagatgagtggcattttaagagaaggtatcctagggaaatacaagctagacagtaggattgtaattgttccatggccctttcaaatcacataagactcagaaggaaaatcaacctagttttcagctgactattaatttttttatttcatatgcattcataaatatgcataatgtgtaatgcttaggaaatccttattgtcccttgacatagttctttttgaattttaataactagtaccacaagttgagttaattgatatgttatagaaatagagatggtaaaaattctatttgttttcatctttttaaggatgatttccaatgcagaccctagtataccgcctccacccagagctcctgcccctgcgccccctgggaccgtcacccaggtggatgttagaagtcgagtggcagcctggtctgcatgggcagccgaccaaggggactgtgagtcttcctagaattaatacttattgaacacttactttgggttgggacatagttcttgctttcaaattctgatgctgatttcagaactgaagcttgaggttagtttttaaaaaatcaactctggccgggcgcagtggctcatgcctgtaatcccagtgctttgggaggccgaggcgggcggatcacctgaggtcaggagtttgagaccagcatgaccaatatgatgaaaccccgtctctattaaaaatacaaaaattaggtgggtgtggtggcatgcgcctataatcctagctactgggatggttgagacaggagaatcacttgaaccgggaggcggaggttgcagtaagctgagatcacgccattgcaccccagcctggacaacaagaccaaaactccatttcaaaaaaaaaaaaaatcaaatcttagataaaataaagttaagccttgaattttgttaagattattatctgtaagagtttagacccaccatttaataaatatggtattagggttagagtctttttatttttttaatgctaagaggaagttttacttgattgacaaaaagatggcaacaaaatatatacaggtttttcttaaagattgcacttaacattctttccattttttattatctaactagagtccctttttggacaagtttgtcatattcatggaaaggttgtcaggacagtggttggctgctggcagtggagaagggtaaaaggtatccatcatatgactgttcttgtcaagtgggccctatgagcgtggcatcatttcaccttggcattctgtttaaaaacaattataacatagaacttagtgttactttttatatgttagaatattttactagaatctgaaatgtttataactaaaaaaatgccttaaaatatgtttggtctagtatcttcattttaaggacgaataaattgtgattcagcaggctccaatctgatgaactctagagcctcattcttttgccgctactccagtggaacttcttaacttcttattctttatccagtaaagtattattcacacagggtatctggcactatagttaaacgatataactcatttccaaaaatgagtcacctcggactctactttggatgtgcagagtaaaagttggactctgaagcaagacctgatatgtctacctgtgtggtcttgggaagttatctctctgtacttcggtctcatctctgaaatggggataataattcatgggttgctctgaatctgaaagtaaataatgtttatggtagtacctactacaaaatagtaagcataatttgtggttttcattttgccaaattgagttcattttctttctgaattgttttctattttgtttaggtttcttgtattcttaaaggttttttcagaggttgaaatgtaagccgagctaccaaagatatgaaaaaaagaattctttgatgcatttatttaaaaaaaaattaattaacagagatatgtagtttaattttataacagtttccgttttcataagttatgtaaatttgtattgatctgctttgtatttaaaatgtgtttaaaagacagtaatttattgtattctatactttttgtgtacttatggtgtttttgttgttactgtttcgatgaagagggtctgaagtagaggaaggataagacaagtttacagacattctgaacaaacctgtaaaaatatatgttgaacctaatatatataatatatattatgtatattatatgttgaaccatatatatatgtgtgtgtgtatatatatatatatatatatatatatattattttttttttttttttttttttttttgagatggagtgttgctctgtcacccaggctggagtgcagtggtgcgatctcagcttactgcaacctttgtctcctggttcaagcgattctcctgcctcagcctcccaagtagctgggattacaggcgtgtgccaccatacctggctaattttgtatttttagtagagatggagtttcactgtgttagccaggattgtcttgatctcctgacctcgtgatcctcccgcctcagcctctgaaagtgctggaattacaggcgtgagccaccatgccctgctgaacctaatataatttataacaaagacagaatttatccctaggggtttctgagctttcattaaattttatctgaaatattttctgcaatgtcatctgtttaagtgagataaggctttcagaacttctaatttaccactagcctaaacagaagacttattatatcaggtttggcctgggtccagtccagtttttagttggaaagcccctcaggaggaatatctttttggttcctctggatgctccagctgactcaggctgaactgcttctccgttgaatccctgaggcatatctacccctgacttccaaaggtgatctctgtggaatagcgccagtggcactagggttcctagtcgtgtttcagacctgacagagcccaagaaataccatatctccccctcactgtgccctccaaatgatattttttggggcctctgtagagttcctaatagctatttcaacctcaacttagtactttctgtggtagtccactacaaccaaggtagcagctatctatgtgtaaaatagtagctaactggcaagatttcatagatagaaattttaattatcttaaagtagttaacagccgctaattaagtttcataagacacgatgatttcttctttctttttttttttttttttgttggcaagtgttccagttacaggtaaagttagtgtaaaggaagaatagcaatacaaagtgtccaatttttttttgcagttctctctattgaacatcatgagtcacgatgatgtatcatgagttgtatttccatttgtggtgttacgtttctgttgttccatccatatattttgaaatttattctaccatgagatatctgtaacaactctctgtgtttagaggcagtattaactgactcataccaggaaggagttcatgataataacttcatgattaacatcatgctgtagccaactgagcaaccttaataccctgaatggtcttaagacatttattttttaatgtgaaaatttctgtctgcttttaaagcatgtagcttaaaattaatgagcccaacattgtgggttttaagcttaattacactagaattttaagaagcactctgctgtcagaactccgaaagctttattgtagtcacagtgttggaatgtataaaaattatagctctgttgcattagaacttagttgaccagcttttgagaagtaaaagcttgactgctggtttatatttctggcttgtgtaggaattaaagggtgctaagttaaggttggttctacaggtagctgactcagggaagagagagaatggggtgatattacaaggtaaattaacatcataaagttgagaggactaatacttaagctctgctcaactgctcctgttagtattgacaaggatgcatttcatggctgatgagcacagttttgacttgtgtatccagtggaggtgttccctttggcaaatggtcctcctttttaactaatttttatgttttaattgtctgtattggtattgtgggagtaaaagattgaaagacttatgattgtcctttctatagttgagaaaccaaggcagtatcatgagcaggaagaaacacctgagatgatggcagcccgcattgacagagatgtggtaagtacaggagtcgcctttagatcactggcttttcttttaagaggaaaaagaaaacttcataagaaaatgaagctgatttaaatagagatattttatggaaaccatgttttctgttacctgtgatggctatgccctttgaatttgccctttgaattattttctcgttaaacatttttgcctttatgccaatatttagttagtagacttgggctatgatagaagaatcagcttattaactagtttacattggaacttaggctgaattattagatttcaggaatggtacaatttttattttattatcgtttgtaattcataattgaaatatctttttaatatgtcttcttggcatttattaacaatgtattttagaatacctaagagataaaagttaagtggcatttttaaaggatagatttgtaaatcgtaaagcttttataaaagataatgctacatttgttttctttatagtgatttacagaatgagaatgctgtaaatgctttattatagcattttcattctttaaatgagatctagaatatgatgttaatacattactttttataccatatacatgttaccagcttattgagaaacaaatactgaaaggaatttgaaatttctaattcaatttttacagcacactattacatgttatacttaaaagtttaaccccaatttgtagtcttaaattagaagaatgtcaagtttcacacatactggagaaaggcaactaagactatagtatataagataatcaaattcattccagtgatctctgaaagcatggtgcattattctattttgtcatgtggaaactcttattaatgcttagtatcctagactagctattaggttatcacaacaatctgtatacctttaattccatgaagtaatattgtcagtgctttattgggacatttatcagtaaagcaaaaatgtcagtgctcttctaacaaaacctattttagaattttcctcctaactgtgtgggagaacactgagaaaattagagtaattgaaaataataatctgagcagatattgtgaatgcttccttgatgacattgaaaatagagcaaaagtaagctaaagaaaaatgtaaatgtcagaatatggctataggtatatttagtttgattcttgtaattagtaataaacttgaaattggcatgtgggctgcttccttttctaaaaaaacctttctattatttactaacagagtacagctaaggtaaaaatagttttgttttatattttattctataatttctaatttcagcaaatcttaaaccacattttggatgacattgaattttttatcacaaaactccaaaaagcagcagaagcattttctgagctttctaaaaggaagaaaaacaagaaaggtaaaaggaaaggaccaggaggtaagttggattttcttaatcttctaatgcctggttagatctccagtactggctgggcgcagtggctcacacctgtaatcccagcactttgggaggccgaggcgggtgtatcatctaaggtcaggagttcgagactagcctgaccaatgtgatgaaaccccgtctctactaaaaatacaaaaattagccgggcatggtggcatgtgcctgtaatcccagctacttgggaggctgagacaggagaattgcttgaacctagcaggcggaggttgcagtgagctaagatcacaccattgcactccagcctggaaactccatgtcaaaaaaaaaaaaaaagaactctggtactaggcagagttttgaccctcaagaactacttagcaaaacttcattgactgtggactagggttcctcttctagttttggggtagcacttgagatttaggcaaagagtaagatgaactcagggaagagtccattttggttataagtcagctatagtgaagaaagatcctggaatgttttacctaaatcacagagactgagattcaggcagtgaccatctatctgtagttttcattagttattgtaaaattaagtatctgttaaagaaagacatagctctattcttgtagttggatttattctgttgtaaactagaaccatattatttgttaaataaaagggttgacttactaaaatatttaaaagtttcaacagatttgaattttttatcacaaaactttaaacggtacattcaggtcacatacaaagtcacatacagacaattttgaagtatgctgcagttcagctatttaaaatggcctcagctatataaaattaaaattatggaagtaatgtttatacttcctctgacaaaatggtagagattgaaagatataaaatagtaaataaatatccctttcattacagataacttccaaatctttctgtagcacatatttgtataatgagcatatgacctttggctttatcttctgcatgtgaatacatggatgtgcttcctctccacatattctgaaattaagtactattgcttcctggtatcttaaaccacttattccttttgaaattctctatgaaaggtatactatcctcttgatcacccagattcaaaaccacagattcttctgtgacttcattctcttgcttatagccaacatcaattttattttctcaacatctcctgtatccagttttttcccttttcattttcatatctagttcaagctactatcattttttttaaccctgctttcgaagcagtctttaagcctctactttttcatgctgtgagaacaatcttcttaaagctctcagtcacttcattcttctgctgtaaagcacgctagttccatgttctattgatttaagtacaactgttcgccctggaaatcaaggttatccacaatctaaccttgatctacccttccattctcatgtttctctccttttgtttgttgtttcgtatacatgcaattccccctttccttgtttttgcttatgctgtttttatccaaccatgatgtttttcccaccacatcaccctggaccaaactttttcaaatcccatcttataagctactttctccatctaataccttttaagtatccatttccttatctcccaaccaggtaagtctcttctcataacgattggtacttctcttgttatttatctgattcatgtattttattagcttttaaggcccttagagcagggcttgtcagttactcacttgcacaatgtctgccatagagaaaggctacaatgtatgtttatggaattaaatgagtaatttgtagtgcctaaggatagagcaatccattttgaaatttgtatcttctcagtttgttacagtcagactatgagatgtagcacggtaactaggtagcatgtctgatgagatcttcaaactttacagacataaatgtggtttttgtttttccatttaataaatttccttggattttgctctgatcctctcctctcgcttatttcattagagggtgttttaacgctgcgggcaaaacctccacctcctgatgaatttcttgactgtttccaaaagtttaaacacggatttaaccttctggtaagtgaaatttatgtatatagaattagaagaaataaatggaaaaggtgaaaatctagtcaggatgtttctgattaaattaagaaataaaattgtttttatagattttgtgggggtgtgtatgttttgatttgccttcagttaaaacagcaaattttaaaacatatatatctaagagacttgattgaaaaacaatgacttctattctcactctatccatgctaaagaatatattaaaactgaatctggtggtaaagaccgtcccctctgtgtctatgttggacctttctgagtgtctgtcttgcttgatagtaatctgttttctgttttcttcatgttgcaggccaaactgaagtctcatattcagaatcctagtgctgcagatttggttcactttttgtttactccattaaatatggtgagattttattagtttaagaaagaatcgttcttagtatattttttaaccccaagtgtctgtctggattatctagactgcttttcttcattaccttgcgtgggtactatttctttgccatttgtgtaaacatcaagaatgtaaaatttgagaatttaaaagaaccctgtaaatcatctagtttaagcaccttattttatagttgaggaaactggtatctctgacagtgctagggatatgaaaagaaataaagatttattggataccagtatttcaacgtatactagtatataatatccagtgccttgaataacgtagatgtttttctcattctcacaaaataatcatgagaagtctagttcttgatggatggtttgctccatgaagtcattcagagacccatgttctttttatcgaggtgttccttcatctcttgaactgtctctgacttgtttattcatttatgcactggttctacaaatacaaattgagagccttctatgtgcttggctttatagtagcccatcaggaacaaaacagacaaaaattcttaccttcttagaacttatattgtaacatagtggggtagccaataacctaaataaatgtctgcataatacagtagtctaaaaatcacgtgctatgcagaaaaatagaggagtgaaggaaaactgggagttccccagggggatgcacgcatgtgtctatgtgtgtgggaaacggagtgttgcactttttgagtagggttggttaaaggaagcctcactgagaagatgtcattggagtaaaggaagtaaggaatgggtcatgtggatccctgaaagaagagaattccagacgaagaatagttaacgtataaatgttctgaggtgataacatgcaaagcatgttcttggaataagtagagctgtgacttcaacagaatgaagaaaagattagaaagagatgatatcagcagggtaacaggaagacacatcctgttggtctttataagggattgggagacctttgacaactgaagagttttcagcagaaaaggattgccctggctataatgtttagaaattttggggaagaaaaagctagggtcattattaaaataatccagatgggggattatggtgcttggacctggtagcattggaggtgatgagaagtctgatttggttataaatttgctgctagattggatatactgtgcaagagccaaggatagctcccagatttttggcctaagactaacaggatggagtgatgattaactaagatggggaagactgggtagagcaggtttttggaggttggtgaaaaattcagttttaaacatatcaaaattgagttgtatccagatggggaaatttgaattgatcgttgagtatatgaatttggagttcaatggagaaatcaggccaaggactgcttgagccctgggcattcgatgttaggagaatgggaagaaccagcaagtaagattgacaagaggcagtaagggaggataaatctcatccttctttccccagggataagtagacaagacctgaattagaatatgaaatgagtattgctttacaaacataggaaagtaagtaacattatcaacatgaatgtcagaagctaagcaataagggactagaagatgaaagtccaagagtacatcaataacttatgaatgctcctatatgttgttgctgtatatggagcatcagatttctacttgcctaattatttctgaataattcttgctctataaatgcttttaaaaaattaggtggagatcaaggacatacatatgcaaagaaactgatactagttcattaacaaaatttgtattccttagtttttaacatttttgatgctatcttagagtatttggaagtattatttataaagaagtttttgctgcctcctcttatttatttcacacactttcagagatcatatgtagatatctagtcattacacagaatagagctgtaacataacaaggctggtttccctgacatatacaaattggtctttgtgatcaggttatgtacctgaaaacattggtttacttgccaatgtttagtatctctgcttttctcaaaaattacaccttattaatggtctctccaatcataatattttgctggtccatttaatgttctccctacagggccccggacattttacttggacgagggagatggggaggaacatctattcagggcctgctactggccagcatgatgtagtggctttacacctgcgagttgctctcctcttccctcagcatggacatgtacacacgagcgtagccacagcacatgtgcctgcgcacgttcttgagagggaaccatggctcttaacctttcatttatactttctttcattttatttcctcttccttctgttaaatcaggtatttttatattcctctactcattttctttagttttacttttccctcttattgctacatatttattggaaatgcgttcgaggttggaagttaaaaattactgtgctagataggcagggtaggttttgttctcaaataagagttagctttcctccgttatctgccatcttttttcattcattccagtaccactgtatcatctgcagttgaaagtcagataagtcttagtccaactcctcaaggaggggaaactgaaaagccataaattacagtgtaatagtgtaatgtgttacgaatatgcataaattacagtgtaatagtgtagggtgttactaatatgcataaattacagtgtaatagtgtaatgtgttactaatatgcataaattgtttagaggacgcaggctggggagtggtacatcggagttacactgtggggttaacacaggctttcacaagagttgggacctgagtagagttctgaataatgggggaatggccttctggggaactgggaacagcatgtacaaatacacagaggcctagaacagtatagcatgctgagaacacctggatgattggagccattcaaaaaatctcctatcttcttgtgccgcatctctgagaaggtaagattttataaagagactctggtttctgctctaggagataactaccattttttttttagccagaaaatagctcataagaagtaaatttagagcagtttttgaacatctacttatcctcattttgcttatcagagaattgcacctgtttgtttctgctgtcattaaattatccatattaaatcagaggaattttctaaaaataattctggggaaaagtaccatagattcagagtaccagttctcattcctgttttgccttccttcctggatccttttattttttgtatgtgtgtataggcacagccatagactgttaactctcgatagtattgtttctcttgatagtactcatttcgggaaccgcatttttcaagtttggcataatagatttgccagtagagaaacacatatttaaaacaacaacaacaaaacaggggtagtaaaatcacctgatctagaattctctgcatagcctttggtatcttccagagaaactatagtcatatgcagcccataggcagatgctgtgaaagttgttaaattgttaactttcatttaggttttaaagcactgctgggctgggcaagttgatttgacaagcttttcttcattcagtagcacattgcacagcatcaaaagttaatatgactattaaaaagtagtgcttgtttttgccatgggtttttgtccacacattttgaaaatacacaaagaatagtaatcttcttgctaaaaaatggtttattatcttaggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccaggtaagcatttaccacctataatgccttaagtaccattctttgttaattacatggatctaatgagacatttatttaaccttctacatacgaaggactaagcgtcataggatgaaaaaacctaaacccttaaaggctagaagtctagtggaagagatagaagtgtatgtaatataaggcatgatataccttaggagtgagtcataaacaaaatgctgttggttggcaagggggaccagtcaggaagaggatttagacaggagggtagttagctttcaaagaagagctgtcatttaaaatcgacaggtacacatagggttcacacacacatacacatgcgcgcgcgcgcgcacagtgcttgctagtccatgcactttacagaactactcttattatccctattttgcagatgaggaaagtaaggcacagagaggataagtaatttgcccaaggccacacaacttgtaagtgacagagcagggatgtgaactcgtgccatgtagctctggagtcagtgttcatcattggtttgctaaactgccttttagcaggttgggtaggatttccacagttccatagtagggcaagggcctgtccaggtagagagagaagcagaagtgaaggcataaggtagtcaagagaagaaaggatgaagatgtgtttctctggaatatggacttcgggtagcagatcattgtggaagggcgggaggcggatggtattaaaatgagcatatagagatgagcatatagagatgagggctggattatgcaggctttcagtgccatgctaaagagttagagtgtggttctgtaggctgtggagaaccaataactttgtgaatagaggtgtgacataattacatctatgttttagaaaggtcagtctggtagttgaggctagaaaggacaaggacaaaagtaactggaggcagaggccttttgagatgctaatatcgtaggagaggctccttataaatcaattttcttcaggactagagagtcacagtggaactgaaaaggaagagtgggtaattttaagaaatgtgcatttgtcaataaagtgattatggaagacagattattaacaattgtagtactaatgcttgctgagcaaggcaaggtaagaaaatatttctaatttcatgattgtaaataaatcatttttgctttgcttatttatctaaatctttttctttatttcaccacttagaataaatcacttagtatggccacttagacatttgtcttcctaatgcttttgaatgggctagcttaagagtcatgggccaattcataattttttttctccatttttctcctattgaaacatatacaaacttttccacttattttctggactttgacagtggcttgtgttggaatatagttaagcagaaaattctttgaaagcattgcagttgttgcttttaaattgaaaatatttacatttatttatattatttatgtactagtatagcatagtgtatgctgtataatagtgttcttgttatactgtataaaaactggttaaatagatctttttatttttataattttaattgatacattattaatagttgtacatattttcagggtacatatgatagtttgatacattcgtataatgtacaaaggtgaaatcagggtaattaggatatccatcaccttaaatatcttaaatatttatgctaggaacatttgaatttttctcttctagctattttgaaatgtacaatagattagtgttaactatagtcactttactgatctatctaacactgggtcttagttcttctagtcaatgtacgtttgtatccattaatcaacttctctccatccccctgcaaccctgcctcatccttgtcagccactagtaaacaccagtctactctctaccttcatgaaatccagttttttagcttccacatatgagtgagcttatttcgcttaatggaataacctccagttccatccatgttgctgcaaatgacaagatttctttcatttttatggctgaataatattccattgtagatcacttaaatctattagatttatataggttatgattttatgataagcctcggtggcatcctttaatttcatgaagtttattaaattgatcaggtctcacattacaaatatagctcaggctctttaatttctttgtttagggttctatcttaaaataagaaaattaattaacattcaaaaaactacatcaaaacgaaatatattgttagctgttaacacacggaaagggtcattttagatcctgattgttaagagtattaggaaatgaatgtactgactgatttaaaaactcataaaggtaaaaagaaccatgaaagtctataacaatctgaataaaatggctgatttcatcatagtagaactataacatgaagaattaaatatgaaagatgaagcaacatattctagcaaaaatgaagccctcgtttttgtcctagttatttttgtggttcatgaatgattaggatcttacagaaataagtttcactcagtgtcattaaatgatgaacccatatgattgtgattacagattagtttactgattaaaacagagctgatacatttaatttataaaactggccatctgtttcagtttaggggacttcataaatttaaaaatcgtaatcttaacttgctgggctgtttctcttttgaaagatatatctaataccaggaggtttcaataatgatgggaggggagtgaagggaaagttgagaatctgaaactactttaaatgttagagaagtttgtgctctaaatacttatcacactcctagctccataatcccttcttacacaaatttttaaaaacctatatccatgttacaaagttgagtttaatggagaaatgaggcaatgttgggaaaacagatcatgcaacagaattcaatctttctttcattttattaaggtgtgaaatactggcataaacatgtttgctttttctttttgggtggatggaagacagattaggtctatgtgctgtttttgttgtttgttatttatgtgtgtgtgcgtgtgtatgtctagccttactgaagataactgtgagcatggatacattcctagattttattgtttatatgccttcattccctcctgcagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagaggtagttttttttttaacattgccctctgtagacagtgtaattatctgtgtattctcttgtaattctgattgcaagttctcattttattcaactgaaaattgttctagaatcaaagtctgaatgttaccctgtcctgaattacctctctctcttgcctctgtcattttttgtgacagttgctctgttcctccgtgaagcccaaccccaacccaaattgctctcctatagcctgtcagcccccacccctccccttgttgccactgttttcctggctctggcgatcctaagtcagcttttttaggatgactttctctccttgtcagggaattgcactactgccctttggcttatttctttatgttttcctctcccattatcaggccctcaagacagttccctgaacctagatcctctaacctgtcttaagcagctgtttcctgaattcccccagttaattaatttctctccttctcttcacgttgctttgcctctcttctcctctgtttgttttctttcttcccttttgcctagttctaaaactctggagtcctatcagccttgctagagggcccaagttcttctgcactctagtccttaggctcaaatgatcatttataaaactacaccttgaggagatcttaacattcattttatcttttaagtatttaataatatttagagtataacctatttgggaatcaagttgagggaatgaaattgagtatgctgttttgtcacattccctaaaagtgatgtttctatgactcttcttgtttgttggaaaagaacattgaacattgattaaagctggaccaaacacaaataggatgatcagaacccgaagagttaggtgaatgagatctagtttgaagaagaaacagtaaatgatgactagatcttcccgaaatcctattatttttatttaattccttagattaattttctcagactatcataggtatttataatgtggcaaatatgttatgagggaatgaattgtcaaaccatggtgtattatatcctgtgactgcttttaaggggaaatgtttatctaaattaaattttaaaaattgttccctttgtggactattctttggacaataaaaataatattatagaagtttggttgaattcctgaaactttaaaaataaagcaaacatattactttgaaattattttttcctaatgcaatttttttttccctctggctgtattataagggaagaggtggattccatgcctgtctttccctctaaatgaataattaagatgacctcactgctcggttggcaagcatatacccctgcctgtatttcatagttcaggcctcatcactgtgaattttctttccatttaaagggtagtttttctagaggaaagaaaatataatcaaacatgaaattatgatacacttgctgttgctatagttacagctgactatttttacatcataaaaatttctagcttatagccttcataccttaaataagaaaatatactcactttataatgtatgcctcagaaattcacttttgtgatttcgttctcaatttgtgtatttaagaagagagtaatgtgttctgggctcccaggatataagtttgtctactttcactgaataattaattttaaaagaggaattattgagaatccttacttgtaatgagttattattttcctgttataaactatatttcattttatggctgaagtagttattcagaggtttaaaaaaatgaaaaacacattctagcagttccagggaattttatgccttgagattttgttggaaaagaggccaagtaattgtgacttaaaaagcaaaaaaacgtaatcatccctaaaagagatactttattatactttattgctactataataaatgcatttacaacaagacttgggtaattcaggatctgatgatttttgtttaggattgaaagacataggtgacttggagtgacaaatatgggtggcagtactcagcttccttacttcctctgaaccctaagcaaactttggtagtcatcacagttagtcatttgtcatcatttctcttctccctttcagtattcgcagttgctctcaggacccagtgatttcctactgctgacttcactgttatgttcagagctgggcaaaaggtgtgggtgcttccaacagttagagcactcccctctttagaacagcctttaattaaagattacctaatctaatgtagtgcctctactctttcccagggaaatgataaactgaattaattgagctcagatttttttaatttaaatggctgaaacttgtttatttttatttatgtattaattacagtatcctgataatgtcacctgctttgtccatggataaactcagccctcctcctgatcactttgtcattagaattaactgtggtaaccatatgtccaagaattttctgaaacattcccagtttcaatattttgccccaatgaatccataaacaaatatacaaaatccataatgaaaacagccaaggaattccagtgcttcagtgtctatcatgctttctccatacctcattttcatataaagaaacaaagtaaaggctttggggagtttttatttgttttctcccaatctgagcatgtattctctatagcaggggtccccagttcctgggtcgtggaccagtactagtgcgtggcctgttggaaactgtgcctcactgcaggaggtgagcagcaggcctgcgagcattactgcctgagctccatctcctgtcagatgagctgcgcctttagattctattaggaggaagaatgctcttgtgaactgcacatgcaagggatctaggttgcacgcttcttatgagaatctaatgcctgatgatctgaggaggaacagtttcatcccaaaaccatccccatcatccccggccctggggtccatggaaaaattgccttccatgaaaccagtcctgctgccaaaaaggttggggattgctgctctatagctttaaaactgtggtcctcagtgggacctatgaacctcaactgtcactcttggtagctcccagtagtctcctgtctgaattatcttaactgcaaaagagaagtgactctagcattctcttatcctggactcttgactgtcaagatcagtttagttgtgcctttctgtgtttcccttaacagtaaatatgataatagtgctgctattttaaaaatattgaaaatactataatgttctgtgtataattttgaaattgagaaaaatgagaagccggtataattttaatgcatagggttcagttgattttcatgtgacaatatttactttgctagagtggtgaaagtttcttgaacagagagagcaagattaccctttgcactaatgacttttcttattataagtaagtatttgacaaaaatgtgtcactcccatttgataatgtgttaacataatggtcagtcacttgaaaatgaaaacttatcacaatatagttgagagatcttgttgactgacctgagtgctgattcaaatagtatttggtgattctttaatctgccccactttgtctttcagcattccagtgtatcagagtatcatccagccgatggctatgcgttcagtagcaacatttacacaagaggatcccacctggaccaaggggaagctgctgttgcttttaagccaacttctaatcgccatatagataggtaacatttaatgggcaccctttggagagctgtggataaatgtctctgatctagtgctaacagaggtgacagtgtctgtattgtctactgcttctttaaactttccatctgttaattagttgataaagtttcagttgttcctttagagaactggttttgatcaacaaaagatgtctggaccttcagtctgtaattcccatttagtgcaaatgcctttggatgactttccattttttaaaagatacttcggacaaaatgtgtacattaagaagaaagaattgtcttgaaaccctccattagtttgtaccagatggtctctgaggatccttccagttctgtagcttttaaagaaaacagtttccatctttatcttcacccaatgaaaacaaataaaccttcctttagacagatatatttaaactgaatataaactaaatatttaaacagggtcaatgctttattagtcattcttgccatttcatctttttatcttgactttccagttttacatttcatttatttttctatatcttcactcttaaaaaatttaatataggcagagatggagaattgggatgagaagaaataaaggaactggaataagttctttttttttaatttccaatcttgtttttagtaaatgagatctacatagagccaagccatgtagaaaagagaaaaggaggtaaaatcttggtaacacggttataggagaagggtcattcagtgaactgggaatagagaactcggcctagtactttcctgcctcaaaagcctctcttaccacaagagttatatgccctttacttcttttctgtatactcttttcttaatataatctgaagaaagtgggatttaaaatttttattctttgtcaggggtggtgacaggtaatgcttaagtaattgctgtagaaattacacaggtataactccaagggcaccagtgacattaaattgagtacaaagaaaagtcagcaatgaataatatattttttaaatgccaacatatgagaatgttttaattacataattaattttcagtagatacagttgaaaatcagttttgaagcttaaacattatttcattgaaatccttaactaagtattcatcttaatattttcttttttctttctgtctgtcttagatgtcaatattttagaaatcatttcagattaataggtttctttttgttttatcactccagtaattcagatgattttccacagctaagtagctagaaaaccacttgagtacatatgtagagtacatattgacactagaaaacttttatcaggttccatttgaagaccacatttagcatactgtggtcactcagtaagtgtagatttatttgattgatggattggatgaataagtgcatgagagtatatctagtatttcagagtcactacttccctgtccttcacctgcatatctataagggatagtattactgatggaataacctctgccatttattttgggcaccttaccacagagtcttttaaaagcttaccttgatttttatgatctttatagaatatcagggcagtatacctttcatttattgatttagttatatctttgtaccccttctgcttccaaaatagattcagttagctcacttaaattatatgtagttaaagtggtattattattgaaagttaaataatgaaataaaatataaaattaagaagttaagagggaagatgagaatttttataaaatataaaagttgacactattattgaatttcagatttgtctttcagatttttggctgtcagaacaaaaagagaaacataatcattggctgacattaggaaaaggaataagtatcagttcatcgggataaaaaatgcttttcttactcctaaattctcaataatatttgtttcatgaaacttaatgtaggatgggataggtgatgtcagggacatttatttttaacaattttttttcctcaccacagagaaggctgtggtgaattttataaggtttctttttgtaacctttgataaatagaaatttaaataaaatataaaaatagaaattccatgaagggataatagtctagagtggtcagaatttcaccatagaaagaatttttttgaataccttgagtggtgggtagattttatatctcagttgttcttatggattctgtctcagctggacttaataggagctaggatagttgataaatacatgaatcattgatgttctatgttgctaagaacatttgtcatcattttgaaaaactgtctgaaaattgtggtctgatataaaatacacagaggtttggaatttgtttttataaataattattgttgaccttaaactctattacataccaggaatgcagtagatactgttaaaagaaaaacttcacacaaattaaatttaacagtttttttttttttttttgagacagagtcttgctctgtcgcccaggctggagtgcagtggcgcgatcttggctcactgcaagctcggcctcccgggttcacgccattctcctgcctcaacctcctgagtagctgggactacaggtgcccgccaccatgcccggctaattttttgtatgtttttttagtagagatggggtttcaccgtgttagccaggatggtctcgatctcctgacctcgtgatctgcccgcttcggcctcccaaagtgctgggattacaggcgtgagccaccacgcctggcaaatttaacagtttaattgaacaaggggaaaaaaaagtggcacatgaattgggcagcccccagaatcacagcagattcagagagactccagagatgcctcatggtcagagcaaatttatagacaaaaaaaggaaagtgacgtacagaaaacggacgtgaggtatagaaacagctggattggttacagcttggcatttgcacacaatttgaacagtcagcagcctgtgagtgcttgaagtatggctgctgggattggctgagactcagctattgttacagaagcatactcctaaattgggttttcaatgtgtctacctactaaattaggttatgattcgtccacaggactcaagtatggaagtatagagggtttctcagaacatatttagcttaacaatgccatacgaagtatattcactgttctgtgaaattgctatgccattaggtagaacatttgttgaatttagagcccacgccttcgagttttatagcttactgctgtcagatgcaattagtattttagagaagttctcaaattactgctgtctctatgtctgctctctatcaagtggcgtatctattattcctaatcagaaactgagcccatacgttttgttacattccatagctgttaagaaactttggtacctcttttttttttttttttttttttcgagacagagttttgctcttgtcgcccaggctggagtgcaatggcacgatatcggcctactgcaccctctgcctccctgtttcaagcgattctgccacctcagcctcctgagtagctgggattacaggcatgtgccaccgtgcccagctaattttgtatttttagtagagatggggtttcacgatattggacaggctggtctcaaactcctgacctcaggtgatccgccctcctcggcctcccaaagtgctaggattacgggcatgaaccaccacgcctggccaagaaagtctggcatctctgaaaaattacaaattgtgattgtctgtttgataactatggtcagtgtcatatccatgcttaacatatagagggcaaaaaactgtgagccataaagatttgtaaattctgaagcacttcaggtaaacacttctgagacctgcaagataacaaaaaatttgttatagacccttaactctccattattaatagtgattatcttgcagatcataggagaaaggaaaataggggaagagaggaagataaaacactaaaattactgttttcctaatgtttggggtagttgaatctcttttatctgccaaatgaaatcttagtagattaaatgtgaatatataaagtaaatgaaagcagagctattccagtagggatagggatgggaaatccatggaacacagttttaaaattattattattaataacataattacttcaccataatttcaccttttccaccaattttctttttaatgtgctaaaaatagccaataagctgttcttacatgcttatctgtaaggtgttctatactggtcatctttttgctttgtccctgtctccctcctccaatggagttactacctaagaggtaacaaaaacctatgacaggatacattatgtctacaactgtcctgcaggccctggtataacattccagagaacttggtagacagcaaaaagaatggcaactttacaggggtaggatgacctaacatctttagtctctacctgctatttcccttgtagagatgtgtaaataaatgtgggaatgtaaatggaggagaagactagggagtaaaattaataaagggttaaagtaattttattattgaaatatatgaagaaaatacaaatatttaatgcatcaagtgtattatgttacatataaaagtaatctttagttaagttgttaaatctattagtactcatttaatgattagaagaggtatttggttttttaaggaagttttattttaaaaaaatgaggcccatacactttttaaaagtttatagtgaattaaattatttacttacttatttgcaagtgttactagtctcatacttaatgcatatctcttttttttgcaatttagataactgggcaaagtgtttctaaaaactaatgcctagttataaattttaaatttatatatttggttactgaattgcagacattgcttgaattagtgaaatcaacatataactaaaattaccactatggaaattatcttcagtctcctttaactttatgaaaaatactaacatttatctttatctagttcttttatggtagagatggtaattaacataatatccagtatgtgtatttagtagacaaagaattcatagacttggattctggatttggctaagtaccacctggccttgtgattttgcattatttgtttttatccctggccataatttgttcattttaaaagcaagaactttaaagtaacttttatttatcataatgtaaaatataataaaatgaaactgctgtaatttttcagaaagttttctggtaggatttggcttgtctcagtgttttccatttttatcctttaggaagagctagcagaataataatcttttttctttctttttatagaaattatgaaccactcaaaacacaacccaagaaatatgccaaatccaagtatgactttgtagcaaggaacaacagtgagctctcggttctaaaggatgatattttagaggtaatataattttttcttttttatactcttaataaagtagttttattgtattactcttttggtatataactaaactttccttcaaaagtattatattactaaagacgtagtatattagaaatatctacatctatttagtaggggtatatagatactccttctaaggggatagctttagaatactcctttatttgttttttgtggggagtggcagggtgggtttttttttaacttcctttgctctcttccttgccctctttcttcttctgatatttattcattttggagtcaagactagttaacaattcagatgtggatgcacataatagttcaataagagacaacattctttttttaatcctatatccttgcacagatatactcagcagtcattgagctaataatgttagggataatccaccacaacaccaacttctctttgttagattctaattgacagttcatcttcttgaatatataaggtgaattatcacaataaattttgtaaggaaaaaaagtaatttttatatactttttctttctatcaccaaaatggagacaatggggctttccaaaagagtcattttagtccttaagtcctttaagtactttagtccttaagtacttcaaataatgcaggctgttctttggaggtaaaatggaccttgggtagattcaccataatgataccttacctactgtatactcataaatgtcttcttagtgtaattcctgagaatcattcaatcaacactatgttgatgctgagttaattatcagaagtagaaaaattttctttgttgaagtctagggaacttctttcgtagaatggcttttatatggaaattatacctttattttcttgtacatgacagatacttgatgatcggaagcaatggtggaaagttcgaaatgcaagtggagactctggatttgtgccaaataacattttggatattgtgagacctccagaatctggattggggcgtgctgatccaccttatactcatactatacaggtgagcatgatttcttagtaaaatgtagtatgtacacatttacgaagttatcactcttaagtaggatttaaacacctttgtgtattgatcattttgagatgtagttggttatatattttttctagagtaattggtgggggagtggcaatggtgagagacacagggaagaattacacatatgttttctgatttacttctagaaattgttcaagatgtttagcagtaggtacctgattctctgaatgctttttttccccaatctgtagtatttctgacatttgaagaaatggtatttctgtctttttacccacagctctgctatccaccaggggcttcctcttgatagaggatggcactgatatcacggcatggtgtccagcagttcaccttcaccagcccttgctttcagtctcttaaatgttctgccactgaccagccttgaacttgcactcatctcaccttacactaatacatgagtacctgttcacctggattacaatatttttcctctcttgattttaagattaaaaggtacttaggatatagattagataggtcaggctctctcttcttgttcattgaaggcccatgaaggtccattcttatggcccatgccacattttcaggatttcagtgaccctggtcagctcattcaccctaacatctgaattaacttgctcttaaactccggaattttagacctgtgccaggctctctagagttaggtctgtaaacaaagacagaatggatggactctctcaggtacagccagtgaacctggggtggcttctcattcccccagaaagaactcttttaattttcaaagtctcgagaaaaagatcacatctgacctcataataatgtcatgaatttgagtagaagctgcgtagaatatgcagtgaaatagttaatttttatgccagatctaggcttaaaaaaatacagattgtccaaagctggaattgtggtcatacttctgctgccgtgacaatttatttcagtacttttggctcctcatgacattcatgcctggtgtcagtcctgtgcttatccagagggacttggccttactagaatccatgaatcaagcaaacattcaaaataaagaatttgtgtatagtttctctatctcggtaacttaaagtgatggcaatggaaattatttgctgtgttatgttttggctggcctcatgtgcatatatatattatgtacttattttatgttcatcatttgtcattagctgttgatgccaaagaaggagtttgagttattcaaggtatggtctcctccatttcccatgggtttttgaagtgaattttcttagtttttatacctttttcttttcttagttcctacttttctgagtttaatatctgtttacctaatataatatatgcttctgtctggttcatgaataccagttcttcattttctttcccatagaggtagtatatgcttgaaacctatacttaaaataatggtagagtacatacctttgggctatatcaactaattttaatatgcaggtcatggtaagctatgagaagcactattcataaaggatatccctgatccccatatgtgagcaaaaggcaagagtttatattttaagttttgaaaacaattatccaaatttgttttatttgtgtgtgtggttgctaggaataagcaaactgcgataaaataaaaaacatgcaaatagtatgaattctataataggaattttctcctacctgatattcctgaaaagtttaatatctcttaccttttgctgtttactgttcagtcttgtctttttctttaattctgattcttggcttgagccataagttgacttttctgtttaaaaggttgcttctgtctaaaactgaaccaaaactattaatatatatcatacgcagggaaagtattttcagagaatgtcaaacctattcctcctttcttaaacagaacctcatcttttatttttgtcaactttggcacaacccaagaaatgtttttaagagttcacaagtttcaggagtttgttttgctactttatgtaaatagaaacttgtggttcttatagggattgcctatttggctatttcgttttaaacttttcaacactatcctactctcttcttaaaaattcgggttgcaactacaaatgtagtggtgtgtgtagaaatgtgtacagaagctttctgtgtgtatgcagaagcgtatgctgttcaggttgagggccctactttgaaaatgtattaaaaacaatctgctttttaacacctcctgaaaattttgggctgagctcaacaaaaccactaagaccttgtaaaattttaataagcaagcttcacagtctgctttgctatctgctatctggcataaatcctactctaaaaggattcctattctcaaaacatttataatatattctttaaaaaaagaatagagtaaaatggaaaagaaaacatccttggaaatatgtgccagtcatttttctatctctacaacagtagatacccatatctactgtttcatatctctacaacagtagatacccatatctactgttttatatctctacaacaccagatacccatatctaaaatatctaaggaagaatcctgcaacttatttcagaatgataattaagataccaccatatttatgtagattccactgatcctaataccctaaccttataaaactcaactggattacaattttatgtcttactcatctttttattcactcattccacaaatacatattgagtactggcatctcacacacttggtaaaaagaacaatagaaagcctagcgccgagcagatccttcccgaaagcctgcatgagtccacaggtcatctgccatggctttgctccttcctgcatgcttgctgtatcaagagcagcgtgaccctctttctcctcctcagatatggcccacacatttgttttctcttccatctgtctctttcatccagtgatatcaaaactttgaagaaatataaagaaactttaacaaaaatattttagattcctgcaccatgctgccaaaaggaagcaatgattcattacttaaatttgcttcacattcacagaaaacaacattcacagatactcctctctagagaagatatgcccgtggccagtgctcatgctgtgccaggcattgtttgagcacttcgcaaatccaaattcatttgattcccacaacaaccttgtgaaggaggcacatttttttgtaggaaactaaggtgtaggagaaataatttgcccagatttatacagctgtatgaagccaggattgggccccagcactctggatccagagcctgtgctgtgttgcattctgctgttctagagaatagtgattataaaaggttctcatttcgggtgggcacaatggctcacgcctgtaatcccagaactttgggaggccgaggcaggcagatcacttgaggtgaggagtttgagaccagcctggccaacatggcaaaaccctgtctctactaaaagtacaaaaattacccaggcatgatggcacacacctgtaatcccagctactcaggagactgaggcaggagaatcgcttgaacccaggaggcaggggatgcggtgagccgagattgtgccactgcactccagcctggcgacagagcgagactccgtctcaaaacaagaagaaaaagaagaaaaaacaaagattgtcatctctttttgtataaacccatagtttttctctgtattaatgtttaaagtgatattttctcagaatagctttactttgcattatactgtgataaaagttgatctgatcagtcacaatccttggaatttgatttttgctttatgtatccattcactggatttcatggtattgttcattattttataatttaggaaaataacccaaattatatgatttacttagaataggacatttttgtaagtggtggaaataagggaattagatgtaaactatttccatgcaacatctgtgagtcaccaaatacttaaaaaaagggacagtcatgactcttatttttatacccttacatttcctataaagacatatatataaataatggcagtttctgggtgaagggcacaagtgcagctcttgcctattgttcacacactttttatcagagattctgttctgatgacagggatgctcataccaggcagtgaataggtgttgaattgccacctggtgtccctgagagtctaggctatttaatatcctcacatttgaagtgatttttaacagctctgtaaagacaaccattcccacctaatgtatttcccccatggcttcagcaaagttttaaacataaaagagaaagtaataaaaatttacaaaagatattgacacaaaagattgaataaaccacagagaaaaggaagtaaatgctgaggagagattatggagagataacatgtcttgataaaaatgttgtagagcattccaaggctttgtagtattttagctgggcagcagatggacatccagggttctttctccccacctggaagctacttgccacataaagtttcctgatctttattttgacttgattctctgacctctagccctgtgactgctcgtctgctagaattacccttttgcccatttaaatttgcaaggtatatgccaagagcagaaaccacctcctcccgtgatgttatttattatatatccaatggactgactaaagaagtctttcatatattcttaattattatctatgcgtttattattgttataggtattcttactctaccaagatgcaagtaattatgaatgtccagtctctgtggtcacgtgaattcaacaaaacgtttcccatattctttattgtctagcaagagatactgtaatatgatactgtgtgaaaagccccaatctaggtattggtaggtgagggttctagtccttaaagagagcattttatttttctgtgttccaatttgcttggtcatgaaatagaaggagtcagttatgtgatctctacaatccagtctaggtataaaatcttctcattcattatatacatgtttaaatcaccctaaaataaaagtggaaatgttttgtacaggtgactactaaaccgctaacactactaatttcagcctatgttattagtgctctgttttttaagctcagtacagacatttagctactgctggatagagtgacgattttaccaaagatggcttatattcttccagccaggccaacctcctgataatattcagttcttcaaaagtgttttttaaaaattaatatcagaagactctgctcattaattataggcatggtttttagacaaagatgtttactttttattctgtcacatgtattgacattttcccagagacttcttaatgataatttgaataatacccactataaatatatatatgtgtttttatacatatataaagtattgataattactgtctgacatgcacatgtacataattttattaaatgttctatgttcaggctgcttagaaagtttgaaactaaagctcattacaatcacacgataatgcatgcagtattaccttctgtaaaatcagctaattaaacaagaataactcttacatgtaatgcattctaattgtattctttatgagcaataggaataaaataaacctatatcttagtattttacttgaatatacaaatagttactgttgaagtactttacacggtttctactatagtagaatctatatgattagttttccatggctagatagtgatgggaattaattatagatttacaggctccttcactggttgattgtgggcatgtaattttactgtcaggctaatttactctttctgatatttgatgtgaattataattgatattattttaattccatttcctgtattaattttctcatttgatgtgatttgctccattttcctaatagcaattacttggcgagctgtcagaggtaacccacattcgttccctcatggcacttctttttaatataattttttggattcagtctctcaacttaacaccctccaaatgttccagctgtgcttagttttcactgcagagttcccaaataaccaaatttagaggaaaaatgtgtaatttagagtaggttaaatatttaagaacagttcaattttaatggctttgttgcgcttacttgcataatttcccctctgaagcagcatcttgtatgaatcaggatcttatctctcaatagcattctttaattctttagaatttctactcagcttaagttgctaaagaaaagtgactcattccaacttaattatcaataggaaagtaaatttcctatgaggtctattaattctgccttctttcagagaaagagagacaaaaagatagattttgcttttaacagaactttgtgtttgtgggctatcacaggcaagagtaaggaagtgacagttgggtgcaaaagtaggtccacaccaggctgaccaaccctcccagttcccagctggggagtctgaggggtttgtgaagatgtggaactttcagtgctaattactgggaaagtctcaggccaaccaagaacagttagtcagaatttcttttttggatttggagcttcagtacgttggttcaggagaaaaaagttcagagtgcacttctgttctccaagacattacgtaaactgagatacgttggaatcattaactctgtagcttcaacaaaaaatagccaaaagacagacataaggaaaggaagaacagtagttgggtgttaggtaaagaggagtagagaagctagggagggagacagaaaagtgacgttaggagtcagtgctgattctttttcttccacatgaagaatttcaaaccagtttccatggaagagctgtctaggttgccattcagaaccagttgtcacgattcaaggaaggtactttgccccttttaatgtcagaggttggaaacatggggcaggaggagaggactaaggaaagaggaaaatatgcaagtaaatataatttatggcatacattttcatatgggtttctttaatcaaatatgtattttaaacctattattttggtaggtcatactgataaagttgcattatgtaacaatggcatgaatgaaataaagcacagaacatttggtgagtttgttttcaggcttgattgtgacagtaacacagtttattcactttctcacaatagtatttgatgaatagcaaaagcaaaaattatgaatcatatggaaagcagggctcatggcatttttgtttgtttaggctttaaaaacaataattgaaactatgatgcttttgaaacactaatgtgagaattcatttgcccttcatgaaattacgtgcagaggacattcttgtcaagggaacattgcatatacattaatcagatgactttggtgtgtgctaagtattacattctggtgatgtttgctgtattttgactgctttaagtattttattggcccaaatataggaagattgtttgtggggaataataataacaattcattctttcattctaatacagtattgaatacattaaaaatatttctaagccttgaatgctaaggggattagcaactcagtttctgtcccacctaactccttctcttactctgagaatcttaccctttactccctccttccctcctgtcctgcctctctcctccttgccctccttcttccctcagcatctaccagcattataaacactcctttcagatatacttccatcctttcataatacgcttcccacttccttgaccccatcccactggtcagtgagtagtagagcgagctgaaaagaatgagggctccttcccacaccggtttccacaggtgttagtcatttgccgtgaagtggactgatgaaggttgatgtgttgtttttgagtaatagtttaattaaaaagtgatgtgtctgtgtgtggtgtgtatttttgtttttgatctctgtggaaattgggaggactctgttaaaatcaatactacctgatatttgggccattttagaatttaaaagtaaatactgttctaatcaaaggaccagattaccaaaaggtctttttgcatgtaatatgctaatcctaaattagaataattaaaattgtgccagtgcagtatctaaactttgccttaattacaaataattgtcctgtatctttgattctaaaaagaaaatgtgccttttgagaatttggagactctcacaatgcattatctattaaaattattttacttagatttaaagtgttaactattatgtgtgttttaaatagggaatatgcacaaatgctgttttataagtatgcctaacaatcatgattttaaaattattaaaaagcattttgtcacacctaccttttttaatacaaatggccacaggtccctttctagtattcgtttgtaagttgcaatcataaacatttaaagaccataccattaccctcacaaccatccaccccgtgacatttccattttaacaagggaaatttctaattttaataaattagcattaagatgatggcagaaaaagttatgccttgaacaaaataataccaatattttaaaattatttattggaaacaaaattaaaaatctttgaatatagcgtacatttaaaatgagtaagtgatgctttatgctgttgacatttagacttccagtgcaattggaaattattattagcataaattaaaaaataattataaatctttctgcctcccctcatcttgtgtgattccaagcccaaattctgttttcttgacatttattactataatactactatttgctattgacgtagccttgtgactccttaactaatgttttgactttgaacaaattatgtagaatgtttaaaatatgatttttaatggtcattataccatataggattacagataaatgagtaatgggtttgcaagtaagtttaaaaatagccaacaatgtcctatcaaagtataatttgttttcctagcctaggtttatattttttaaattttaagttaattatttgtctttttatagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgtaagtttcccagggaggcaaaaaatgtcttctgcaaattaaaagcactactaagtaaaatattgtttactgctgattctacttgtattaaagtcctttatacttgcatggtacttaatagattgcaaagattttcacctggtttctcatcagctacgtagttctgagaaacaggaagtattctctccactctctaatgcatgcctttctactccttttccaatctgttatgataattgaatgcagactctggagccagacatcctggaatttgtataccaaaacaacacttgccagcttcctgaccttcaatgatttaattatcctctcagcacttcaatatctaaaaagtggagaaaaataatagtatctgcttcataggataagtgtgaggatttaatgagataatgcatagaaagcatctacttcagtgcttctcagccaggagcgattttgtcttcttctccatccttctgaggacatttgatattgcctgaagacatttttggttgtcaaaactggggggatgctactgatgtctaatgggtagagaccagggacacttagcaacaattacaatgcacaggacagtccccagcaacagagttatctggcccaaaatatcaatggtgctgaggttgaaaacccctgactgattttgacccctgtatgacacgtaatatgcagtcactaactacatcctgctgtcgccatcatcatcatcatcataaccttcctacttctcttcctcttgtttgctattcacagtagctgcacaatcacactatgttaatataatcacctgccaatagtagtctcagatttagcctccaaattcaaatttcatgtgacttacacttcagtgccatattttcataacttgaaatttgatgtttcatataaatggtttctatgaaaaccatatttaagtaaactaaaaagacactatgaccaactttggattatccttatttgtattattggtgaatagcagtgtagatattttgaaaactgaaggtagttttaagataaattttgtttaaccttgtagtatatggcatgtcaatttaatctccaaatttggtgttttaaacgtattataaagttacttggctttacctatacttgatgtgtaaaaactcttggaaaaccagagctatgaagatatttcatatttccccaatatgacaaaagtatatgaagtgtgtgtgtgtatgtgtgtgtgtgtgtgtgtgtgagtgagagagagatagagagacagagagagagagatggatatctatctttccctcaatgtgggcctctcttagggttctgccttcgttttccacataaacatacttttactgtagttcattctatttccatttctttcaatactatttatattgttgggaaaagaatgattcccaaattagtcatcgtattaaaactcatctctgacatccagataccagtatggaactattaactttatagctgagattggatgctttctatttatgttcaaaactaaatggctgaatctttcactcccattttcatcctactgtttttctcacgtcagtaagttattgccacatctgttcagttgtggacattcttgataaaataaaaaataaaaaagacactaaaactattactatttaacaattctaaaaattctggttaaatgcaataagcataagcctacttttactcattaatttttctcccacggtatgtccaatttaaatgactgtcatatctatcttgccaggaaactaaaggaaaaatgaagttttggaaaagtgattagctctttctgtacagcaaaaacaactgtgtgcgtgagtgtgtagaaccataataaaatagaatatgctactaagtttttaaaattatgtggagtttttaaaaagagttttctttttcaaatacactaaagacatagttttaagatgagaaatttctataaatatttttattgagttccctaaggagaaaacttcctcttagaaatgactgttctcttctttattcttcccacaagtttatagcatttccctccgtagagacgtcagcacagtcatctttgacacggtgggactctttatccaggcctagctaggatcaaagttcatcggcctccagtccccatttggagcagtgtgtgggttaggacagtctgttctttgttcacgctgagaaaccaagaataacctagtgggaaagaggcatagtttgcatacttttaaagatagagaactctcctgataattgtgactcatcatgttgaagtctgtttttcataagtaaaagggtggcattggtgtataaaatataaacatctctcccaaaattaacacacatacttgtttccttagaatattaaaaatcttacaatatatttgcaacttatgtaagttcctttttaaaatatctcaaaaatacagtttggcattaaataaatatatttctttttataaaacaaatatttcttgataactttattgcagaacagtttttctctgaatgaatgttggggcttaatgttcttttagaaccagacagtagcacatatttcagtgtgtgtttattgatagccaaatttctctcaaaatatgcctactcatctacccacattctctgcttactgcctaaacttctggtaaaaataaaatgaaaggaactaggaagtaaatactcatagaaatctatcaagtagcagctatgaacaggggaaaaaagccaacatgcctgtttttacaacgtagcaagtggcaagagtgaagcccttttgtggaagtctgtgtgttgcctattcaaaataactgtgaagccttgtgtcatagaagctattcaggctgttttatcgcaggatcccaaaaggttctccttttatcgcttttaagatgccaaactttagttgctttgtatttctcccatttcctttgaaatggtagtccttttattcgaatttaatcttttgtaatcagagtgttactttagaaaggtgtaaagttattctggtttgctgttgtgtgttagaacattggaaatggaaagcaaaagcccaggaacatgttaggtggaggtttttttgtccttcctggaagaaaactatgctgtggactggtgatgattgatatactgactaagtcagcagatgagaaaccaaatcttttagtgtggtgatacattttattttttattcttttgagatgcactcatatgctgtttgacagtttgttgtagtgattttttaaaaggtagctaatgaaatgcacataatgtatacttaaatgtaacaatcaatagtattctctcttactctctctagcaccccctactcctccctccctccctccctccccttttccccttttttgattacttcaaaagatttcctagatacttgaggcattaaaaaaaattagactgaaataacactaactattcacactttcccttatttcccaggggcaccaaacactttctaaaaccctttccctaggggggaaaaatcatagaacattggtcacaaaaagctccctaagtgaccaggttattgtcacttgccaacttaattagattgttcttatttcttgaaagtgaaaacaaacaacgaacataatgtacctatgtatatatacacacatattttaaaatacacagacacatgattccccttcctgtacttttatgcctttcctatttttgtcatgacagtatgttcatatacacacacatcttttccattagcataaatggctaggaaaaaggagtagctagggaagttaatcaaaggtgattttaatgactttggctataaaacagccctctgctgaaagtcagaagatccagttctagctaaattattctactaattgaaatgtgactttgacagatcatttctctgtttttggccttcattttcttatctggttatgtaaggggtttgtacatgatgattctcaaagtctcggtgaaaaagtcagcagaatgcctcattcattcatttattcaacaagtatttattgaattaaagcaccgttccacgtattaggatatagatgcaagcaaaaaagggaagcatcctttttctcctcaggcttatattttaatgaaaggaggtaggttaaaaaacgattaagttggctgggcgcggtggctcatgcctgtaatcccagcactttgggaggccaaggtgggtggatcacgaggtcaggagattgagaccatcctggccaacagggtgaaaccccatctctactaaaaatacaaaaattagttgggcatgggcatggtggcacacgcctatagtcccagctactccataggctgaggcaggagaatcgcttgaacccaggaggcggaggttgcagtgagccaagattgtgccactgcactccagtatggcaacagagtgagactctttctcaaaaaaaaaaagatgatagacaaaactatctatcaagaaggtggtaagtggtttggagactaataaaactatgtggatagagagtgcttttggggagggattgcagttttatatacatcaggggaaatagaaaggtggggaggagtaagctatgtggagatgcgggggaaagcattccagacagagcagactagagtggcctttaaatttgaagagcaccaagggagccattgggagcaagagtgaagggctccagaagagttgtggagtggctttagagtggtggaggtcttgtagggccttttactgggagtaattaggatcacttgggaatgttttgagcagaggggctgcaacatctgacttgcattttttttttttttttttttttgagacggagtcttgctctgttgccaggctggaatacagtggcgctatcttggcacactgcaacctccgcctcctgggttcaagagattctcctgcctcagcctcccgagtagctggggccacaggcacatgccaccacgcccagctaatttttgtatttttagtagagactgggtttcaccatgttggccaggatggtctcgatttcttgaccttgtgatccgcctgcctcagcctcccaaagtgcttggattacaggcatgagccacctagcctgacttacattttaaaagaatcacttagttgttatactgagaagagaatgaagagaaatgggtagggtggtagggagtggaagcagagagatctgttaataggctggtaactcagaccaagctggcaacagaaaaaatacagtgaaatcattggattttggatacattatgaggtcagactaacaggatctgctgatggattggatgtagtataggacaggaatcaagtgcagctccgtggtattttgccagaactggaaagatagaattgtcattaagtgagttgagaagtctaaaaagcaagtctaagagttcataaaagcaagcttcaggaagaagatcgggaattcaggtttgggcatgctatatttgacatgcatttgagctatttaagaaatacccaaatgaatatatcaagtagacagcatatatgcacccaagttccgagtaagaggactggaaaaataatttggtaaccatcatcttttaaatggccatgaacctaagcacagtggtcattgatggaggtagtgctggcagagatgagtctcaggagtgtcccctagagcaccttaatattacttagttggagagatgagaatattcagaagaggatccagagaaggggagtccagaaacatgggaggaaaatgaggagactgtggtatcctggaggccacagggagaaaatgtttcaaggaggaatcttctgcttcaaatgtgtgctgataggttaaataagatagtagctgggaaagaattggctggagtttagcaaagtgtagtagagagatggggggaaaagcaaaattgaatttcggcgacattaagagaaaataggagaatgggaattggagtccactagtacaggcaacttttcgtgaactttgctgtaaaaggagcagaaaaatgggcagtagctgggaaaggacatggtaaaaaggacttgtttaaaggtaacagaaatcataaaataatagcatgtttgcaggctgatgaactgattcagtgaagaaggaaaattaataacaggataaataagggagaaatgactcagtatttgaataggcagagaacttgaggcctagtgcatacatggatagttagccttgggagcagggaaacagctcttatataacataataggaaggcaggcagaacatatggggaaagtgctgttaggaagaactactagaggaacttacggaggttttcttctaactattttattcataaattaggaaatgagatcagctcaaggtgaggattggggaatagggttagaagtttgtagagagaaagtagaatatattcaatacttgtctaagacagtgggcagttacatgaccttaggcaggacttcttggcctttgaggctgggttattctctgctgtaggagaggctgacattatagaatgttgtgtgcatcccaggcttctacccactgtgtgacagcagcagcctttcccctttttctccctcaattgtgacgaccaaaagtgtctccagatattcccaaatgtcctctggggccaaaactgtccccagttgagagccaccagtctaaggaaatgtagtataattgtcaggaagcattaacagccaagttaaggttcataatcatgaatttaacatgagatcattcagcattgttgtgttatattcagctgtgcaggtgcaggcacagaatacgcagaaagttaggtttaaccaggattggggttttgccaaaggagtacaatgaagagactagagaagagccagggagttattttaataattgatcatggcatttataccaggcgaggataaaagtgaggaaagatggtaggaacactagactgtaggtcctactggggtcaaggattatagagattggggttctagagagggtgatgtaatattagggattttcaaaaagaacctactccctgttggtgtctaggaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgtgagtctctctgtgaatactttgcaattctgtgtgtacaacatgcattgttttcaatttgcttagttagatgtcacagataactgttataaaacataagggcacagactgcatactttgtgccatactcaagaactcactatagctgttcatagctgaaaaagaactaaaataagcataaataattattctgatgccaccccattttcgaattggtagtatctgttcattattagttctttaagcaaactattggcagctttgaggcccagtagcttcttttctccatcagattactgtgatgtaacctaggtaggaccatggtcttagctgaacttcctagaccacataggacatagagcataagctttcctcctgctgcaggatatagtgtctctggcaaataaaaaatagtgttacctagcatcaattataatcttaatagaacttttcctttaataaacccatagtaaaggttctatttatctatctaaaagtctataaacatttcatatgtatttggcacaatgaactattagaataatacatattcaagggaccttgacatattataaactcacctacccagcatgattgaaaaatgagatacaatggttagtcaattgccaggttactagaaagttatctattccttctataaaacaccaaatcccaagaattggtattaaacaatgaccctaaaccgaattggctcatttttgatactttgtaattaataatctgtatagcctcagggtcatcatcatgaaagaaacttgtcattgccctaactataaagactgtagtggcatttaataagggttccagggtatggaacgcttagaaaagagaagttactagcaggaacagataattttctcctttgtttgtaggcaatatttttaatgctcagtttctttttcctttttttttttttaggactgtcaatagtcttggagtattaaatggtgcacaacttttctctctcaataaggatgaactgaggacagtctgccctgaaggggcgagagtctatagccaaatcactgtacaaaaagctgcattggaggtatgacttgtcaacctaaggtggtgtttttctgcaaattgaaagctctggaaacaactatttatgtccatattggccaatttccctttcttaacagagctgaattaaatttaactctgcttttgtaaatttgtcactgagatcatcaatgacagtttccagaaggttaatttgttataaatgctcatatgatgtgaagcttgagcacatacttttggaaacttgacaaaaagcataatgttctcattttatatgtattgactaattctataggaaatttaattttgacataacaatggaaattagcttctgagtgagtaagagccttaagaggccagaatccttgcctattcttaatatttttttttttttggagattctaataacgtataggttataagattgtaaaaccctggctgtgtgtgttaggtctagtaatacatctcaataatcgggaaagatacattaggtagagatcactgaaaatagagagcctggaaaagtatttaatcacaatggtctgtatgaaagcaggagagtcatgttttctagattgctttatacttaagcttccaatatcctattttagacttaaaatgtgctatatacgggtagtagtttccaactgttacatctcacagctcttaatagtttcatgaaaattatacttggactcaaatgaaagaatgtaggctttggcatgaaattgatccataatcatctctagcaggtatattctataaattcaacagttaaataattcagggtaaaatcacttcatgcgtatcaccccgtagccattctgaatcaagagaaaccatatttcccttggaggttttccctacaacattgatcttgaaggctccatattaaagtttgatttgattgctttccatatgttgaatattaataaggattatatatttttctcaagcagttttattaccactatatttaattttgttgagagtatataattacttcttcaaggtatgttagaaaatgccatattcctaaaattctgaattccttcatcccacacctgcctatcattattgtcatttgctgtcaccacccacttcaggatggtctcttgcttcttgttctcttcctattctctgcatgggaactgaggcagaggctgactacctgaggttcttcatgttcctcagccaccttctaccacctcaccctttccttggatctagttaatcttttagattatttgcctgtgttgccagagacttctgttgatgggaaaggagaaaagccagcatggtcggagggtcagaactatatggaggggaaactgggtgaattctgagcccactctggcctgagttaaaatcttctaaaggcagatcagtatcttgtttgagcccaaaagagtcctttgataatttaccatgttattatgcttattgtacacatttcctctttctctcagcaaacctagagtactatacatacattattgatttatctttatcatgttcaaatgaaaggcctggtgagtgaattgccttaacagactttacaaaatgaaaaattattaatgtgatatattagtgaagtgcagaagcttcacttaaaaagtagagctgttagctttcctaaagagatactagaagaaaaccacagtagaattttatcctgagccatttcatgatatgacctgcagcctgcacaagtcagtaactatcttgtctgaactgtttatctttcaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattccaacatgctttgttttaagaagccttgaagggaatgtcagattcatttttcttgatgtaatttatcaccataaaaaaaaacccatgcaaacctgagtgagcacaggatttgcttctaggcccattatttttattaaaactgaaaaaatttaaactgaattttttgaccttggaaaatatttttcttactttaccaaggtgaagtttccttaattagactaattattttatccccatcccagggtataaacaggaattgttttgatagtggtggagttattcactgcaacaaagcaacaatgttgtccatgattcaaaatctaagcagtttcgattttgcctgtgaatatggtgtctgtcattcagggcatagctcactgtaggctagcctctgcttacttaagtctcttctctgacatactcaatggaagaatatttagatttatttaaagttcttaatgccaacagtttaaaaaaaaattaaaacatttgaatgaactgtaaagtacagccataccttggacatgcaaatataaatctatggagcattctcaagagagtttgtcatggctctgttgattgcaactccttgtatagcttgtattttgatttagtttatattctgcttattatgtatactgtgttcttatatatgagaaagcacaaatgcgaaagaggtcatgtcttctcaaaatctagcaaaggaagtagtctgcattggtgtgcattacagtattttgcttaatgaaagcctcagttctgaatgttgatatgagtagttaaaaggaagtggggccattttatgtgtttatctgtgtcaagtatttctggtaataagaagcacttaatttacacatattttaatcctgtgaaagattccacatagagaaaagaaagatacctaaccttcaacaaatgttatttttggaaacacaatttttgtcattaaatgttatattatttcacatatataaaacagatgttatgtaagaatgttgtatattttaacataaatcatttagagaaattatctagattcattaattttcatagtgcctttttcacatgagtcagctggaaagtctgcaataaacagtatttgctgtctgttaataaatggtttctgtctcatt

SEQ ID NO: 36214 - DNA, 32865 bp, Homo sapiens
gtgcgcacagcctagagcccgcctccgtgaaagactgccgggcgcatgcggtcggggttgttcactggctgtccggggctccgcgcgcgtcgccggcccagctctgtcgctgacgggaggatctgaagccggccgcaggtaggctgactccagggatcccgggggggatctgttctcccgcgcaggagtcagcggcgcgagctgagcccggcgccgaatagccccgccgccgcggtgacggacgtcgctcctaccaatcaggggcgaggtgactcggcgtcctgcccaatgggctgtgtgcctaacgggagtggggcgggcgccccggccggcgagctgccggctcccgcgcgcgggcctcgtggccgggcggcgctggggagaggggccaagcggggcgcggggcggcttcagaggctgcggggcctgcgctgccgcgctgggccgcgccgaatcagctcggccgggctcgtcggacggagaaggccgtaggggagtggagcggcgcccccccccacaccctccgcccttgctcttcgtctgcgaggaagcccggcagtcgcccatccattcaagcagtgcgggcctcgggcctccggcctcggcgcgggctcagccgcccggggctgggcgcggcagctccgcgccgtaggacgagggggcctgcgaactcgccggccctgggccccgcggctggcctttgggcctcacggcttcctcccttcccggcggccgggggtcggggcgctggcggtgtatagagctcaccacgtttgcgtggcgcccttccgtccacgctcgttacagtttcgaatcctcagcggccctgtgacgcgggcggcgcagagattctcacccccattcccctaggtgagaacccgcgttgcaggcagctcaagtgacatgattgaggtctgcacactagtgatgggggctggcacttcatctcataacattgaaagaaaaagcatttcccccctcagtctttgttgaatttctctgatgcgtcttgatttacgttacttctgtgccggaaaaccttcttgcgccttccgtcaccttcaggattaagttcagattgggcatgccagtttgcacatgatctggcccttgcctacctttccagtttatcttccactgtatatccctgcttccccgccttccccctcacggccttacctctgttctctgtagctgccctgcacctgcctgttcaccctgttccctttcctgtgctctgagtcgtgcagtcagtccttcaaggcccattgcaagtcatatctacaaaacaggagccgcctggatccgcccactacccccaggacttgtctcaccttcctctgatggccatggtactgaaagcgtctgctctcatcgtccccctttatagtctaaacatgttttctgtctgcttccaccgtcactgaattactcatttatttgttaatgtttcatctctccaactggactgccagaaagttgagatatgggcccaaatctgattaatgtttgcagtccccaagcacagtagctgtcatgtaagtcagtagcccataaggatgaatgaatgagcctcccgcctgatctttatgtacactggcatatgtattgccaggcactgagactgcaagaatctaaagagagaaactaaagaacgtaaagagagatgttaaactcttagagtaaaattgggacaaatcaaatgtaattggatgagatgaatcttttgtagaagtaactcactcggtggcagaggaatttctaggatcatccaaaacttagggagaccagggtatagtctcagtaaggtatatgtctggttagaacatatctaaaatgtacctaagactgattttcatgtgtcaataaggaactgtaaagtgagagacttagggtcagataagcttggagacaccgcatactgtatagcagtgatcacagtgcgagtttacttgctaaacactcccaggattcttgcgttaaatgacttggtttaatcagcgtttctctgatttatatccataacaccctttttgagaatcccatgtgcattttgttgaaaccagggagcatgcttttggaaatgctgcagcagaggatgcaaagagcctttggagcggggaagacttctgagcattcttccttccctgccaagtgtgttctttcttgctctggggagggggtggggcgggggaatgcttcgagcacaactccttagttttcttgttccttagtttatttttatcataatttggcttcacatggaacgttcctgaggaggaaaatgtcctgaccatgccaaagtaagcattttctgctactttctaattgtgtttttcattttggtcacatttgggtttgctgaccaaatggacgatcctggacctctgaagctggggaccagtgataaatcctccgtggtgagcctgtcacggtctcctcacctcttgtcgatgctgttttcacctgcatcttgactctgctgcccttatatcttatttctcctttccctgccaccgtggcactgctttttggatttaatctcatctcccctctctttgagtcctctgcccgtcatgtgcttcagactggtttcttatctgatgtccctctcccccagtatttacagtctctcttcattgcatgcctgggagagatttctgacaaggagcaagttgttgttaaattatagaagagaactactttttctttttttttgaggtagtcttattctgtcgcgcacgctggagtgcagtggcatgatcccagctcactgcaacctctgtctcctgggttcaagcgattctcctgcctcagtctcctgagtaactgggactacaggcgtgcgccatcacagccggctaatttttgtatttttagtagagatgcggtttccccatattggccaggctggtctcgaactcctgacctcaagtgatcctcctggctctgcctcccaaagtgctgggattacaggcatgagccaccatgcccagccagagaactacttttaattaaaggaattttggtttagctgcaaccacttttaaatgttgatgttctttccttttagtctatcttttgtaacctagaggagctgtgttttcttgatgatatgttgtagtttagccaaagacattatttatttcctggagaactggagtacttatccaagtttgaatttttttcccatgtagggaaaataatgaggcacctgcctggtatcccagtgtctggcagtgatgtcagcaaacatttggggtgtagtgttctatcagccagcttagagctggttttattaggttgactctgaaggttattagttgtcaaagctttaaacaaaagctgtgttattagagtagcagttgtttttctacacgtatttgactaaagccattcagtgatccaagaaatgtttgttttgatcctatttaaacctgacgagaaccttctgaagtcctgtgacagagaaactgaggcttcaagagggttcatagctaataattggcagagccagtgtttgaacccagatgagtttggtttgttgagatacatttatatcatctgtaatttttccttcttccaggtcaaagagtaaaatgaagtacattctggttactggtggtgttatatcaggaattggaaaaggaatcattgccagcagtgtgggcacaatactcaagtcatgtggtttacatgtaacttcaatcaaaattgacccctacattaacattgatgcaggaacattctctccttatgagcatggtaagcacagtggatttcttcataataattgcatgtggcagaacatgtcagcacttgggaattatgtgcacggtttgcataacttttattttctgccttctaacaggtcccttaatacagcagaatgatacttttctcacctagaaaggaagaagcagaattctttttttttttttttttctttgagacaggatcccactctgtccctcaggctggagtgtagtggtgtgatcatggctcgctgcagcttccacctccttggctcaagcgatcctctcacctcagcctcctgagtagctgggactacaggtgtaaatcaccatgcctggctaatttctaaattttttgtacaggtggggttccactgtgttgtccaggctggtcttgggtcctcccacctgtaatcccaaagtgctgggttttataggtgtgagccaccatgcccgactgccttttacttctttgttgttattgagaacctgtcaatggtgtgacatacagctgtggctgttacttcaaagattaattgcttaaaactgggagagatgttaaaacatacctcttaagttttaaaattctgcattcgtactcctactctctagcgttgaggtgaaaatatgcaagcattaaatgtcactagtgcagaaatcctcgtaacaaatggcatcaggaaaagatccatatacctgagtgatatttaatacagaattcttgagcagaggatgagttatctctctgagggagaaaatgagactttttttcctttcctgtgtttgagcttgtctcctattgtgatggtaggaatgaatcattctgggcaaaatttctagagtgaagtttcatggaatgaatgtgcaacaaaagaatggggtaaatatgtgcagtttcacaaagttgtttagaacaaaagcagagctcggaagctgatttttataatcagcacaagcttaatatgcatatatccaggttttgaatcaaatattgttatcatactttaaaccatattatgctcaattaggagacgtttctgaaggttctttttccctaagcagcagatgctgtatactactgtaaagtcctgtatgcacagcccactgggctgtcatttcttcccatcccatgctattttataactcttcttaagaatgagtttgttgacaggctagaagtatgaggttaccttttagagaatagctggtaatttttctttttgtgtgtcatatttagtcttctagaagtgaatttctgtgcttcctattacgtaattgcacaccttgttaatgagtgttttatttcaggattgcagttgtgccatggtataggtatttttcacttaacgtaaatggtttctctgttcactgcaggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaaggtaatactggatttacctttaaagcttaaaagtcttaaccagtttaatttcttctccctcccacctctacacagatgtgtaattcccttttgagtacagaagtttacattgtatgtgatttcagcatgaaactctcaaggtattgttactgaaatatgccttcagttgaaaaatcagaattatattgttgtttgctaaaaaaaataatttgaagaactacttcttcgttgaagcttgtcaattctgctaaggcagcatgatacgagtccagagagctgttgtttttacacagtaatgagtgtgaaagtggtaaaggcaactcgattagggcattaagccagatggcatgtatgtgtgcatctgggacttactatgtatagaagtgagaaggaaatgaacatctattgtgtatactggtttccaggccgttcatcagtgccatatggcctaggaggagcctgagaagtgggtttctgggtcctcccaagctttcactggcacagcttcgcttacatctatttgctgttttggggttttgtacaaacattcatttaaggaaaatgttttgctgctttaaaaaggtggggatggaaaactactgatctagtataatggcagtggcccaaatttggagaggttgctgaaaagtggctttaatctgagttatgagagcagatctgcttttggctttagactttactggcctgaaagctgagggtcacactgacagctggctctggtctggggctgccctggcaagattctgggctaattgggtcatgtttggatcttagcttcccctctcaccagctttgtgaacatgggcaaattaacctcttcaaaatgtggattccttttctgtaaaatggagacaataacaacacctacctctctaggttgttaggaagattaaagaaactaaaagtcagtgaagtgtttccctgacttcctgacacatagaaaggaatcagttaggaattagaatggttttgatcttacagtttgctgtttatttattcatcatccatcaaatttgcattgaatgctcactgcagtcagaccctcactggtgctggtgatgcatgtgatgagcaagaccagagaagtcattgcccacatggaggttacctgtgggggaggcaaacaacaaacatgaaacaaaacgagacgtctgtcagaagctgtgaagaaaccaagtggagtgaggacagagtgactggggaaagccactttgggcaggtggtcggggagtctcccaagagaggccatttgagctgagaggccagtcacagcgagagtggaatgagaagtgcggaggcgcagggctacgaaggcgtggttggtccgggaatggaggggaggccggcatagctaaggcagagtgactgagggagatggtcagagagcgggggtggtagccacagccaggttctacccagtcgctgggccgcagcaagaagctaggagtgtactcggaggagtgggaagccaccgaaaagttgaagtgtgggagtgatgaattctgacttgaattttaaaagatcactttgacgccatgtgtggagtagataatgaatattcttctgcgtgaggcaaatgaatatccttgtgcatgaggcattgctgtaactggagtaacctggagttaaacagtaatcttcaccttttaggaacttgccatctgtgcccaacaactatgatttttgaagtgttgagcaattgctggcattctttgagcattgacatggcaggcactttaccgagcattttacaggtgctgtctcacaaaatttccacagcttaacaggtggggaaaacaagcttaaaatggttctataattggcccaaagatccacagctaacgagtcatgagactaaggtttgaatccagacattctgaccccgggtgctgtgcttctaaccactctgctgtgctgtgctggctcactgcagtggattgtctaccctttggtaaactggaaacatatggaacagggtcccagaagtctcttgttcctggaagtgcactgaagtgtaatgtgcctaccttcagctgtgagcaatagggttggctatactggtgtgtggccaaaagggtagactctgcacaggggcacgtgcgcctgtgtggctcaggacactgctgtcagccttgctctgttgcagggcttccagcaacaacttagacatctggctgcaggaagtgtgagctcagagatttgttgaggccagttaaagggggcctcaaaagtatttttatgaccctattgctactctctccaggcaaagagtgctgcagtttgttttcacagtaagtgcatttgtctcaatcaatgtagatggacaagcgtaagttccctgtttgttttctttttcccagttgtccctcatatcacagatgcaatccaggagtgggtgatgagacaggcgttaatacctgtagatgaagatggcctggaacctcaagtgtgtgttattgaggtttgtatgattcctgcacatgtgaacaagtgtactcatctccttagtcagccatcaataactgataagacagttcccagtggagcccttggccttcctatctctggtgcagtatgttgcaatgtggcaggtaagggcacagttaacagtcatgtggaatggccacgcaagggaaaaccgtagtttgcccagtgttccttttttgtagcatttatggtacaatcacttagtactgattgtccccatgagtagtgtgacacattttcatctgtctcttgagcaagtcagcagatcttttgctttcgtctggcaagagcattcgtctccgaatgagcttcatttggtttcagtatctgtactcctgctgtgctgatcctagctgttggatctcagtgttcctcagataacaggagactcaaaagttccagcagtttgtttataactaatactttttttttgagacagggtctcactctgtcacccaggctggagtccagtgcagcagtcatggctcactgcaaccttgacctcctgggctcaagcagttctcctaccttagcctcccaagtagctgggactacagtgcgcaccaccatgcccggctagtttttgtacttttttgggagaggcagggtttcgtcattttgcccaggatggtctctaactcctgaactcaagccatctgcctgccttggcctcccaaagtgttaggattacagatgtgagccaccgtgcccagccaactgatgctttttcagtacaaaaattatttatggttaactaaggagataagatttaggtttttcttttttttttttttttactttgtcactgtgatagagataacattcctggcacctctctcatctgacctttttcttgaaatgatgtggaaagttccataataacctttgggaaggatgagcctgtccaaaagaataaccttttagtacaaagagttgtctaattcctgttaactgttaactaacattatacagggttagagagtccgtgttacataattactgatactgaatcaggaagacagaacagttgttagaaaactaaactgccagagaagggtttagtgcctaacctctgaaacaactttgttcttctagcttggtggaaccgtgggggacatagaaagcatgccctttattgaggccttccgtcagttccaattcaaggtcaaaagagagaacttttgtaacatccacgtcagtctagttccccaggtaagtaagacattgaaagttttactttgggggagatggagaggagggaggaaaggtaaaccggaatgattttcactcattgtctagtagttttcacttgaggtgcaggaagcagagaataaagaactttgtaagtttaaatttgttacaatcatacttttttgaaaagatcaaatagaaaacatttgaaaaatcagggcagttgcatttgcagatgtagattggccgtgtgcatttgtctttactatatggtggaactagagtaaagaggctgtttttaaagacaaatcttgtggagaggagtcaatagtaacaaaaattgggaagccggaaagcagatggatgcatagaaccgactaagctgaccttgagtgccggatcttaagcccgcagcagtgaaagcagagaagcagccctgtttgccctgcagaaccccaaaagctcaggagtgggatgagggtgggcctcatgtaactactgcttcagaagactcagaccctgacatctttttcctacagtgcacagttgggcgttagcctcctcccaccttggcagaagactggaggcttgttctctggggagggttcctggatgagcagacagtagggacagttgagggcagtaacactggactacaaacatggggttatgtgtaatgttaacgctgttgacagtccttgccttcttccaccatttggttcccagaatcatcatgtttaggcttggccattccacgtaggaggttgtaagattgtcttctggggtatggatagcccaggataaaagacactggctctggcggctccccatgaaataagccagccagattttcaccatgacaagcctacacactcacacataacttataggtagcatttaagcaggcctccatacacttggagaaagcatctgataggtaagagaccaaacaacagaaagaaagaaacttacagggaactgaggcgctacaagcagaggaaactttaaaaaaacaccaaaaaaccaaaaatgacctgtcattactattcttagaaaattagaaggagataagctatatccgttaggtaagaactggatgctataagaaagaaacattgagagaacagaaaagaatccttggaaattaaaaattagatagcagaaatgaaaaagttaagagaaagtaagttgaggaaatacccaaggaagtacagcaaaaagaccaagagatagaaaataggagagaaaaggtaaaattagaggactggctcagaagttctaatgtccaaataataggagttccaaaaaataagaacacagaaatggaggtataatctgaaccccaggggtcagcaaatgatggcctatgggccacatgaacctacccccccgtatttggaaatcaagtttatggaaatacagctgtgtctgcttgtttatgtgctgtctgtggctgcttttgctctagaacagtagagttgaatacttgtggcagagactgtgtggcccacaaaacctaaaatacttactatcagggcctttacagaaaaaattttctgaccccttatctgaacaattcaaggaaatttctagacatcagtttctgggttgaaagggcccccttggtgcctatcatattggatgacagatgacctacaccaaggcatattattgtgaaggttcagactaatggggcagaagttctaaaaggctctgaagagaaaaatcaagaatcattgtgccactggaccccttagcaacaatactggaagctaaaagacattgatgctatttcattaaaaattctagtggaggctgagcatggtggctcacacctgttatctcagcagtttgggaggcagaggtgggaggactgcttgagcctatgagtttgagaccagcctgggcaatgtgacaagagcctgtctcgatttaaaaaaaaagaaaaagtccaacagaaaatgatttccatcctacaagtccatgtgtaacgtgtatctgttaagtgtgagagaagaataaagatgatttagtacagaaaggaaaagtgtggcacatggtttgggaacagtatttaaatacttaaaaagtatgtaaacccaaaagaggactgcaggcacaggaaagtgtctaatgggggcaggatcctcatttaacagggaaatcaatagaaaatgcctccaagtaaatgtggagaagtagcacaccagcaagatcagttaagagttgaagagcggttgtttctagggattggaaaggggagagtgggtgagggccgatactgcttacaagctcggttagaaccatttgattctaaaatgcatgcatgtgtaactttgacaaacataaaagctaaattacacaagtgaccaaatgatctatttccttattaaaagaggttcaaggaaaagtcatacttgaaaattccttatcagagggaaactaacttttttttttttttcttttgtgaaatagccaagttcaacaggggaacagaagactaaacctacccagaatagtgttcgggaacttagaggacttgggctttccccagatctggtaagatttcctgatagctggttgcagtgtaatcttttatgtctagttaagatcactctatcatgacagacaagacctttgtcttgttgggttgcttttgataattgatgatggagaaaataggattagttctttgaaccgggctgtagtttgcaagatgttcatacttagagcgtgttaggtcttgtactccccagaccttatttttcctctcagtctttttactctcatttttactcctacttgggaacactaatggaggaaaatcccagagctcttgtagttcattaatgtattcatttgtactgccattctcttatgtttctccagtttggcgtttacggattttagctttgaaacgagtcataatatttttatggattatgtgcctggtgctgagagttaacgttttcgttcatcttaacaatgtgatgtctgttttaatttcagtcaggagaaacccctacttctgtcattttttccttctgtctaagccatcttgttctctactgctaggttgtatgcaggtgctcaaatccacttgacacatcagtgaaggagaaaatatcaatgttctgccatgttgagcctgaacaagtgagtagaaattcccatctctaataagttgttttttgcttctaattgtcctaaagcctcttgatcagtttcgtgaggcttgttattttctaattagagatagtgggctgttccagaagaacccattgccatcggccattccctgcctctcctggttccccaaacaacacctgtgtccctcctgcctcttctccgtgcctcgttgtactttgtgcttcagccgggtggagtatctttcggttcccctagtaccctccactctccctatgattgtactttttcactggctaatttctgttaagaacccatgtccccctcttcctgttggcttggcagtctcctactcactctcatccttcaggttctagcgaagacatagtgttgtctgagaagctttaactgccaaacctcctggcccttggccttcagggttaactgcgtccttcactgggctcctgtgtggtgtcgcatgtatgctgctgatgggcccatctttctggtgtgtgtgtgtgtgtacatgtgtggtgtgtatctcccttcacagactctaagcttctggagggcaagggccacctcattcaactttctgtttctggtgcctggtgtctagggtgttgtaggctgtcacagagatcttagtgtttttgttactgtacctatgatgcaggaaatccaaaatttggaacctgtaatgtatctaagtgtggtgcttagtatggaaattctagtggtgatacattgagcatgtagctttggccaggttttagatatttctggcctagcaagtgaaggaaattcaattctgtagcagaataggttgtcattaaaattgttcaattttttttttttttttttttttaattgagacagagtctcgctgtgtcgcccaggctggagtgcagtggcgcgatctttttggctcactgtgacctccacctcccaggttcaagcgattctcctacctcagcttcccgagtagcttggattacaggtgtgcaccaccactcctggctaatttttgtatttttagtagagatggggtttcattatgttggccaggctggtctcaaagtcctgacctcaggtgatccacctgcctcagcctcccaaagtgctgggattacaggtgtgagggcgcccggccttaaaaatattcactattaaaaatgtaacaagtatttccacatttaagtttaagtttcagattttttgctttttttttgagatggagttttcactttttcatccaggctggagtgaagtggagcaatctcagctcagtggaacctccacctgctgggttcaagtgattctcctgcctcagcctcccgaatagctgggattataggcacctgccacgatgccgagctaatttttgtatttttagtagaaatggtgttttgccatgcgggccaagttggtctggaactcctgacctcaggtgagccacccgtcttggcctcccaaagtgctaggattacaggtgtgagctaccacgcctggccttgccttttttttttaagagacaaggtcttgctgtgtcaccctgactagagtgcagtggtgctgtcacagctcactgcagcctgggcttaaacagccctcctgcctcagcctcctgagtagctagtaccttaggcggacgctaccatgttcagctgttttattttttgtagagatgaggtcttgctatggttgcccaggctggtcttgaactctttgggctcaggcagtcttcttgcttcagtcttccaaaatgttgagattacaggcgtgagccggcaatgcccagccttacttactcttttaattggaatgtttatcttactgagttgacttgatatagtctgaatacaagtctttcatcaggtatgtgattttcacatattttctccctatctgtgccttgtcttttcattttcttctctcttttttttttttttttttttttgagatggagtcttgatctgttgctcagactgtagtgcagtggcatgatcttggctcactgccatctctgtctcccgtgttcaagcgattctcctgcctcagcctcctgagtagctggggctacaggcatgcaccaccacacctggctaatttttgtatttttagtagagacggggttttgccaagttggccaggctggttgcgaactcctgacctcaggtgatctgcctgcctcggcctcccaaagtgctgggattacaggtgtgagccaccgcacctggccttcattttcttaatagtgtcttttagagcacagacacttttaaatttcgatgaagtccaatctgtttttttcttttatggattgtgctttcactgtcgtgtctaagaactccttgctcttaaccaaggtcatgaagattttcttgtaaaagttagttttaggtcttacatgatccattctaggttaacttttgtgtgtagtgtgaggtaagggttgaaatttttacatgtggatatctacttgcctcagccccatttgttgaaaagactatccttggatactattctgtactttttaaaaataaaggtacattatagatttactaatcttcataaagttgtttagacttatttatagctattcataatttttattactaccgtgtatttttaaaaattatattttctgattagataataccccatgtgtaggagaccctgctgacctctgtccattcatctacagcctagcaaccttactaaaattctattagtactgattgtttacctgtaaattcttttggtttttatggataagcagtgatattgtatgcattattcagtggcaaccgcttcttgttttctggttcatttttttttcttatctaatgataatggctaatatcttcagtacatcattgaatagaagtactgaaagtggccattctggccttgttctggactttaaatagtaaacattaatattaaaccatgtgatgtttactgtgggttttttatattgccaaattttccctaatcttaatttaccaataatttttattatgaatttggttttgaatttttatcaagtctacatctactgagggaattgttttcctccttaatctgttttctatttatgtggtgaattccactgttaaatttcctaacacagtagttctcaaacttgactgcacactggaatcacttggggagctttaaaaatactgatgcctgcctcctaccccacaagatcctaattcaagtggtctggggtgcagcatgggcttttgaccttttataagctctgaatgattccaatatgcagctgagtttgagaaccactgttcctagttaagccattcataggttcgtggacatgatttttttaaagctacatttgtgatttggatcatgaattattattattattatttttaagacaggttctggctctgttgcccaggctggagtacagtgatgcgatcttggctcactgcaacctccaactcccaggctcaagtgatcctcccacctcagcctcccgagtagctgggaccatgggcacatgccaccacacccagctaattttttgggtgtttttttttttttttgagacagagtctcactctgtcacccagactggagtgcagtggcacaatctcagctcactacagcttcaagctcccaggctcaagtgattctcccacctcagctaccccccagttagctgagactacatgcacatgcccaccatgcctggctaaattttgtatttttttgtagagacagtgttttaccatattgcccagtctggtcttgaactcctgagctcgagcaatcctcctgccatggcctcccaaagtactaggattataagcataagccaccttgcccagccatgaattttttttaaaggacttttgcatccatgttcataatagattggccactaattttctattctattcttgagtctgttttagtagtttatctagaaaattgtccttttttctgttttcaaatacataatatttttacaaggtcacgtagctagtaggaggctgtaagcctggtgagtttttgcttttatttaataacttgcttttttctaaacaggtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacaggtttgcctgcaatgaggagctgggagtgctagcctcctttactcttttgtagggctggtgaagccgactctagccctagcacttttgtacttttgcacttctgccatccactcattagaagagcctttgtagtaagagatgttcagaaaggatcttagctgtcacgtagctgtggcacagatgaggagatcctgatagggccaggccaggtgccgggcctccagacaatgagttcgggttatgtcttaacacgcttgtctcttaccaactagatcagtgcagatgggcgtcctggtggcagcgggtgagtgtgcatatccaaagcccacacgaatggctgacagtggctggagcactcctgggtaccactccagagttctgagctgtgtttgggaatgtgtctcaccccacaccagaaagggatcacattaggacggggatgtgttgctgcctactccactacatccttttaaggctcggtgatgctgtcacattccttcagaaatcttcacttcgtgtcttagagcaatgggcaggccttatcttagttgcaagatcaatatgatggcctagaagcatttggagagggcatactcattccgttgctctgtgagaatcatttttcatttcaacattttcctttcagtctttgtctgcttacatatagctatcagaatggcagttttatcatcctttttcataaaacattataagcattttgctctgttattatattttacaatgaaaacttttaatgagtgtggacttttctattttgtgaatgtcccataatttgtttgacacttgccttcaccccattaattcttgtgaattgtctatgtctgttattttttttggtctttggtatgaaaaaaattttttgtaggcaaatttgtgtgagacgttgaaactctttgtaagtttcaaaacaaaaacaaaaaaaaaatttttctttacaaagcctgccatgttgatctgaaaattacttcctctttactggtctgtacacagaactcagataatagctattcccgttatattcttcccaggtgtgtttttgttgttttttgtgggggttttttgaggcagggtctcacactgttgcccaggctgtagtgcagtggtgcagtcagctcactgtaacctccaactcctgggctcaagatccccccgcctcagcctttcaaagtgctgggattataggattatgggcgtgagctcatcctggccagacgtggttttttttcccttgaaatagctattttggtctcatgatagcgtgtaccttctgagtaattgggtttttcttgacgtttatttgatagatatgatcgcttgctggagacctgctctattgcccttgtgggcaaatacacgaagttctcagactcctatgcctctgtcattaaggctctggagcattctgcactggccatcaaccacaaattggaaatcaaggtaaggagggtggcacaggtacagccaaaggatgagcagggaagcagtctgtagtctcgtaggtgctgtgtcatatctgctttctgtttggagctcagaattactttttaaggaattactttttaaggattaaaaagatttgtggttgcttcgtggctttgagaagacagtagagcattttcaggaattaatgaaggggagagatggctagaggagagggtgagagagacttgagttcttggctatgactatcaggtaaccaaataaaatgccctgtggaaatggggaccactgatggaccacaggcatgctgcacagttgatagctggaggctcttggagactttgttggcatgtgggctgcctttcctaacctgtgcttatcacttattgcagagtgggaatgacagtattgacctcacggagctgtgaggtttctctgggatgcagggcaggcactcagtaaatggtagttactgtgttctggtctgtgccatggcgggcagcagctgagctggtggaatggtggggcatggccctgcttgtctgtgggtggcagtagagtgtcatggttaagagcatggatgccgtggctaggcgcgttggctcatgcctgtaatcccagcactttgggaggccgaggtgggcagatcacgaggtcaggagattgagaccgttctggctaacacggtgaaaccctgtctctacttacaatacaaaacattagccaggcatggtggcatgtgcctgtagtcctagctacttgggaggctgaggcaggagaattgcttgaacctgggaggtggaggttgcagtgagccgagattgcacctctgcactccagcctgggcaacagagtgagactctgtctaaaaaaaaaaaaaaaaaaaaaaaaaacatggatgcctgagcccggtgaccagggctcagattctagctctgtcatctacaagcggtgagacctagacaacttacttaaccctctttgtgcctcagtttccacattgttaaaaagggatggtgatggtgccttcctcctagggttgttgtaagaagttcatgaatacaaagtgctgagaattatgcctggcatatggtaagcactatgtcagctgtcgttaaaccctcccttctgcctgtcccctttattccttttcttcctggcccatcagctgaagcttttcaggaagagatgaaggtcagaggtaaagttggggctcagtgctgaggttgttaaacaggccccatgtagctgtccccacattggggtttgctttctacttcccaggtgtttctcagcgtgagagtttagtttgctttgtgctgctggacaggttcctgcagaatggcctgttgtacgagttttaagaatttaaatcccattacacagccctgacttcttatttgctagttctttccatcattcatttattttatccacttggagttagtctgtggctgccatgtgtttgtcaggtggcagaggatgagagatggatgaaaaggcaacggtctccgcctttaaggaatattgagtctcttaggaaggaaggagcacataggagaggctgaacctgctgtggcagacacatgaggaaggcagacttcctcatggagggacaccaggttgggttgggtaggatggagaaggctcggaaggggcattcctgttagaatagatagagcacgtccaagggcttggagatgtggagcagttggaaacactgtggatggaaattgtgaattggaggctgtctggagacaggctggtgagggcctgcccacaattccatgaactgggccaaatctgggtcttaccctgaggttcaggaaactaactgcagggtttaggtaggagattgtagaaaagtggtgaacaccctaatttaaaaagtgggcacgagatttgaacagacacttccaaaaaaagatgtaggtgataaacacgaaaaggtgctcaacacctctagttagggaaatcagtgcagatgaagtcacaatgagatagtgacacaaaccccctagagcggctgagtgttagagaggctgtggagctcttaccttgctgccgggagtgtaaaatggcaccaccacactagaaaacagtctggtagtttcttatcaaggtagagacgtgtgatccaataagtccattcccagatactcacttgagagacttgaaaacgtccacaaaaaaagatttttattcaaatggacaaattattcgtaatagctgaaatctcgaaacaacccaaatatttatagcctgtcaatggatcaatttgtaatggtttatttatatagtagaaaccactcagcaatgaaaaggaagaaaccaggctgaacactgactggctcaagcccataatcccaacacttagggaggctctgctgtgggaggatcgcctaagaccagtagttcgagagcagcctggtcaacatagcgagacccccgtctctgcaaaaaaaagttaaaaaagaaaaggaacaaacaactgataaacacagcaacatggatgaacttcaaaaacactaagcaaaagaagccagacacaaaaggttatatactatttggctccatttatatgatgttctataagaggcaaaacgaatctgtgatgatagaaattggatctgaggttgtttggggtaggaggtagaggggcacattctgggaagatggtaacttatgttttgttttgttttgttttgttttgttttgttttgttttgtttgagatggagtctcgctctgtcacccaggctggagtgcagtggcatgatcccagttcactgcaacctctgccttccaggttcaagcagttctcctgcctcagcctcttgggtagctgggactacaggtgcatgccaccacacccagctattttttttttttttttgtatttttagtagagatggggtttcaccatgtttgccaggctagtctcgaactcctgacctcaagtgatccacccgcctcggccttccaaagtgctgggattataggtgtgagccaccacgcccggctcattctatatcttggtgtgtatgtttgacaaaactcttcaaagtatgcacttaaaatgcttgtattttattgtatgtgaattatgcttcaatatggtagaaagaaaaagaaaaaacccacaaaagctgggcggaagatgggctgaggaggctgtcattgaacagaaagccctctagagtctgctgcagaggcttagctgagacccgatcctgaacacagtagagtgcagaaagagagagatttgggaatttaatgattttgaaggaaactgttgtattttaaaacctcatatttaaaaaatgtttaagttattaaatatattaagttgatcactttaaagccagtattaagatgatcactttaaagccagaatcaagaaagacaactttgataaaatgataatattatttaaaaattaagaacgcacagcctggggtcacgagcctgcttttctcccctgtctgaataacatccagtacatagattctgcggacttggagcccatcacctcgcaagaagagcccgtgcgctaccacgaagcttggcagaagctctgtagtgctcagtgagtagagttcgctgccttgggtttccagagttcttttggtttgttttaatgaaaaagtcctcttgttttcatgtgccagtagtaggtaattgacttgttaaaatattttttaattgttgaaaagactacatgccatctgatttaatccttaaaaaatgcagcttgtcaatatcattggatctgaaaagctgctctgattttgatattgtttgccatatgcatctattgatgaggctcatttaaggatttttcatccagaacatttgatgagtacccatcagtagagtctcatcagttgttttggcagctgttatttataatagtaaaacattagcaagaatttctggttcactagaacagttgaatattacggaggtgtacaccttcttctgagtgtcttggtcagtacggcacacagagctgatgaagaaaggcccccttaggggagcattttaagccaagaggtaagataaattgttaatattaatatatgtatttaaaattttgggctgggcacagtggctcatgcctgtaatcctaaaactttgagaggctgaggtgggaggattgcttgagcccaagagttcaagaccagcccaggcaacatagggagaccctgtttctacaacaaaaacaacaaaaccagctgggtgtggtcccagctccttgggagatcaaggctgcagtgagctgtgatcacaccactgcactccagcctgggtaacagtgtgagaccctgtctcaagaaaaaaaaattgtgaacaactcagtaccaaagatagtgcagtggcagtattacaattatgtatactatctttttcacttgcaataagcatgttcttaagttactaagaaaagtccatagtttcatatgcagtttctaagttgatagtgtttacatacaattcattgtcacagtagcacaatgtatggggttaattcatggcttcagtgtcttggtaatggcccgttaggcgattattgcaagttggactggtagaaaaggggaattgcctttgtggtttgttcttttgtgcagtggagtgctggttccaggaggatttggtgttcgaggaacagaaggaaaaatccaagcaattgcctgggctcggaatcagaaaaagccttttttgggtaaggagctctgcagtgcagtcttcacttaagagtaggaaagagtggggaacggtgccacgtgggagcctatgaacaaagtggggggattactgaaacatgctgtctttgtggataggagctcaagtagaagccttcatgttttctctttagagacaaattcagtcttggaaagcttatttatgcttatgagctacatgtagatgtcgtggaattttgagagaatgaattgtgaattcctgtccatttaatgaacccagctgtttgtagcacacgtgaggttgagttttatatctgctcacttggcacaacagctgactgtaattggacaaaatgattttgcatgcctcctggtgctgtacattttagtaattttcaacttgaacaattataaataaaaacttaatgagagagggtaagaaaacttgaattttaaagtactgaggctaggcacggtggttcacacctgtaaacccaacacttgtggaggctgaggcaggagggttgctggatcccagaaatttgaggctgtagtgagccaagatctctccactgcactccagagtgggcaacagcaagaccctgtctggggggaaaaaagtactgaatagaatatcacttacttctaaaatcggataactttgcaaatctagaattttcatctactttacatgcagtttttgaaatctaatacaagtaaagtgtaacagcagagagtacttgttcatagcaggaagttatgagtttgcaattataattctccaaataaaggacacaaaggccattgcagaggctgctgggaaaagtaggagctgccttttcaatggagttttgtttgttttttccccccgactggaaggcgtgtgcttagggatgcagttggcagtggttgaattctcaagaaacgtgctgggatggcaaggtaagcgtgcattaagacactcattcaattcccgcttgtgtatttctggaggatatgaggcctgttgccgcctgggtgatcaggagctttggagaagggcaggcctgggttcctagcacctcatggtgtgccgtaagggagctgccttgcctcttgaggaacagcacggctcctccatgcaggaaggagggagcacagccagactccctcctttgccttctgcctctgtgttcctgttcttgagattctgtcactttgatcaccgtggccaccatcctgaagctggtgcctggtgtgaagtccttgtcctaagtgaggcttgggcagttattatgagaacctgggctctggagctattgaaactgggctcagattccaaccttaccgcttatgggtgattttaagcaatttacttagcctttatgggcctccgttttttctgtaaaatgggagtaataaaggtacgtacttcacatgattaagggagataatgtatgtaaatagtctctagtagtgcctggaaaatagggaaatgctcagataatatcagctcttcgcctagctgtgtattactatgtgacagacctccctaaagctcagtggctcccaacagcagtgacttctcatctcagtattctgtggtttggctcagtgcctgggtttcagctgcacgtggtgtactatctgagatggcacactcctgccttgtgttcagctgtgagctcggcccagccgggacgtcaagatgctgtctccacctagtggctcatcattcattaatccagcccaagcttcctcacacagggtgggcagctggactccaaaatgacaggcctgttatgcaggcacttatcaggcctgctgatgtcccgttggccaaaacaagtcacgtggccaagccccgagccggcaggggaggagaacacacatgggtgtgaagactgagcatgctgcactggggccaccctggaatggtccaccacagcccatttattctctgtagcccacccgacaaatactagattttcagaaagaccttgtaaattctgtggaaaataaagtaacctgaaggaatgtaaaagcagtttgactttataaagaacaagtgactctggtggccagcatatggtttagggctgggtttcattcaccctttccctgagaggctgcttcacagtgacctggcggtgtggcttagtttggtagacagcatgcccttgagtgctggcttctgagtcctgagaggcactgtcttatcacccgccaccccagagctggctttctggtctccctggatccttcacagccccagacctctgcctctcacttaggttcccaaatgggtaggtgctttggtgatgagcttacacttcagttgagactggaccctggttcaggccaggaggagaacagtgcccagcgttcacatagtaccaggaacttggtcctttgccttttggtctttagtggttttgctttggttagacggtaagttcaatgaaggttagaaaggttgagttgaaatcagttcatttctgactgagctattgagtgaaacagttgagtagggctttgtattagctgctgaagatgaaagaagtatagaagaaatagtacttgtttatctcagagagacaagagtctgaaacattaagacaatataaaaacttggctgggcatggtggttcaggcctgtaatcccagcactttgggaggctgagttgggttaatcacttgaggccaggaggtcgagaccagcctggccaacatggaaaaaccccatctctactaaaaatacaaaaaataaccaggtgtggtggtgtgcgcctgtaatcccagctacttgggaggccaagacatgagaatcacttgaattctggaggtgtaggttgcagtgagccaagattgtgccactgcactccattctgggtgacatagtgagactcttgtcttaaaacacaaacaaacaatataagaactgtcacaggcggggcgcagtggctcacgcctgtaatcccagcactttgggaggccgaggcaggcagatcacctgaggtcaggagttcgagaccagcctgaccaacatggagaaaccccgtctctactaaaaatacaaagttagctgggcatggtggtgtatacctgtaatcccagctactcgggaggctgagacaggagaatcgcttgagacctggaggtggaggttttggtgccgagatcacgccattgcactccagcctgcccacacttgttgcccacaagtgtgaaattctgtctcaaaaaaaaaaaactgtcaaagatacagtatctaattaaaaattactaggttatgccattagttttgattttcccattttgtactgattgactttccagagagttatacttaacgtaaaaaaattcacgtgtgtgtgggttgagtattttatgtcttaaaaatgctatttattgccggtctggtggcttgcacctgtaatcccagtactttgggatgccaaagcaggaggattgcttgagcccaggtgtttgagactagcctggcaatatagcctttgtctctccaaaaaatgaaaaaaaattagctggatgtggtagtgtgcccctgtagtttgaccttcttgggaggctgaggctggcggattgcttgaacctgggagttcaaggctgcagtgagctatgatcgcaccactgcactccagcctggacaacagtgagatctcgtctggggatgaggtcagggggatgctatctttagtttttgttctaatcactgatcttaaactgaggagggaagttgtgtttagagcttagcaatgaaactattaatcactttcgtttgtaactattttcataacaagtattttggtatttcagatgccaattctacagagtttgaccctacgaccagtcatcccgtggtgagtcaagtgtttgaacctccacagggcttagaagggtgtagaaggggcatttatgaacgtgattgatgattagagacaagaagtgagactgcttgagtccatcccaaagaaccctgaggttttgggcactcagacctaccagagaggaaaaacttttctttttcattatgtaattcctccctaatctttcattgaccacagaaagtttttaagacaggtaccagcccaggaaactggaggggattcctgattaaaattcttctccatccctactcccctcaactcccagaacacagtatagatactaatatgagaccctggcatgtgtacttactgtgtgccagccgctgctctcactgctttcatatgtatattttatattaattcatgggatccccagccatagtcctgggagaactgctgggttggagcactggttggcttaaccgtatccaaagattttccaggctggcgtaccttgcgttagatttcatgccgagggcatgtggcattctcagcccgctgtactgttaggcacatggaggagggacgatgcctttaatcacctttgaattcccagcccagggtgacagggatgtaaagggaagggcacttatttacgtttttcagcagtcagcaaatgtgaatgcgtactatatgctgggactgcccttgtcactgaggacaccgtgctaaatgagacggacaaagttcttgatctcacggcacttagacagcatcactgtgtttgttgacctgaaattgaactttgctgatactaaggcctcaggagtggaccagcaaatgttttgcagcatggggctttggggtcaggaggaacagggcacagagagcctggaatcagaaggtgcctgggaacgctgggctgagaggtggactgggccatcagtgcatggcccacccagtcctcagatgcttgctaagctgcagggtgctagccctgcatcccttgcctttgagcagtcatcaggctagctggggcgatgacagacatgttatgacacatccagtccgtgtctgtgctactgtatcagtctttctaaggaagtgatgcttaccgtccacagtgctggggcgggactagcctgaggaggggctgctgtggtcctgtctgcagatcaggaggacaggctgaaggacggagcctccacccaaccgaggttacaaatgccaactgggaggcattttcttctgtgacaaaatgtctcataaggaaagcctggagaattagagcttacttacaagcctttgccacccactcagcgagggaggtttctctctagcggaagcagagttctgtagttggtgtctgttttctgaacatctccaggtcgtagacatgccagaacacaacccagggcagatgggcggaaccatgaggctgggcaagaggagaaccctgttccagaccaagaactcagtcatgagtaagagctgcctcacgctggcccagcctttggctctgcgtgcccaggacgcgtgtcttagggtgatgctgtggcttcgaggagcaggctggctttttttggtttcgttcttgcttttgaagttcattctttcctctcttattcatacccttttaggatgcactgtgatagccatagaagcagtgtgggtcttagaaaggacactggcagtgcagtcagactcctaggcatgggcgcctcaacagaatgaggcagtgaggttacattcatccttatcggttactttcctattaagaccagccatatcaattgctgatgtttggcaatttttgtcacacaaagatggcaatttcatatgattcagcctaagtagattctgttctaataaagtactaatagatgctgaaggtttagggtagttttcggaggaaaatagttaagaaaatgactattacacagatttccttcttgtctactgggaaaattctgcctttactgtattagcagaggcacccttgtgtctgtctgggcgttctgtagcagcatagctggagtcacttgagtatcggatctttctcttaccaactctgatgttctgtggatttggggatctcgaggcaactgtgaaatgagtcagtagagcagcccgttcgcaaatgtccagcttgttcacatgcagccactgagggctgatgacctttgatgaccatgattggaactgaatgatcatcagaggtcatctgtgcagctcttaaaatgcctcccatcctgccacgttcccagggccttgccgtttcgtacatcctgatttgctttccaaggcagttttctagcagcaaagtgcccatactttgcaatcatgtgtttgagggtggtggtgagagtcttgtttctgttacagctttctgtagtgttgtcagaaagagtcaaaagcccaagaattagtctaaactgtgttgttaagagcaggtgaccttagcagattcatagaaatagccctcaaaagacctggctgtgtggatgatgaaaagtaaagcaggaaggaggatgtctttgtgaacgcatcatcctgtgagataaagttctttacatacagcccgtttgttttgccagggaaactctatggagacgcagactacttggaagagaggcaccgccaccgatttgaggtgaggattccagcttgctggtactctggaaagatagtgagctgagagaccagcagaattatttttcatgcctcaacaggtgaatccagtctggaaaaagtgtttggaagaacaaggcttgaagtttgttggccaagatgttgaaggagagagaatggaaattgtggagttagaaggtgattattcgggcagttttatttaatggaaaacttagtaaagttttcttggcatatgggaaaatataaaaatgttatcttgttgctcctgacctaacagaattaggaagcagcactgtctcatgagggaaggggtcttgataaacatggggtctggactctagaaacttctttctggtacatggccttcctcggggagccatttaacttctggccgcagtttctccttctccaaaatgcttggagttggtactaaagccacttcagccctctcctgaaccgcaagactcagtctacagaaatcctgggagccagggtcttgggcgggaccctggacaggaggccttcagccaggaggggacagcacaaaccgtgctgagaaagggtatcagatcactcatgctttgaggttccctttatctagattcaaatgagaaagtcattttcaaattattttagggcctatggaaacaaacatttaagcagattttgttcttttacactttgtgcataaccttcacaatgaagctgtttcttttgaatctctatttcagatcatcccttttttgttggggttcagtaccaccctgagttcctgtccaggcctatcaagccctccccaccatactttggcctcctcctggcctctgtggggcggctctcacattacctccagaaaggctgcaggctctcacccaggtaggcgcactctttgcttcagtaatccattagtcttctctagtcctttaggtggtcgctgattcattacagcaacacgtcacagtcagtcataagaaaaaaaagccacaggcgcctggggtgaaagtttcctctcctttcccggagctttctcacggtgtttccctggcatattggccaggtccccctttctgcagcatctgagctctggtggtgctgaccagatcacacttggcgtaggaccctctggtccatgttaaggggaactagtttttcctgggaagtaagccacaatgggtaggtttatgtcccattgccacctttatccagaaccagtactcagagttggtggtagggtgtgtgactgaagtataaatggaatgtatatcttttgtagctagaagaaggaaatctttctgcagtttcatgttaaatatattatgtagcaaacagtctttgtgattcctgccatgtgcaggcaagtgtccctgtaggaaccgtggttacaaaaacagggacgtaaagtgagtttttggtgggagatgatgcgtaaaccatctgaattctacagggacacctatagtgacaggagtggaagcagctcccctgactctgaaatcaccgaactgaagtttccatcaataaatcatgactgatcttgtagcgtaagtggtactttaaagttttagtttttaaaaacatggtgataacacactgcgattgcaagaatatcatggaagtttagggctgaaaatttttatctgccaggaatgaaagtggtgaggtcttgaatataatccagaggttgagagagaaaagaaagtagtgaggtcattgtgggtatcaaatgggcagcccttcctccaagttgcagtgcacctcccagtcctgccctggggatgacagcttggggagcatggtcactgggcagttgtctcaatactgattactacattctggtgccagtctgaccagttctggggcggggaaggggagggtctgaattcttagaccctattgtttgatgtagctgtaaattttggagatcttgaaggaagggacagatacaacaatgtggcacttgtcatttctgcagagcctcaggttttcatcaggaagtactttaaaactgacactgcttagagaacttttttttgttgattgctgcttattctggaattccttcaaagttggaacaattgccaaatagacgtcgaatgtttgtctattaagtgacagggtttgtaggttcataaagtgcaataactgtgggcactgccacgaaatgtaaatgtcctttgagataactgtgtggactgtgttggcagaagtacgcattctgctggtgaggtatcaaatgagggagtgtcagtcatctggggtctggaataagaaccaggggtatgggtgtgtggttccaccgctcctgccctaaggcctgggcagggggacctccctgaatcctgcacaccgtgtgttcatcaccagtgggcctctggtgctgggtcagtgccggtctgacctgctgatcccagctgtttcccctcctgccttggttggttgaccccctgtcctggcatagcctaagtaggtggtgggtaggcatgagaagttagtatcaggaggagggcctgtgtgctaggtaagcgtttaacacggatggactcattaatcccctgaccagggagtttgctataggctgtttcacagtcttaaggagctgatacaacaagaactgttaccagtgaaggaggtagatatttggtcagttacatggaatttctgactgcctcgcaagtggagaattgcccgttagtgacactgttacgaggtgctgtggagaaagaatgcttgcattgggtggttgtagaagtcgatgtgtgaggtcttgaaaaggtctgattctgtaggaattataaatttagcgtctaattattcccagtaggctccttctactgctctgccatgaaaaacaggcttagtttcccatggcagctgactagaaattctaacttttctactttaatgtacatcatataattcccacttttttttttcttttaaacagggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcag

SEQ ID NO: 36215 - DNA, 13319 bp, Homo sapiens
ctgcgctctccgcgttcttccagcgctgtctttttagtaccacatgcgcaggcaggtgatggcggcgctggtcgtatccggggcagcggagcagggcggccgagacggccctggcagaggtgggtgctggaacgctgcgccctccagacctcgcatctcggggcggggcccccaagttagggacaggaccaaccccctttaacggcggcggcgcctttctccgctagatcccgctgttagtcgccttgggccgctgtcaccagctcggggtcgctgtcagccggagcccaggggtaccagtcttttgcagctttagggcacgaccgagagcagcccttaatcctccaatcggaaactacagccttgtcttggcgggtagacggataaaatggactcgacggggagggaaagggccaggccagatgcagcgggcattttacgagtgcgccctcagggaatgctttcagggaagaggcaaaaggtttcattcgccaggcattaactgagcgcccaccgaatgccaggcctgcgctgggtgcaggtactagaatcagagatctcagtctactgggggaatgttaatgtaaacatatcatagccacgtgataaaggaggaggtgcctactggtccctgggacacattgaagggctaatgttagcagttccttacacgccagcgaccactagggacctgtcagaggaggatctgtaatgggcctaggaagcctaggctgattgtccaaggcttttgaaacaactggccaaaaaccatagcagtggtaacgttcaaatctgatctcagggccccagcctccgctggaccatccccaccgccgcccacacagtgggtgaagcctcatgtctgggcgggtccctcctatcatagtgtggggccctagcagaagttgtggcacatagcacagtctcaatacatattcgttgaataagttaatttcttgccttttcatatcctcagactctgtggctcctgaagagataacggggttgaactaagcttaattgtcggggcagggcatagtggcttacacctttagtctgagcactttgggaggctaaggaggattgtgtgagcccaggaattccacaccagtctgggaaacatagggggaccctgtatgcacaaaaaaataaaaaatagccgtgcgtggccgggcacggtggcttacacctgtaatcccagcactctgggaggctgaggcgggcggattacctgaggtcaggagtttgagaccagcctggccaacatggtggaaaccctgtctctactaaaaatacaaaaattagccgcgtgtggtagcacacgcctgtaatcccagctactcgggaggctgaggcaggagaattgcttgagtccgagaggctgaggttgcagtgagccgagattgcaccactgcactccagcctggccaacagacagagtgagactctgtctcaaaaaaaaaaaaaaaaaaaaaaattagccctgcgtcttggcacatgcctgtggtcctagctactggggaggctgaggtgggaggattatcgtttgagcccaggacgtcgaggccgcagtggaccatgattgcacccctgcactccagcctgggtgatggagtgagaccctgccttaaaaaataataagatgaattgtttattcagcttattattttttatcctacttaggagtaggatgagaccagagtaagagttgcagtttgctaagggctacggtttcccctttactccaggagttgtaattatgtgtatacctgtcttttcccccactagactgctggtctctaagggacaaggtcacttttctgtccttactggtacgtccaccaccctgactcaagtgttctttccatccttcctggtttaagagtaaggaggagcaatgggacagctaagtcagttaaatgtatgatgtttatttcccttttaaatgaggagaggtaagcgtgaaagaacgaacagtgtggccacagtcagtggggttctgagtcaggagggcagtcttttaagttagtattcatgtttaacggtttgcttatagacctcatatctagaagctcaaaacttcaaggtgtcctcaggaggtgggagaggggggacattctcccaggctggctgggctggctagactgactcttaggttttccgcagggctgttctctatcagggagcagtatatggactcagactcattctttgccccttagcccctggtgtcacctctgttctcctgaggaagaaggtgagccatattctattcatgggctcaagtcttcgattcccagtgatttcacaacatggaaattataccggttaccttctggcttaatgaattgtctctaccttcaggatgaattcagtgagaacgaaagctgggccaacccccttggtgtctggatctggcccttaaacttggtggagttaacagcttagctgggtcttgttaccaaactcaacttgggtcttcccatccacacaaagcaaaagccaaacactgacatggagatttgcagggagagaacaagcatttattgtaaggcaccaagcagggagactgggcagctaaagcttaagacctaaacttcctgatggcttacaagcaaagggtttttattttatttatttatttatttttgagatggtgtctcgctctgttgcccaggctggagtgcagcggcgtgatctcggctcactgcaagctccgcctcccgggttcaccccattctcctgccttagctgggactacaggtgcctgccaccaggcccggctaattttttgtatttttagtagagagtagtatttccccgtgttagccaggatggtctcgatctcctgatctcgtgatccgcccgcctcagcctcccaaagtgctgggattacaggcgtgagccactgcgcccggctgcagagggtttttaaaggctgggcttctggggatctttaaagtgaattaagggctggggaatttctggaactttcttacctattttctggcttcagtctgtctgaggtcttacatgacagcaattagttggcatttttcacctggtgggggggtgggtgtcctggtttctgaaaaacaacttagggatatatgtcaaggtgttatgtgtagtttctatagggaaccaggcatctcgtgactctgacttgggtgactgttgtttattatcttcttgtttagcaagttatttaattccctaattgctggttgtagggctagctaagatgcctgggatttttcttgagatgactcaaaatttttatttctatgcttgagcgggggcaccggcaggccctgaaaagggatccctattccatctcaatctggcttcagccaaagacagacaccaactcaggccttatatccattctaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaagggtgagcctgtgatcattgagctggggttggggtggagaggttgcctggcccagatgggacagtgtcccccttgcagccccttcctagccctccacctctcatgtctctgctcgtcttgcagtggccttgcaaatgccggaaggcctcctcctctttgcctgtaccattgtggatatcttggaaaggtgaggcttggggcactggagaggagggtgagccaggcttcccccaccccctatgctcattacccgggtgggtaaagccctggtggcgggcattttttccttctgaacctccaccttccccctttccctcccacaaccatacacacactcagggaaaacccaaaacaaatctcccagcttgctgagagccctgcttgtccctgcaaatcccccctcccctaaacatttgggacagagaaagaaatcaatcccagtgtcttcaaagctagacccagagcaggtggtaggacctggggaggaccctaagaattctccaagctgcccctgaaatgcgctgagtgatcagtgggaggtctgccggtcgggggcggtggggggcacctgttcctcgggcacatttggggaagtagggcaaggatgggtttggagtgggaggtgcctgggagaaggtattcagttcctctacatcctacccctgtcactctaagtttctgcaatacaatgagccatccttggtggggagggtgagagctcagccatctggaaccagcacaggaacaggggaggggaacgaagaaaggggaggtcatctcatgctgggaacctcccactcccctgctgccccatcgccctcccctgctcctccctccccctccccttctcccccatccccctcccctgctcccccatcccctgctgccccatccccctcccctgctgccaccctccctcccctgctcccccaaacctctcttctccccccttcccctcccctgctccccctctctcccctccccttccccctcccctgctccccctcccctcccctgctccccatccccctccccagtttccccatcccctcccctgctgccccattcccctcccctactcccccttccccctcccctgctcccccctcccctgctgccccctcccctcctcccccactcccctgctgccccatccccctcccctgctgctgccccatccccctcccctgctgctgccctccctcccctgctgccccatcttgttgccacagactcacttccctgctcccaccgtcttgccccttggggatgctctctggggctcaggccaatttgcatacattttaatctataaaaaattaagtgctgtggctgacttagacgcctgggctgcattctaaggaggtgaataatctgcttctgggcacagcctgatttggggaagggggtggaggagggggtgactagcaggagctcaactcttccactgccacacccccaggggaaggatggggggaccccagtcactgagccaggctccacgccccaagtgtgagtctctttcaaggaagagggggttctcctccattcctagggtgagttcaggggtacaaggtcttccccacccaccccctcccccagtgattcaggcctggcagcagttcccacggcagtgttctggccagagcctcctcttcctgatgcaggaggcgtgtaggtggtgccatgtgctatgggggagctgtgcctgggtccccccatcctgggcaccaagggccctgcctgcggtggggaggtagtgggggtccggacgagagggccctgcctgtggtggggaggtagtgggggtccgggtgagggggccctgcctgtggtggggagggggtgggggccctgcctgtggtggggagggagtgggggtcccggcaagagggaggctgtgtgtattcatacagccacgcccatgcccaccacagcactcagcgcgggagtgaggacctttgggtgtgtgtgcgtgctcacggctctgggtgggtgagtcagggcatggggcgtctgtgttttgaccccacgtgtgccggagtgagggttggggtccctcctgcagcctgagcctgggtagaggaatgagggtcctcacgcagcaacagttccaggagcggctgccaggctggggcaggcggcagctgtgcccctcctaatctttgttggcagaagtggcagctgccatcccgaggaactgggagaggtagggagagaggagctgggccctgagacaccctcccagggttgggtctctcctacctcagtccctgtgtccctgtcccaccgttccccgcccctgtgcccgcaggttcacggaggccgaagtgatggtgatgggtgacgtgacctacggggcttgctgtgtggatgacttcacagcgagggccctgggagctgacttcttggtgcactacggccacagttgcctgagtatggtggggccaggacacctggacggtggcggggctggcagggaggcaggctgcacattcatcttccccatggcagtgccttcttgtcctgcttggagacacaaggtccctcctggtttctggggtggcctctgccttcccgctctgcaggtagatctttcctttggatttggttgccttggcaacggtgctctgtcccagatgcaggtgtttgaaaggctgttggttgtagagcaggctgggccccggccgggtgacagagaagtctgattgagaaggagcttctaggggatctgtgacccccctcttctcctaccctgtccttttacccccaggctgaagccactgcgcctggctgctcagagacctgagcctggccgggccctctgctgctcctgccttcccaaacagcccctgaactcctccctcccacagttcccatggacacctcggcccaagacttccgggtgctgtacgtctttgtggacatccggatagacactacacacctcctggactctctccgcctcacctttcccccagccactgcccttgccctggtcagcaccattcagtttgtgtcgaccttgcaggtgggtggaacgaggatcctcggcctcctgcagggtggacagcggccactctccagctgttgcgggatccccaggtgctccaggctgtttctcagccctggctctcctgccccagccgctggcttcacttccctcgtcattcctacaggcagccgcccaggagctgaaagccgagtatcgtgtgagtgtcccacagtgcaagcccctgtcccctggagagatcctgggctgcacatccccccgactgtccaaagaggtggaggccgttgtgtaagttaaaaatgggggccaagtaagtcctagagacatgcgtgtaccctgggagggagcctgaggttcatcatccaggaaagaaaccaaatctaatgctccttacctgtgagcccgaggtcacactgcaaggtagggaccaaacagggagcagacctcaggtttactgtcgctttctccactgcccagtccatcatccagaaggctgtgcagggtgggggcaggaatcagagggcctgatgggggttgagggtgggctggaaatggtgggaatataattggagaagatggatgggcacgcccaggctgcagccccattaatttaccatccggacagctaacaagcagaagcagcgtgtctcctgccgcctaattattttaggtaatggaaatgcttaatgttgtgtgaatgcagccagcctgagagccgacggctcccccgactgggactagggaagggagtcccgttccgtactaatggcagggagggagggtcgctccctgactcagtcccacctctggggctttggaggctgtttccacaggcctgacacccctgtccctagacaggcccacatcagggccttccccagcccagatctggcagccctgctccccgagcagcactgagtggcattccccctgtgcccacgtcactcagtctctacccttggggtcttcaaagtgtatgttggagggagggacaccctgagtgttagccattcatcagaatgaagtgtggtctccaagagggagagaaggagctgccacaggcaggttatcttccacgctctgtaatcttcatgggctgggaagctactgtcagggacagcatgtctgggggcacacttggtacagcctgggttgagcctcagacacactgcttcctagctgtttaatactaggcgagtttcttaacatccctgagcctcagttgttaccttctgtaaaacaggtatactatacgtatctgggaggattaggagataggactgcgtgaactaattcacagcaggtacttagtctatgcctggtacacagaaggcacaagtccaataaacagtagctgttggccgggcacagtggctcacgcctgtaatctcaacactttgggaggccaaggcaggagaattgcatatgtccaggagtttgagaccagcttggggaatataatgaaaccctgttctctccaaaaaaaaaaaaaaaaaaaaaaaaaagaattagctgggtacagtgtccatgcctgtagtcccagctcctcaggaggcttaggtgagaggatcgcttgagcctgggaggttgaggctgcagcgagccatgaccgagtcactcaacctgggtgacagagtaagaccctgcctcaaaaaaacaaaatgaaaatccggtagcttttgttataactcagtaactggccccaagagctagtttgggcagaaagtagccattgtatgccctgcaacctcatgtacagcatagatcagaggtccccaacccctggtcccatgtcctgttaggaaacctgccgcacagtagaaggtgaggggtgggccagccagcgtgaccacctgagctccgcctcctgtcagatccgccgcggcattagattcttgtaggagctcaaaccctatcgtgacctgtacatgcgagggatctaggttgcatgatctttatgagatcctaatgcctgatgatctgaggtgagacagtttcatcctgaaaccatcccccaatcccacccgtgtcttccacaaaacctgttcccagtgccaaaaatattggttactgctggcgtagatgactccttgaacactactgtccacatctgtattgagcttgtgaaggagaatctgttccccaacttccaaatgaggatctctagaaccccaggtggcctcaccacggccggctgctccttcactcttcctcagaagcttggggtgggacggttcttagattctgcattatgtaaatagagggaccgtagagtcatccaattcaaactccttatttcacacgtgagaaaaccaaggctccaagaggtgaagtgaaggcttgtcccagtttacacagaggcacagcacagccagctgtgaactcagtcctctggacttttttttttttttgagacagagtcttgttctgtcgcccaggctggagtgcagaggtgcgatctcggctcactgcagcctctgcctcccgggttcaagtgattatcctgcttcagcctccccagtagctgggactacaggtgcccgccaccacgcccagctaagtttttgtatttttagtagagacagggtttcaccgtgttagccaggatggtcttgatctcctgacctcgtgatccacccgcctcggcctcccaaagtgttgggattacaggcatgagccactgcacctggcagccctgtggacttctttttttttttttttctttttgagacggagtctcactctgtcacccaggctggagtgcagtggcgcgatctcagctcactgcaagctacgcctcccgggttcacgccattctcctgcctcagcctcccgagtagctgggactacaggcgcccgtcaccacacccagctaagtttttgtatttttagtagagacggggtttcactgtgttagccaggatggtctcgatctcctgacctcatgatccgcccgcctcggtctcccaaagtgctgggattacaggcgtgagccaccgcgcccggccagccctgtggacttctaagccagcgagtgcctcttctgctgccctaaaccacacttagcctcctttccacccctgcaggtatcttggagatggccgcttccatctggagtctgtcatgattgccaaccccaatgtccccgcttaccggtatgggctgggccgggctgggctgaccagctggtgaggggtgagattccctgccactgaggtcctcaattggttgcatccccatttcctggccactaagccaccagccctaagggtctgaggcacttgggccctggatctgggcattagccccagggctgctgttgcctacccgtctcctggggtttacacggagatcttaaagccgcccactcttgtctgctccagctgtgggacaggtcttcctaatgacagtccccgctcttgcctctgttcttaattacctgcgtggggcctaaaggttcaggagcccacggggctgagtcaggagctgtgtgcataatactggtcctgacagtggctgccacagtgaccctgactgcttcttttccaggtatgacccatatagcaaagtcctatccagagaacactatgaccaccagcgcatgcaggctgctcgccaagaagccatagccactgcccgctcagctaagtcctggggccttattctgggcactttgggccgccagggcagtcctaagatcctggaggtcagtgggctcaggacagcctctggaggagggaagtgactgggaacacagctgggaaaaccagtaggccacaggttcagctttggctgcttgaccaggtgacccccaccctgcctccctctcccaacagcacctggaatctcgactccgagccttgggcctttcctttgtgaggctgctgctctctgagatcttccccagcaagcttagcctacttcctgaggtggatgtgtgagtatctgcctggctatgactggctaaagaagcttagaagctgggtcttgcccagctcgtcttgaaggctggagccaacaggaattgcttccatggtcatggaattttactgtttacagagacctccctgggagggctaactgggtcatacctgctttgggactttggggctcagaggcaatggcaacatcacatttgtccttgtgagatgagtttgagcggtggctgacacctgccctgtaccaggtactaaatgtggttctggggatactatcaccagtgagctgccctggaaagctcattgtcggcagaggaaacaggagaaaacacgcaacaatacagtattccaaacagcagtgggtcactgtctttactttaggattcataaagcctgttaatgaatgggtgtgctgggggcactgtcatgttcttcagcatgctgcctgggcgacgaggaggcccttcctagggtctgacctggcttcccttcccaggtgggtgcaggtggcatgtccacgtctctccattgactggggcacagccttccccaagccgctgctgacaccctatgaggtaacaccaagctctgggagagagtgggctttggacgtggttctcaaaggtgaggtctggagtggagtggggtgggtgggcagcacttcgttatgttcgtagattccggagtctgtctcgatttctccagcggagtcacttcctagctgtgtagccttaggcaaggccctgaaccacacagttcccttctgtggcaggggacagtgtgcccttcacaggccgtcgtgaggactgaattcagtaatccaggggcagaaaaacactggcagatgttattgtccctccctcccctcccctaggcggccgtggctctgagggacatttcctggcagcagccctacccgatggacttctacgctggcagctccttggggccctggacggtgaaccacggccaggaccgccgtccccacgccccgggccggcccgcgcgggggaaggtaggcgggggcttccaggagggaggagagaccgcgcctgggcactggccgccgccctgcgaccgcgacgggaaacgcacaggagcggagcggagggaaacgcagggtcgcaggagcgagaccctaaccaaagtctgcgacctcaggtgcaggaggggtccgcgcgtcccccttcggccgtggcttgcgaggactgcagctgcagggacgagaaggtggcgccgctggctccttgacgcgctcccgggcctcaggtatcagcccccgctctgggtgcgccccgccttttgccgttgtcatgggaacgccttggcgctccgaggcccgccctcggggcggtgctgacgttcggttccgccccgtgcattgtgcttccgctcggggaaagaccgcttccggtgcttccgtcgctccttgccgggcataatggccgcgcagcgacccctgcgggtcctgtgcctggcgggcttccggcagagcgagcggggcttccgtgagaagaccggggcgctgaggaaggcgctgcggggtcgcgccgagctcgtgtgcctcagcggcccgcacccggtccccgaccccccgggccccgagggcgccagatcagacttcggtgagacaagccccgctccggaaacgcactcagtttcctccatcttgtttcgtccccctcgacacccttcagcatcccccaccctgcgtccacccgcattcctcccacccagtccacacccttcatttctcgcgacccataccctctttgctcaaactgcagcctgtcctcccaggcttccgccttcaccgtcttcctccgctgtctcctgttcaggccaatccactcatttcccccctctcatttcccccagacttttgcctcgattccctttttctctctgtcatctcgaaccctcctgccctttctcatttctttccttcctggagcctcccatgccctaatcccatcctttttcctcatatcgctgtagggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcacccactctggtggccacttcattccagcagctgcaccccagcgtcaggcctacctcaagttcttggaccagtttgcagagtgaaagatcaagaaatgtctctgctcctacatccagctcctctaggggcagcctccgtcatccatgccctcccaggaccctccactcactgctgtgagtgcgcctcaccagaaccagttaagagacaactatcaattcttgagacccaaattataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttggattttg

SEQ ID NO: 36216 - DNA, 15527 bp, Homo sapiens
ctataaaggatcacgcgccccagtcgacgctgagctcctctgctactcagagttgcaacctcagcctcgctatggctcccagcagcccccggcccgcgctgcccgcactcctggtcctgctcggggctctgttcccaggtgagtcggggtggggattgccgtcgggccagttctccgaagccccgggaggaccggctcccgggtcaggtcatgcatgcttaggtagctgtttatgggaaggaggggctagagacagcgattgaaaggcaacagccagtaggttcgaatccagaccctgcatacctccacgtgtggccttgggctatagattgcagctttaaaaaagggtagggggttggagatggaggggaggggcgggcctcgttttgttgcccaggccggtcttgaactccgggggtctagccttacctcctgcctcagcctcccgagtagctgggatgagaggtgtgaaccaccgccttgcttggctagattgcgtctcttacagtttctcagctgtaaaacgggaaacgttatagcggccacctggcagggtatcttggcccagcgcagcacctggccccaggactcgatcatgatggtttgggaacttggctctgtgccaacccaacaaggcttaagggacccccacccccctcaagatgtatattctgttcctcatcctctctgcccctggggaagtccagggctgcttctacttgggggaattccagagctgacttatccgtggcccaaagctgagaagtgggacgccccagcacaccctcccccagctccagcccagctagggaagagggaaggggtcagagggtctttcatggtggtgtaagtttggggaaccaggagggtgggagattgacagcttggttaacagctcaacaaagcctgagatccaggccagcacggtagttcatgccagtaatcccaacactttaggagccccaggcgggcgaatcacttaaggtcaggagtttgagaccagcctggccaacatggcaacatcccgtctctactaaaaatacaaaaattagctggcatggtggtgggcgcctgtgatcccagctgctcgggaggctgagggaggaaaatcccttaagcccacgaggctgaggttgcagtgaaccaagattgtgccactgcactccagcctgggagacatagcgagattctgtctcaaaaaacaaagcgttctgatccggactcagacccagatcgcactgctttctagctgagtaaccatttctctctatgaaatgggaatggtcccagaatctcccttggagaatgtatggagccagtgtcctcacacccccatccaagatagaacaaatctgagacaggaatctttgagtgaggcagtgctgggctcagacattttttcccaccttcggaggcagcagaatctgagggacctgatccaaataagccccttctttctttcttttcttttcttttttttttttttttttttttgagacggagtctcactctgtcgcccaggctggagtgcagtggcgtgatctcggctcactgcaacctctgcctcccaggttcaaacgattctcctgcctcagcctccctgagtagctgggactacaggcatgtgccatcacacccggctaatcactgtgttagccaggatggtctcgatttcctgacctcatgatctgcccaccctgcctcccaaagtgctgggattacatgcgtgagccacagtgcccaccccgtaagccccttctttcttacctgcaaggtagccagttgctacccatcctgtgctgagttacttgtattagcaagggatggggtggctatactcacccaccttacagatggggaaattgaggcccaaagagggggaaactacgtgtctcagggagtgaggagccagtctgattcctggagggctgactgtctccacctgacttcttaggagggaggagggcaccaacttcacattaaaatctggttggacacagtggctcacacctgtaatcctggcattttgggaggcttaggcgggaggatcacttgaggccaggagtttgagaccagccttagcaacatagtgagaccccatctctacaaaaatgtttttcagggccaggcgcggtggctcacacctataatcccagcactttgggaggctgaggcgggcggattacctgaggtcaggagtttgagaccagcctgaccaacatggagaaaccccgtctctactaaaagtacaaaattacccgggcgtggtggcgcatgcctgtaatcccagctactcgggaggctgaggcaggagaatcgcttgaacctgggaggcggaggttgcggtgaactgagatcgtgccattgcactccagcctgggcaacaagagctaaactccgtctcaaaaaaaaaaaaatgtttttcaaatattagccgggtatggtggtgtcctgtagtcccagctacttgggaggctgagatgggaggatcacttgagcccaggagttcaaggttacagtgagctatgattgtgccactgtattccagcctgggtaacagagggagacccgtttaaaaaaaaaaaagtgatggctaaagtccttccatggctccctattgccctcagtataaagaacacatgtggctgggcgtggtggttcacgcctgtaatcccagcactttgggaggctgaggcgggcggatcacttgaggccaggagtttgagagcaggctggccgacgtggcgaaaccccgtctctattaaaaatacaaaaattagctgggcgtggtggtgcttgcctgtaatcccagatactctggaggctgaggcaggagaatcacttgaacccgggaggcaaaggttgcagtgagctgagattgcgccactgcactccagtctgagtgacaaagcgagactccatctcaaaaaaaaaaaaaataaaagaacacatctttagcatggccttcagtgctcacgggatcttcctgaattaatctccccctcttcatccttgctcactcagctccagccaccctgccccgggacatctgtacttgcctggaacttatttcccttttctccggacagccagccctttctcgtcatttagatctctgctgaaacattaccctgtcaccaaagcactgtctattctatcaccctgttttgtttttgtcaaagctcatattaacatcagttattaattatcttgtttgctcataatttttttttttttttttttggagacagagtctcgttctgttgctcaggctggagtgcagtggcacaatcttggctcactgtaacctccacctcccaggttcaagtgattcttgtgcctcagcctcccaaatagctaggactacaggcacgtcccaccatgcccagctaatttttgtatttttagtggagacggggctttgtcatgttggccaggctgatctcaaattcctgacctcaagtgatctgcccgccttggcctcccaaagtgctgggattacaggcgtgagccaccacacccggcctgctcatgaattttctctttaacttccacatcgaaggcaaagtattgtcttgttaaggctgtgcctccagcacccagcacaggctgggcgcacattcccttgatgaacctgatttgtaatgcctgtcgcctcttccctcgtttcttctaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactgtgagtaactgagcccggagggctggactaggcagacccggtgggagagacgtgcaggggcacctgcagaggcctgggggaatctttgccacttgctcgtagggtcaaggaggggctccttgcagggcaggtggggacatccttggaaagtccctttgtgaatttctttgggtacaattaaagtatttacaggctgggtgcggtggctcatgcctgtaatcccagcactttgagaggctgaggctggcggatcacctgagatcaggagtttaagtttcgccaacatggcgaaaccctgtctctgctgaaaatacaaaaatcagccgggcatggtgtcaagcgcctgtaatcccagctacttggaaggctgaggcaggagaacgcttgaacctgagaggcagagattgcagtgagccgcgatcgtgccagtgcactccagtctggataacagagcaagattccatctcaagaaaaaaaaaatgccatctctctatgcctcactctttgaacatatgacacggtcctgcttcagacactttaataaaagatgcaaattaagccaagtgtggtggcttgtacctataatcccaactactccagaggctgaggcagaaggatggtttgagcccaggagtttgagaccagcctgggcaacagagtgagaccctgtttctttcttttttttttttttttttttgagacggagtctcactctgtcgcccaggctggagtgcagtggtgtgatctcggctcactgcaagctccgcctcccgggttcacgccattctcctgcctcagcctcccgagtagctgggactacaggcgcctgccaccatgcccggctcatttttttgtatttttagtagagacggggtttcactgtgttagccaggatggtctcaatctcctgacctagtggtccgcccgcctcggcctcccaaagtgctgggattacaggtgtaagccactgtgcccatccaagaccctgtttctaccggaaaaaaaaagtaaataatttagctgggcatcgtggtgtgcacctgtaatcccagctgctcctgaggctgtgatgggaggattgctttaacccaggggttcgaatcctaggagttcgaatccatcctaggcaacatagcaaaaccccatttttatttaaaaaaaaaaaaaaagatatgagttaaaactagccctgggatggcatttttcacatattggtaacaaacaaaagaattgatggccgggcgcagtggctcacgcctgtaatcccagcactttgggaggccgaggcgggcggatcacaaggtcaggagatcgagaccatcctggctaacatggtgaaaccccgtctctactaaaactacaaaaaattagccgggcatggtggcaggcgcctgtggtcccagctactcaggaggctgaggcaggagaatggcatgaacccgggaggcagagcttgcagtgagccaagatcgtgccactgcactccagcctgggcgacagagcaagactccatctcaaaaaaaaaaaaaaaaaaaagaattgataacagctgtgctgccaaggctattggaacgtaggaggtcctaggacagtgctgttgggagcataaataagcccaaccctgtggcgggaaattgggcatcagttctcaaaatgtcatgggctgggcacggtggctcacgcctgtaatcccagcactttgggaggctgagggaggcggatcacttgaggtcaggagttcgagaccagcctgaccaccatggagaaaccccgtctctattaaaaatacaaaaaaaactagccaggcatagtggcacatacctgtaatcccagctactcgggaggctgaggcaggagaatctcttgaaactgggaggcagaggttgcggtgagctgagattgcgccactgcactccagcttgggcaacaagagcaaaactccatctcaaaaaaaaaaaaaaaagaaataaaagaaggtatgttgaatatgagtggtatgccaccctcacattagggaagggcagtttcggggaggctgtatttatgtataaaatagccctaaaaggaagtgggagaaatgacaatattagctggctatgagaagagaggctgggaggctgtgggagagggcttgggtgtggagaattctttttgttttttcctttttttgagacagagtttcactcttgttgcccaggctggagtgcaatggcacgatctcagctcaccgcaaccttcacctcctgagtttaagtgattctccggcctcagcctcccgactagctgggattacaggcatgggccactacgcctggcaaattttgtatttttagtagagacagggtttctccatgttggtcaggctggtcttgaactctgacctcaggtgatccgcccgcctcggcctcccaaagtgctgggattacaacgtgagccactttgcctggctgagaattctttttttgttgttgtctttttgagatggagttttgctgtgtccccagcctggagtgcaatggtgtaatctcagctcactgcaacctctccctcccgggttcaagcaattctcctgcctcagcctcccaagtagctggaattacaggcgcccagcaccacgcccggctaatttttgtatttttagtagagacgggatttcatcatgttggccaggctggtcttgatctcctgaccttgtgatctgcccgcctcggcctcccaaagtgctgggattacaggcgtgagccactgcccccagccgagaatttctctttgcgtccttcctactttggggacttcgaatggtgggaaagagttatcaaggccaaaataaggaattcaaatgaaaacaaaacaaaatcaaagaagaaaaaacagaagagcactgggcaggctaggcacgtggctcatgcctataatcccagtgatttagaaggccgaagtagaaggatcgcttggaggccaggagttggacaccagcctgggcaacatagcaagaccccatatctacaaaaaataaaaaacctaaccaagcgtgctggcatactagtagtcccagctactcaggaggctgaggtgggaggatcacctgagcctgggaggtccaggctgtagtgagccgtgatgacaccactgcactccagcctgggtgacagagaaagaccctgtctctaaaaaataaaaactggccaagtagctttgggattagccttgggttccagtcccagcaaggcctttaatagcttgggacatgacttctgcatttactttgcaatcaggtgagacctcctctgatggggaaaatgacacggtgagtgacaaaggatgttctcctatcattgtgtcagggcaaggaagcctctgggtaaatgatcaaatgatcagctttgcttctgatttggagggtgggtgagcagatgctgaccttcccaggtgagggaagtccccgaacattcccagcagcttctggaaaccccagggaaacctctttgaaggtcttttctgcatctctgcctgataggtctttttttttttttttttttttttcttttttttgacacacagtcttgctctgtcgcccaggctggatcactgcaacctccatctcccgggttcaagcagttctcctgcctcatcctctccagtagctgggattacaggcacctggcaccacgcctggctaatttttgtatttttagtagagacagggtttcgccaagttggccaggctggtctcgaactctagacctctggtgatccacccgcctcagcctcccgaagtgctgggattacaggcttgagccaccacgcgcggctctgcctgatagctgagagcatagaactccaggtttgagacctggctctgccacatttctccctctatgactgtgggtgccccactttgccttagtttttacctctgtgaaatggagcagatggctggcacaggtagcaaaggagtaaaagttatgtgggagggtggtacctgagagagactctagcttggtcttgccccacccctggtgtaaacataaagaagcctccctggatggctcaatcttctccaaaaaggttagaggtgtaattcctagaggaggcgaccactagctgggctttgaaggatgtgtaggagttcataaggacaggcattctgggcaggaggaacagcctgggcaaaagttgggagcagggagaaatcttgatggaggcaggaggaggaggaggtaggttggtgtaggccaggtgcagtggctcacacctgtaatcccagtgctttgggaggccaaagcaagaggattgtttgagcccaggagttcgagaccagcctgggcaacatagcgagaccctgtctctaagaaaaaataaaaaaattagggtacagtggcatatgcttgtattctcaactactctggaggctcaagtgggaggatcacttgaacccaggaatttttttgtttttgtttttgtttttttgagatggagtctcactctgtggcccaggctggagtgcagtggtgccatcttggctcactgcagcctcctccacctcctgggttcaaccgattctgctgcctgagcctcccgagttgctgggattaaggtgcccaccatcatgcccagctaatttttttgtatttttagtagagatagggtttaccatgttagccaggctggtcttgaacgcctgaccgcaagagatcctcctgcctcagtttcccaaagtgctgggattataggtgtgagccactgagcctggtcaagcccaggaatttgaggttacagtcagctatgattgcaccactgcattccagcccaggtgacagagagagacactgcccctaaaaaaaaaaaaaaaattgattgatgggaggaagggtgaggttggcagagccttgaatgccaggtggaggagctgggactttccttcttggggtgatagggagtcatggagggtttctgagcaggccagggattagatagctgaaggctggatttactggaagccaatgagcagttggctatggtccttgtccacgcggcccatgttgtgggcagtgaccgtattcaagaagggaaggacagacaagtatttgaatacttcagtgaccaggatttggtaaaggactgcaggtcagggtcaagaagaggtgagagcaggacagacttcctccccgctgcaccaggcagctgagctgggtttcctctaggggctgaggtttgagggtacctcaagttctgcaagagtctataggaggtggtaagagagaagagctggaggtcagagttttcttgactatatatatatatatttttttgtttttgtttttaacagcttaacagctttctgttttatttttagagacagggtctcagggtctcactttgtcacccaggctggagtgcagtggtacaatcgtagctgactgcagcctcaaactcccaggctcaagaaatcctcctcccacccttagcctcctgagtagcagggactacaggtgtgagccagcaggaagcccagctggttttttttttttctttggtgttttttgtttgtttgtttgagaccggagtttcgctcttattgcccaggctgaagtgcaatggcaggatcttagctcaccacaacctccgacccccaggatcaagctattctcttgcctcagccacctgagtagctgggattacaggcatgcgacaccacacaaggctaattttgtatttttagtaaagacagggtttctccatgttggtcaggctggtctcgaactcccaacctcagatgatccacctgcctcggcctcccaaagtgctgagattacaggcatgagccaccgtgcccggcctttttttttttttttttttttttgagacagagtctcactctgtcgcccaggcaggagtgcagtggttcgatctgggctcactgcaagctccgcctcccgggttcactccatcctcctgccttagcctcctgagtagctgggactacaggcgcccaccaccacgcctggctaattttttgtatttttagtagagacggggtttcaccgtgttagccaggatggtcttgatctcctgacctcgtgatccgcccgccttggcctcccaaagtgctgggattacaggcgtgagccaccatgtctggcctggccaggctggtcttgaactcctgacttccggtgatccatctgttctggcctcccaaagtgctgggattacaggcataagccaccacgccatgccgaagcccagcttgtttttaatttttttttttttttttggagaaatgaggtcttgcaatgttgcccaagctagccttgaactcctggcctcaaatgaccccgccttggcatcccaaagtactgggattacagatgtgagccaccatgccccagccttgctttcttgagatacgatttagaataccataagattcatcccttttaagcacataattcaatgacttctgtacaaacaaccatgactacaatctaattttaaaatatttcaatcactctaaaaaagaaacctcctgcttatgtacagcgactctgtctacctcttaagtgaattctcctacctttaatagccctattttacagttcaggaaactgaggttcagagagacaaagtcacttacccacagcaaagaagcaaggctgggtatcaaatgcaggacccccccggtcctgatgctttttttttttttttttttttcctctgagagagactctcactctgtcactcagtctagagtacagtggcgcgatctcagttcactgcaatctctgcctcctgggctgaagtaatcctttcctcacaagtaaacctcagcctctcaagtagctgggactacaggcacacaacaccacgcctggctaatttttgtatttttaggtagagacggggtttcactatattggccaggctggtcttgaactcctgacctcaggtgatccgcctgcctcggccccccaaagtgttgggattacaggcgtgagccaccacacgcagcctttttgttattagactctgtcattactgacttttttttttttttaatagaaacagggtctttctttcccaggctaaagtacagtggcatgatcacagttcactatagccttaaactcctgggctcaagtgatcctcctgcctcagcctcccaagtagcagggactacaggtgtgcaccaccacacccagttaaccattcattcattcattcattcatttattttgagatggagtctcgctctgtcacctaggctggagtgcagtggcacgatctcagctcactgcaacctccacctcccaggttcaagagattctcctgcctcagcctcccgagtagctgagactacaggcgtgcaccaccatgccagactaatttttgtatttttaatagagacggggtttcactctgttggtcaggcttatctcgaactcctgacttcgtggatccaccctccttggcctcccaaagtgctgggattaaaggcgtgagccaccgcgccctgccaacctttttttaatttttcttagagatgggggtctccctatgttgcccaggcttgtcttgaactcctggcctcaagtgaccctcttgccttggcctcacaaagtgctaggattacagcctgagccatcacacctggccaacaggtttttttttttgttttgttttgttttttaaagaatgtctaggccaggctcatttactttcacctgtaatcccagcactttgggaggccggggtgggcagatcacttgaggtcaggaattcgagaccagcctgggcaacatgctgaaaccccgtttctactaaaaatacaaaaattagctgggtgtggtgacacgtgcctgtaatcccagctactcaggaggttgaggcaggagaattgcttgaacccaggaggcagaggttgcagtgagccaagatcatgccatcaccctccagcctgggcgacagaaggagactcagtctaaaaacttaattaattaattaattaaaaataaaaatacaaaaattaacctggtgtggtggtgtgtgcctgtaatctaagctactcaggaggctgaggcaggagaatcccctgaatcccagaggcagaggttgcagtgagccaagatcgagccactgtttgcccagtctagtgcactgggctgctgaatttatttgaccagacacctagcaatagactttgaagttcttttccacttttcactctaagatgctgctgtcatgaataaggaatattttgatccccttcacaaacactcggggccctcttaccagttttcactgaagatcttgacattcctatctgcttaggtgtctgggcgtgtttgggggagatactgaagaggtagggctcccaggcaggtgcagttcgtctgttaggcaggcagcaaggtccacttcaccagacacccccacctctgttttcctgcagggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttggtgaggattgaagaagccagcagggagaaggtgggggtggggtatcctgcaatgcggtgcctgtggccacaggatcttttgagatgggtgtggccccggctaaggggtgcatgtgttctaggcgtatgtgacctaggctgctgagtggccctggaagaggatctcgcaggagggggaatgaaatgccccagagaagggcttcgggacgtccatccctgtctgctcacacctttcttctctccctagtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagtaagaaggggcaggggcggagtggggcttcttgggggtgtgacctgaacccggggcggggctcactgtgtgcctattccaggctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtgtgagtggggctgctggtcaatggcccctatcccccaaggcccaatctccctgaaggtcccataaggtcttgcctccaagtcctgcccccacccacctccatgtcatctcatcgtgtttttccagatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaaggtgaccgtgaatgtgctctgtgagtgagccggcgggcagagctgggtgggggcaggggccatggacctaatgcaatcctcaccgcctgttgtatcctccccacagccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttccagagacggggtctcgcaacattgcccagacttcctttgtgttagttaataaagctttctcaactgcc

SEQ ID NO: 36217 - DNA, 51040 bp, Homo sapiens
gagagaagcgagatttattcctacgtaccgggccgtgctgcttatggcggcgctggagagggggcgctgagctgttggggtgagtacgacctcagggtccaactgggggtagcagaaacccaggggaagggctgagaataagaccaaggctaacgagaagccttctgagtcaaggtgggcactcgtagagctctaggtggggaagaatgcaccccgattccctgccctgggctttttcatacgtctcccgttcaactgcctgggcctcatgtcaggtcgcagagctgaaacgaggagttgaggccagccggctgcgcgtggtggtagtggtggtggtgactaaagtggggggagggagcgaaaatggaggctccgacagcagccaagatggaggcagagggtgcggggctcgggcgcggaggctgctgggatctgtagtctggctgcttccccatctgcggcttgtctggggaaacgggaactacatgtcccggcgggcggggcgagggggtggtggcgcggtcctttgtgtgaggttggaagagcctgagaccgagaagaggggcctactttgactctggaccctgtagtttcctggccgttacctgcttgggaatctgactaccagtaccagagcgcagtgcggcagtggcgccttctttgtgtatagactgagaccctgctccatctagatatcttaggggaagtgtttaaagacacctttccccagccacatctggcacagtagtgtggcggaattgacatcgttactccagtcacctagagcagggtctcagcacccaaccttcccctcattgtctccccttcggcgtcttgagaaagggaaccagtccctaatcttttaggcacgtggctcccacccctctatcttggggaatgggcgtgcgccctgaaagctcagtagtgtcctcccttccacctcctgtagttctcatggtgccagcgcctggcccacccacattgtgcaatgaacggcctggcttcgtcattctatgtagaatgttttagagttcccccgtcggagacagcttcaaatttttgccatgctattttatcaatacgaaatcttagtgccaaggttcttttgctttaaggttttcccttagaaacacccagatggcggccgtcttgcttaactcacaggtgaagcagagaacgctccctgaaacaggcttgaatctgcaaagaatatctgaacgttgttgggcaagttaattttcgtgttttgcaccttaaatgagtaaaagaatatggcgctctttaaacagttgggagacagggcggagagggagaatgctcaaaggcactgtggtagttaaatctttttgagaggcttaaattttcatcaggctggtatgaactggcagttctcagccactgctactaacctacttttttagaatgtaggtttcaaattatagcccacagatataagctactctatactaaaatgctgagtaattttcattttgagtaactaaaggcaaacattcttgatattgcattgaggagcactataatacataccttggttttcttttggtactaaccaataatggatatccttggtgtgggtaaggaggggctttatatacttcagtagggatatacctgagtcataaaacttagataaatatttggccttctttttgtttcgttttagccctgggactaaaataaaagagaaggtaatagtttggttttgcagctgttctggatgtttaccatcgagatgattatttatagcagctgagttgaaaactaaagtatttgaggcacagaagataggttttctttttttgtaagtactgacttaagtgtgacctttagcgagtgtgggtgaaaatctggtaaagtcctagcaaatcaaaattgaaagcgtgaaagctgacgtgcagtctggctttaccctctacccttattttcccttctccccacctgaagacacatcgtgtagggccatcgatttttgttttaaacaaacaaaatgctaaaatatcaaattatgctggagcattcataacatgaaatttagtgttccagtgtttttcattgtacagttcagtggcactaagtctattgaaactgttgtgagagccatactttcgacaaggtagttaaaacatggaaattttggaacgatgttcttttggacagatttttgaggagttgaatttcaggactgtattgcaaaatgagataaaaatcttgatcttgttaagtaaacacaaagaattgatgtgccttcttcttagctttgtccttgcagaaaacagaagaggaagcactttgagatctattttgtaagctttaatagctagactgttgtaagtggtgaaactactatggtgagagtgacttgctgttaaatcccttctgcccagtcaggattttaaaaagtcctttgttttgatattagaatgttttccacttgcatgtgtgggtacctagttaaaaacaacacaaaactttttaatattttaatgtccttttatgctgaggtaaaacagtgtgtggctgaaaattatcagtttcccctatgttgcacatgtaagctatccgttgatttgcagctacagccggtacataaccagttatttgcacttctttttctccaatttattaacaacaagcttctatgctagatactgcctacttttattagtgaaaatctttgctcaagacccttacatttacttcctgttgctaattggcacaatagtgcttttttagacccctgctcagtttatacctactctgtggaacatggtagccgccagccacgtgtggctgttgtgcacttgaagtgtgactagtttgaattgaaatgtgctgtgattgtataataacattggatttcaaggaatgtaacagtgtcaatttttttacattgattgcctgtagagaataacattttggatataattggttaaataagacgtttaattaaaattccttctgtttcttttgactgtaatatggttactagaattataattacactgtatttctgttggaaactgctggtctgtggtgttttctgatgtgtctagaatgtttcttcagcatcttcccacactgccatttgtcctgcttaaaactattaggtttctgggtgtatatataagcagttaagtgatagataattttaaatatctcagtagctgtttagataattaatccagcacagttgttactacacagatacaaaaagatagttgtgtcagtttgattttttatttttactcaacagatgacttaggttggttaattatctagagtttatcgtttaccttagatcctaaagtaaaaatgaattaagacctattaagcacttcagttataaaatgtggtgctcaatgaaatgtcaggcaatagagaaacttttcagtcctatgctacctatttgggtctttgttttttcctgcctaaaagaagatactgcctaaaggaagtgggttaggtgagcagacttttgtagactggcttagcctttcattaacttttcccgaagtgagtgctgcacatactttcaaaataataaactaggtagtgtgatacattttagatggattacttaccacataaatgtgttagtttaacctcttcatttagtgcccactatgtcatggcttatgctaggcctttgaggtaaaacagccgaggaagacatgaaataaaacaggtggtggccaggtgcagtggctcacgcctgtaatcccagcactttggggggctgaggcaggtgggtcacttgaggtcaggagttcgagaccagcctgaccaacatggtgaaaccccatctgtgctaaaaatacaaaaattagccagccaggcctggtggtacacgcctgtagtcccagctactggggaggctgaggcaggagaatcgcttgaacccgggaggtggagattgcagtgattaagtaataatactatttccatgctgagcaaagggaaaaggagttgattacttagcacacagtatgattctcagatacacatttaaattgttccctagtgtttttattggtaccctatggtgggtttgtgggggcgattgttttgagtcagcgtcttactctgtcgcccaggcaagagtgcagtggcacagtcatagctcactgcagcctcaaactcctggattcaagtgatcctcctgcctcagcttcccgagtagctgggactacaggtgcatgccaccacacccagtgaatttattttttatttctaaaattttttgtagagacagcatctcaccatgttgcccaggctggtctcagacaatcctcccaccttggcctgccacagtgctggggattacaagcgagagccaccaccccagcccaatacccagtgtttcatgcaacttaagtttcaagcttttagggggatggaggagatgcacttgtgttcctagggttaaggcaaaagaggtggttagtagcaccaattaatgttaatccgggcatgagtggatagctatttatattaaactgcctgaccaatacctttaagttcttcagtaagtgttaatttaattgaaaaacatttagttaactatagaagctgtgaagatgttaattcggccagtaaattattcatgactgttggtgggttcgtttgagctttaatagctcctaatagacctcattagtgcctaagaatggccctgcagtactccagagtttcagttccagaaatctctttttttgtgttactgaatcttggacttgacagttcttaatgtgatacgacaacctggaatgggttaatccagttcaagtgtttcaagataacttgttttctccatgttgagttctttgggttcattaatacacctaaagcattaagataaaaccaatatacacagtctgtattttttaaagaagagattatttcttgattggataattaaaactatataattaaaggtggtataactgtttacacttgaattgtggcataactgtttacacttgaattgtggcgtccttttgcttattaaggattaactacctttttcctttggttgtatatggcagcactggattaggtgcgaaaggaggctgtgataaagaaatttgagtttacctctcagaaatttgaaatagaattggaggaacaagatacataaaaacatgaagtaaacaaagtacagaaattgcttggtatcacttgctgcaaattgcttggtgcaggcagtggatgttactgccccattcattagtaggaattaatgaatgagtctgctggaatggtcaagaaaggcttttttgtcaccttgaagatcacaacatagtatttttttgtgggaagacccatataagcaaaggtggctagaattcaggaatctcccaagagttgtgtttaaggattaggcgaggtaatggacttctggtagaactggaacacagtagagagtaaggatggaaggtagaatagagacacctggaatagtagttcttaatcctggctggaagtcagaaacacttggagcaggggttggggggagataacaaggcctggcacctaacctagtgtagttaaatttagaatctttgtacgggactcaggctttgattttgttggtttttgtttgtttgtttgtttaaggttgctgggggtgggtggatagccaggattaaaaacttcccatctagaatggtggaaaaataactgaagatgtttgacaggggagatgagaaatgaaattggagagtttttgttttgttttgttttttgagacaaggttctgatctgtctcccaggctgtagtgctgtgtcactatcttgttctctgcagccttgacttcccagtcctaagtagctgaggctccaggcgtataccaccatgcctggctaattttttgtatttttagtagagatggggtttctccacgttgcccaggctggtctggagctcctgggctcaagcagacctcctgccaaggcctcccaaagtgctgggattacaggcgtgagccaactcacctggccaaaattcaagtttttgatagtctggtggtggtatgtgacagaaaatggaaagtgtgcacactggaagttggcggatatattagacacctgagctaaaatatgtcacttagtaggataagagatgaatacaaaagatatagcgagggaaatactaacacaacttgcaacattgggtatggtgatggagaggggaagaatcaagatagttaaagaagtggccctacctcaaaccagttgtattactctgagtggaggctgggcataggtttgtttttgtttttttttttttaaagcttcccaagtatttgagcaccattaccctgagacatatatctagtctgggtaataggagaatgatctaaataaagttgaaagatcagacaagtgtatgtaacatttgatatttgaaggaacatgggatgttagagaatagaaaatggccagatcagctgttattgagtttttattttacatgtgaggaaagtgaaacttagagagattaaataacttgttcatggtatttactagtaccagtgattgcgattaggctcttctggtctgagctatttaatcagctctgacctctcacctgataatcattcttctgatgttttcaaatatccatttctcagcacgtacacctttttcttatctctgtagaaataattttcgttaacaccattttgtaactttggagtcagtgcaaaattgttgtttattttatagctaatataaagcagaaatgtgatttttactgataaataaattttatttctcttctatagacatttctcatctatttactgcagcagtgcaaatgagatttctgtttgcttactaagtcatctcctttaggatttcaagacttaataccactttcatcaaaaactaaggcactgtttcctgttacatcacgttgaaatgcttcataatcgggctccgctacacctgtcacactacatatcctatttcacttcagcccagctctctgttctagccaggctagcctgttgattttcctctgaaacaacaagccacacatgttgccacaggcattcatgcagaagacttcacttgatgctgggcttagaaaatcatagaatgcatggtcgctgctctgaagaaagaatttagtggcatattctcgcttgacttatgtgctgtttcatgcctagaatactcagctattttctttctcctagaattctgcctgattttccaggttcacttcaaattccacttatttaaaagccttggttgctttgatggacatgcagttgtggataaacaataaataatatttctagatagtctgtgacataatagatacctagatactaattgagcaaaataatttttggcatttttgtcctatactctgttttttttttccatgtttacatcttgtcttttcagcaagattgtctatgctctcatggcagggacttcttttatgttttccacagagctagatccttataaaatacttgcactaaattaaacattatgccatgtaactgagcttatttgggggaagaggtcaataaagactatggaataatttgaggtcttgggtatgagataccaaaggaggtagttgctagtacttgagagattgctccaaataacatcagatgagcatgcttccaagtttcctgcattacttgcatgacccatgattctaagttaatgaaatgagtttgtccctcttctcacccactgtccctgattattttatgtatgttatacttaatgtcttcattttttacctttagtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgaggtaggtttgtaatttcctattaagaatcagttccataattctagatttcctgattatttggtcaaatataaaatctttatttgttcttttctaaaggtattcagaagacagtttttctattctcaactagtatgaaatatcaacactatctcttgttagataaggacagtatttatggtcaaacatttttcataccagattatattaatacatgctgatctctcgacttgctggtctcttagagaagctccgtctgtactatttagaagttaggatttcaaataagaatgtgcattgcagtctttctatgagggtctgtgaaactttggtgatatttgctactgacgtctgtttctttctctctactgtcttcaatgttagcttcttgaggaaagaaccttactttatatccatgcctacatttgcagtgcatatttgtgaacggtatacagtgcacatttgtaaatggttgacatgcctactgtattgttaggcattgctagtgctgaaatataacgaatgaataagatactaatggacttaatgatttagaacaatttgttacacaatatcacaatataggctaaaagatactaataaaatattaagaatataactgaagctgttcccttggaggtaaggaggagggtaaagaaagcctacagaaaagggatatttgaaggtgagtagtaccttgttaagaggtagaagagacattggtagaggtatagaggtaacagaattagcagattcagggctacgtgaaagcacatggtatatattaagttgttcattatgaacagagtagagaatataattttgcgggagagttatgaaagggaagtttgctggaggcttggcccaatgcatttgtctttattccgtaggagagccatcagatgtctataagcaagggcttaagggtttttcccccaaaagtaagatagctttattgcttcacattttaaagtaatattcagaagtgtacctttaaaagacaaatggtgacacttttgagggaaaggctgaggatgggaagacctgtcaaaagcagtggatcaagtataaggaagataaaagctaaggtgtaggtagagaaaaaggtaggtgctaggtgttctgatgatttagaagtgaggacttggggaccaattgaatctgaagataaatgtggagagaatggctttatcaaatccagttgtgcaaactagaaaccttcattgttcataggaatagggaagttagagtagtaacttactgatattaaaatatgttatggaaatctattgtgttcattagatagcaatctgaagttgaaggaaatacactagtatggaatattgaacagtggttaactttgagggtaggcttatgaagagcaattttcctttttaatctttagtttccagattttctaaagttagacataaaggaattcagaaaggagtcatcagtgtataggtaataaaaggaagaagcaccaatgaagagagcaaagacatagaagtcaggaaaaagcaccaacgataatttcaggaagtcaatggtaaacatttttttagatgctacagaggtcaaataaaatgaagaatgaaaataagtcattcagttacaaaagcttcactgctatttcaagaagcgcttaggactttatttccaatttattgaaggattatgtaatagtgtcagtgaccttgctgtgcactagaattattccttaacaactaaaaactatagtaaaattatctatgtctcataaacagacactgttatttaattttaaggtaattgtagcatttagtttttctatttgtttcttcttaccttagctgatttttaaaaaataattttagactaattgttgtggattctgttggattagatagggaagattaacacaaattgaaaccacaattttatgttctgaagcataaaagattagatttttttttttttcctctctgagacagagtcttgctctgtcgccaaggctggagtgcagtggggtgatcttggctcactgcagcctctgcctcccaggttcaggtgattcttctgcctcagtctcctgagtagctgaaattacaggcgcgcatcaccatgcctggcttatttttgtatttttagtagagacggggtttcaccgtgttggccagtctggttttgaattcctgaccttgtgatccacccgcctcggcctcccaaagtgctgggattacaggcatgagccaccgtgcctggcaagattagatattaaggctttcatttcattgacatgatttatagaaatagatttaacgaagtcctttttgtttagtgtaatctttgtattctgaatattagtttactacatgaacattttaatatataaatgcatccatagctgtctaaaaattacatgtttacatatgtacaaagaaaccacaattgggatgaagattattggcagtaaaacatggctgtggttgtacagttgtgaaatagttcagttaaagggggcacacagctaagaaaacagatttggtaatgcaatggaacccccagattttaaaggggggttttgtaaaatcagtaaaaatagtacgtaattaggaacaaatatatatagaagggtagaattagccataaaatggcaagaaagaataaggcttataaagcatttgtttgagatgtgaaaatagacctgaattgtttggtgaatgatttgatccaggttagtctaaaggtgacagacaagagaaaagcaaaactagaaaattcctgtcgcgctcctagttttttctgctgaatgcaataattttcatacttgaaacatagcaaagcaagagaaaactgaggccccagatgagtgagaaaataacaggattacttggcggttgctagggtgctagttgctaggtgtgtgatagtagtcaaatagagacctatgacaggaactgtaaatgtcctgatttttcagtcagatgtgggaactattgagcttacttttcatccctagcaaaaaccccagagccagtgaataaataacttggcagactagctcatgatagcataatggtcaatatggagaaatgttggatggatagcagttagtaagagactgattttagagaagtctccaggtgtatgctgccagatgctatcctcgccctgcttttttcagagacctaatgagtagttctgtgagtacctatgtgctacgtaagcacttattttaggctttttacgtgcagcaactcatttaaccatctcaacaactctgtgagacaggtgttaaggtaggagaatgaatgattaaaagataaactacaaagagtctgataatttaaaattagtcaccaaattggaatactagattaaccaacagaaggcattttaaaagcattaggttatagtttttttatttgggaacaaacgatccattacggaggaactgaaagaaaacctgatttcgctaatgtgatttgtgaagaaatgatggggatgtgttttagttttacaaagttataaaacttcagtctacagaatcaaggagtgtaatcactcagtactttatattggtcgggtacattaagaatagtagtgaaatgcactttaatgaataattacttagaacctatccagaagacagcaattagtgttaaaaatggttgtgttcagaaaattggaagaaacagtggaagtcaaggggaggtatgtctgagaatacagagtagttttctaaagatcttatggtgaaataggctaccttttccaaattgattgtcaatcagtagaagccaagcagaccagattaggggggaaaaacaacttagatgttgtaataaattacaaagcatagatttccaccccctctccccaaaggaacttggaaaccagttaggtgctcccactttacttttgaggaaaaaatcccagagatgttaaaagtacttgagagtcaggactgaaagccagtcttttgacttttatgttcttcagggaactttaatcaatttcttgagttacaaatgaagtttaaatttgacctgagatttgttccatttctgcttttattaaaggaggactaattttgtcaatgactttttcagtttaaaagtaaatatgtagaaaagggtagaaggtctaaactttatgaggctggagatatttgtctgttgtgttacctactatatgagtagaacctaaaataatgctgatgcattgtatgaacttaattgtggttgaatgaataaggcagtggttaagaatggagtcagaactggattctgttcccacatttgccatttttagcgctgtgcccttaagatggctaagtgttttctcatctgtgaacattagattttctggtctttaaatacatttgaaatcatactgtataaatatcttatgtctcatttcctattacagaataagcattttccacatattgtttccaatgaccacatagcattacataagttacaatgacgtcttgagctataaagtgtgttagactttatattatttccaggaatttgctacaaaaatatatttgttaaaatacttgtgtataaagcttttttcacatttcagatttccccaggagagcttttctgcaatgcagttattaagaaaaatatctccacattttgatacatgttgctaaattgcatttctaaaaggttgtaccaatttactaccataaaagtggtgtgtgtgttgttcttagctcactttttcattattttaaaatcttacgtctttgctagtttggtatatgaaagtattaatttgctttatctggattttttattgcaaaaattcaagtttttttttaatgtttaatgttttagcttttgtgtataaagtttaataattgatattcaagaatgatttatttgctcacttaatcagtaattcaacatatgagtgcctgctctgtgccaggcactgtttatctaaaatctagggatttagctttgaattgaaagttctgcccctcaagaagcttatattctggtaatttaattgtactgatttgccctatctactctggtgtatttacacttttcccccaggtttgagtataaaagcttgtgctttttgtataatcagatatcagtcccttgtgatttttttttaattgatttcaaatctagaaagttccgcccttgcaaagattttacaaatatactcatccatgggggtgtgtgtgtatgttttggggtttttgtttgtttgtttttgttgttttgtttttgtttttgttttgagacagggtctcactctgtcacccaggctggagtacggtgtcaggatcatggcttgacctcccaggctctggtgaacctcccaccccagcctcttgagtagctggaactataggcatccagctaattttggctaatttttgtatttttttgtagagacagggttttgccatgtgcctaggctggtctcaaattcctgggctcaggtgatctgccacctcggcctctcaaagtgctaggattacaaacgtgaaccactgagcctggctggtttttaaatattttttaagacattaaactcggttcatttgaatacatttttacatgctgttaggcaagcaactaaattgtggatttttttcccccctatttaaagaagaagtcaagtaacatttacctactgggtccttcctaccaccacctttgttagcatctttaattttttataaacaaggttctgttaaattatctacttccatttgtcctatactttcatgtaattgtttttgtgataacttccattttgcttgttttttgatggtgctgattaagaaatatttgcaatgccattaaaatatagtttagccaaattattaggaattctttgaaaagtattaacatgtcacatgtcacatcaacttatctaaagttgtttgagtggtgtgtttccctttggaaaaataaaataaaggcttcctccaaatggataaaggctagggaaagagagctctagtcagcaaagattctgggagaaggggaaggctttttcaactcttttggtatgtgtctagggatgagacggagactcgaacagtagagcccagattccaacattcttgttggggaacaacttagagtcttaaaatgctagctttgatgctttctaattctggttcagtctccctttgggtgagaaaaagaggatttctatctcctacctgcagtgatgtgtggcaggattggagacttgagaatggggatattttgcagctttaaggcatatatatttcagatcatatcattgtgttcttgtttaatagtaatcagaactatagtctaaacatgaggccaagtgcagtggctcacgcctgtaatcccatcactttgggaggccagggcgcagtgcaggggccggatcacttgaggtcaggagttccgagaacagcctggtcaacatggtgaaaccccgtctctactaaaaatacaaaatttggctgggtttggtggcgcacacctgtagtcccagctacttgggagactgaggcagagggatcacttgaacccaggaggcagaggttgcagtgagccaatatcgtaccactgcactccaggctgggtgacagcgagactccatctcaaaaataaattaattcagcctgggtgacagagcaagactgtgtctcaaaaataaattaattaattaaataaacaaacaaacatgaaagaagcacagcttgaaagtccctcagtgatctagaataatggttctcaagttaattttatactgcttgtcagttaaaaacatgtattttcgatatgtgtatatgtttacaaattgtgtaattataattctgtgtctgcattgtaaaacacagtggtacaaataggaaaaatgtgaagtgagggatattataaaaagtttacttgtgcagaaatgttctgttagaaatactatgttctggattgctggtttttaagtgtttaattttaaaaagctttataatatcatgaattagtatcagggaaatctacatttgtgtgttgtattgcaactaatttaagtccatgtcatagtcttgatcttaactgtttggcatacttaccatatctcgttagatggtttcttaatgtggaggttgaagaactagtactaggaatagaaatgtcagttcccttgctctttgcatgtgcttgccttatcttccatctgaggttcttctgcgggaatctttcaaccatttgtctatttgggcttttttgtttttctgggatggagtcttgctgtgttgcccaggctggagtgcagtagcacaatttcggctcactgcaacctccgcctcctgggttcaagcaattctcatgcctccccctcctgagtagctgggactacagacccatgccaccatgcctggctaaattttgtatttttggtagagacaggctttcaccatgttggccgtgcttgtcccaaactcctgacctcatgtccaccccggcctccctgtgctgggattacaggtgtgagccactgcatccggcctcatttgtcttatttgtgaaggtagcttagttacactagataactaaatttatatatctccttatcgggcatacggtaatacggtaagagcaaatgagtgaggacttcactgttggcctcttttggagttctccactctttcctcagaatacctgagtaatacatgatactcatagaccatctgacataccaactcggtgaaacctagactataaatacatagtaaatatttataaaagctcatttttatctctgggcagaaaaatagtcccagttattttcttctgcaccccattgggttatcagtgtgtactctagggagactagtgactaaaaatgataggttctatttaaagttgatcggcattgaaaagaaattggactgaatagtctcactccaacaaccatcaagagtctttgtggcattttcagaattgttgatgtcatcgtatgttttaatggctttaaaaaaaatacatttcaccttttatagtaatgttaattctatgtatttcctgtcaatagaaatctaatttatatttcgctaaacccaagctaaaaatatatattgactgtgaaatgtgcattaaattgttattgatcatagttatcaacattatgctatgttataacagctgtttgagatggagaacgtttttactgtgtcatcagatcctcatccctctcctgcagcccctccttcactttctttacccttatcttcatcttctacctcatctgggactaaaaaacaaaagaggaccccaacttatcagagatctgtaagtcaggaaagcagtcatctcagcttaccttgctttgtgttaagagcatgacctaggattgccactcattctggttgaaatatcttgccgactcaccttctaacttcccgaatcatttttttcaccttcactcttgaaagataacttcagtagattagggtcttactgcccaaagtatatctaagaatcagaagcattattatcaccttggatcttaataaagatggaaaatttcaaatccccatacctactgagtctgattttatattttaacttctcatttgagaagccctggtttacagccagaccttcttggtttgaatcttctactatttgactttggcaagtcatttaacttctctgtgtctgttttctcattggtaaaatgaggcgaatacaatactttcttgtgggcttttgtgaaagttaaatgagttaatatatgttaaacacagaacagtggctagtgtagaagaattaggacgtaaccacctacaggtgtggtggctttgatttacgtgatttgaccatcacacatatcgttgactcaaactttggtttatctttctagaatttgttactcttttttcctagtgaaaatatatcctttttattaataatgcccaacattccacttaaatggaaatacttataaatcagattttcagtgaaagggtctaaaacataattgtaatgatttagaaatgtcattactgtggtaaattatagacctaggctttgctaaggatttcgtcctgttttgtgcttcacttatagtttttgttgttttactcaaagaagggaaatggaacatccaatgtgatagtattttatgacctaggcagattccattatattgcttttaaatagctcctatttcactaaagaatgggaacgaagtgatagttacagatttcatcagtatgtaaaaagtgaagggtttcttttaggtaaagatttctttaaatgtacctgtgaaatgattcagcatttttaaaatggaaatgcttttgctgtcttggagttttgttgtttcagaagttttctactgcactattttggatagtctttcattaaaggacctaagcatgaattactctgaaattttctagtttaagtattgcatagaaagttcattttattgtgttaatctctactaacttgaaatatgccttccaaatgcatgacttactaaacagtattaaggtattggctgaagtttcaaaatagcgttaccaaatctcttaagagtctttggtagtttgtggtcgctgtctcttaatattaattacctttgttctgaaattgttgttttagtaattttcacttcatgtaaaggcagcatttgctaatgtagttgctataccttaatattaaaccccagaaattctatttttgtctgataagtggaaattctaccataatttggggcaattccccaatataataagttgtttcctctgaaatgttttattagctaaattaatgctgcagtaataaagtctataatcttcccttcattttacttttttttgcgtttttatatggaagatttagtgacttattaaccagacttaatatgctatggagataatgtacagatatgtatatattctttttctttttaaaacagatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggaggtaatctgtcagttctcctttgtaaaaatgtaatcacaaaatttgtcttgcatatcaatttgttcatgagtgtttttcaaaaagttttatgtaaattaaaacattttggacttttagttgtactgtttagtgaagaatatctgtataaaccagcagaatccttgaaagattatatttgcatatatttacaataaatgcttggaagatttcattgtttttccccataatgatgactgtttacccgtaagattttaagccagtacgaatattgaacttttgtaatgttacttatgattattctgtcaggtactattttgggtagtacctgaaaaaagtaatccttagagtgtcacctcttagaagctgggcgcggtggcttacgcctgtaatcccagcactttgggaggccgaggcgggcagatcacgaggtcaggagatagagaccatcctggctaacacggtgaaaccccgtctctactaaaaatacaaaaaattagctgggcgtggtggcaggcacctgtagtcccagctactcgggaggctgaagcaggagaatggtgtgaacctgggaggcggagcttgcagtaagccaagatgccaccactgcactccagcctgggcgacagagcgagaccccgtctcaaaaaaaaaaaaagtcacctcttagattatatggaaattcattgtggctgacaccatacaaattatttcacaggcctggcatggtggctcatgcctgtattcccagcattttgggaggccagggcaagtggattgcttgagctcaggaattcaagaccagcttgcagcctgggcaacatggcaaaaccccatctctacaaaaaatgcaaaaattagctgaggaacgtgacatgtgcctgtagtcccagctactaagtagactgaggtgggaggatcgcttgagcccgcaaggtagaggttgcagtgagctgagatcgtgccgctgcactccagcttgggtgacagggagactctgtctcaaaaaaaaaaaaaaaaaaaaaaaaaaaaagtttttacatgtgaagtgtttggcttactaaaggactgaaattatgaggcctctgtgcatttttaaaaaacgtttgagaaaagagtcagtataatagctaacaagatgcatgctataggaacattgttttggttaatcctcatggcagtcctgttaggaattattctccttttacataagagaaaactgaggtacagaggagtttaaaaaaaaaactcgccaaaggttatgattgttaagtcatctcatttgtagtatgtgtaaatgccataaaaactaagattaagacatggctatcttagcataagatggtggttctgaaacatttgtgtgtatcagaattagtggaaggcttgttaaaacacagattgctatacttgatccccagagtttgtctttggctaggactagagttaggcccagtatttcttttaagctcccaggtgatgttaatgctgctggtccagggaccacactttgaaaaccactggtctaaggcaattcaaatgctatgttaagtatagcttggaagcaatatatcgtttcgcaaaaatcagttcaacaaacataacacattatttatttttagatgatgttgaatttgaagtatcatcggaccgacggactgggaaacccattgctgttaaactggtgaagataaaacaagaaatcctccctgaagaacgaatgaatggacaagttagtgactttgatgctttgtgtttttttagggccctgcatttgcatatctttcacattagaaaaggaagattctccccatctcctcagtttgcacgaaagagagctatagtatataaagattactattttaaaattaatcaaaagcactggcatttcttgacctgaaataaaaatatggtcaagactcaattgggtttttacatataaccctgagtcaatgcttacagtcaatttacatactgtaagtttgaaacttggcagcatgacatcctcttgtggatcatattaaaatgcatccctgtatatagtatagaggatattaaaattcagtttatattgcacagtgctgctcctgaaatgattagcaatggaaatttttttttttttgactggtaggttgtgtgcgctgttcctcacaacttagagagtaaatctccagctgccccgggtcagagtccaacagggagtgtatgctacgaacgtaatggggtaaacttgtgtatttttcttaaacctttgcctgatccaccatgtgatctataagcgtactttaaaattcaaaatagaaaacgtaagctgcaattgttaaaatcagttttaaatttggtttctaagaggcttcaaatgcagcataatcaaaaaatttaaaaagaaaaattccataggacttccaagtgtcttagtttgcccaagtatgaccttagttagaacattaaggtaaaatgttccttttaatcacttttttgggggttgtgggggggatctttttctggtttcttttaagcactaacaccagctttttttgtttggaatgccttatataaaattgtttttttgaaatgtaactatagtctctgggcaaatgcttccacgtgtgtaagctttttgaagttggattgctgctcagctgtggactcgcagaagtcatcagcaccatggaggggaagtgtgtgtttatatgaataaagtgacttgtcataaagcatttaattttaagaaatttggcttaaaatgccagtataagaggtttttaagtaagtaaatcacagtatacagtgaatatgcatcctgccaaaatagtaataatgatttattaattcacaggaagtgttttatctgacttacacccctgaagatgtcgaagggaacgttcagctggaaactggagataaaataaactttgtaattgataacaataaacagtaagttctttttttttaaattttctcacctaagcggtttttttttcccccctccattaagaaatttgaatagagttaaaaacctaacttgtaagtctggatagttttcatgaactttcaattcatcaactaatgctttgaggtctatgaatattgtattacagccatgatgcagggtctcagaggaagatgataattaaaacattgttaggcattttaaggacttgttctagagatcagtgaaggtttttcaaaaaatagtgctttgaggtaagttttgagggaggggtatagtcactatagagaggtgagaaaaaagcattatgattagaagtatcatgacatgttgggggaaaatggccaaaagtttggtcgaactgaccagaaggtaaagtttgagcattcttctatgtaggaatctgcgttgtttaaaacaaggaagtgtgattggtttagatctttggaggtggtggaagtggtagacttttgaaaggtggggatgctgttgaccagaggcagtgatgtgagagttaacgtgaaagatgaccgcctgatatggatagactaagaggatggggtggaggagtcaagtcatattgagaagatagaatcatcaatcttaattgatttgataaaggtggggttggaattaaagggagtcccaaatactgtttttctggcctggcctactgggcagatgatggtaccataaactgggctaaggagacataaggagaatgttcaaggtgggaaaagaatcatacttatcttggcaatttttgagtgtgagatgtttgtgatatatctgggtagagatatcaaatctacagttgcgtgtataggtctgagacttagacctattaagtctaaggtctatttcctgcctataggggaagtatatagagctgtagaattcatcagcatacacagttaaggaaaatgtagttaagaaagcccagggagaatattatttttatcttggcataggagagatgagagatgcaagaggagaaggaaattaaaatagaaagttggagaaagtgctagtaatgtaccttccagtagcatgtggagggaaaagtcctaagagcatgtctgggattatctgccttgaaccttatctctttcttggcaagccttgaaggaatcagattgtgttgtaggtgtggttattattagttacagtctgaaggcctcaatttatatagttgttaatctcagaacagccttacctggtaagtttcttcatctgtaaaatgacgtataagttctcacaaagttacttgtcgatgttcatactgcttttaaatagcaggcatttaaattcccatctgactctaaagcgttttcactgcagtaagttacaaaaacaggtagaatttttctggtgtctttgttagtctgtaacatttttttaaataaaaagcacattttgggttatttgtctgtgaaaaattaagggaagtaattgcttggtgtataggtcttttcttaaaacatttagactaacagtaccattatgtcttatacagtctatgttatcttaaaaacaaaattgaatttacatcgctgctacacaaatatgaaggcataaaagcaacatgtggtgtctctaacttgtttccattctccaatggaggtggatatcattacttttaaaagcatagcaagttctcttaaagtcacttcatttactcaacttttatggctgtttactcagaaataattaatgagatagctactaaatttagcactcactgaaaatagagaccatctcctatttatctctgtatcaccagtaccttactttgccgcagattatacctacacaaatgtttgtttaatgaataacctttataagactttagtattccccacctttggtagcattcgctttgtggctttatttcagttattttgttgaaatagaaaaacagagtagaacatcacgcacccatgtgtaagtttgtaaaaaagcaaatcttccaacaacagtcccagagaaagatgacctatatatatatttgccaaacgtagaaggctaaggagttaaagtcctttgcatataaagccatatgaaaataatcaaatgtcataaaccctgtatttattcttagtgatgatagaattcttaaagccccaggaaactagtttctttagactcatatctaagcaggccaatacatttttaatccctgtttcattcctcctccctgcaattattttttttctagtactggtgctgtaagtgctcgcaacattatgctgttgaaaaagaaacaagcccgctgtcagggagtagtttgtgccatgaaggtaagtgttaaatttgagaaacttgagttttctttggccacttgaaatgttgtacttcaaactccagcctttgtttttttttttcttttttatcttacccttttaaaatatttcactgttaacctcaaaagtagtctcttaaaattccttggttgctaatacattatcttctttaaaattggctgtttaattgataatattaggttgtaccaaattatattattgtgactacagtataattttacaaaaattactggttttaagttgtaatcataaatttgtacagagtggtaataatgttcttggttttttattttgcttcaggaggcatttggctttattgaaagaggtgatgttgtaaaagagatattctttcactatagtgaatttaagggtgacttagaaaccttacagcctggcgatgatgtggaattcacaatcaaggacagaaatgtaagacagtcagttaacttgatctttggccttttaagatcagagttggtttatgtttttaagaaacacttaaaattatgtgattcttccttcctctgtccccccaccacctccaaccccttctgatttagggtaaagaagttgcaacagatgtcagactattgcctcaaggaacagtcatttttgaagatatcagcattgaacattttgaaggaactgtaaccaaagttatcccaaaagtacccagtaaaaaccaggtaaataatctttttcaggagagtcctatttcgcctcagtagtaatagaataatatggtgtggtatactgagattttatcttattcagttaatataatgtggtagtggaacaactaaggacctcttgttacgtatatttaaactaaaagagaaaccagatttatatattcataaatatggtgtttttttttttttttttctttttttgtgacagagtctcgctctgtcgccaggctggagtgcagtggcgcgatctcggctcactgcaacctccgcctcccgggtttaagcgattctcctgcctcagcctcccaagtagctgggactacaagggcatgccaccacacccagctaatttttgtattcttagtaaagacggggtttcaccctgttggcaaggatggtctcgatctcttgaccttgcgatctgtccaccttggcctcccaaagtgctgggattacaagtatgagccacctcgcccagccaaatatgtatttttttttactgggtgatgaaaaaaggccaaagaagaaaatgctaattaaattggaaagcacctgattggattagactgcagttcaggtgtacatttgttccctcctctgcccctgccctacccctccagtttgtggggaaggtgaggacacaagtggtgtcattcctggaaaaattccttaaataaaatcttttggtaccagagtgctgggtcttaattgcattgttgtaattttatggttgactcgtgtgaccatagaccatgaagctttcacattggacttatgttgtcaacaccttttttcgcttcagggaactaagttaaaaataacatgggtttactatgtgttcttcttgtttgacttagaactaggaaggatgagaaatctccagctaaaatcgtttttccttctcatcagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatggtaagtgttggatattactggatatgtatctaatatgcgaaagccaatgttatattcaagtttatactactaaattaaaatttttcttaagttaaatgaccctaatgggcatttaccttgttaaggtgattaagaatcatacacatttgagtcagtctgggttatctctggcagttatcttggaaatatatgtgaaaaaattttttgaatggaaatctggacaggattactaagatatttttagagtcagtgattctcaggcccttaatatgaagagtaagaaaattcaagttcatcattgtagaaagtagattttcccaaactatttcctaagacatttaattagtggtttctgtttttaggaaacacaattcttcctccagtgtggtccagggaagccaaaagattgaacacccatgatctagacactagatcacacataaaatacactaacagcaatgatagctgatgagcttttttaaaaaaaaaatcataggcacggtggctcacacctgtaatcccagcactttgggaggctgaggcgggtgatcacttgaggtcaggagttcaagaccagcctggccaacatggtaaaaccccgtctctactaaaaatagaaaaattagccaggtgtgacggtgggcacctgtaatcctaactactcaggaggctgagacaggagaatcgcttgaacctaggaggcagaggttgcagtaagccaataccatgccgttgccctgcaacctgggtgacagaggaagactgtctcaaaaaaataattgcaaaaacatctcatcatgttttaagaaggtttaacaatttgttgtgttgggccacattcagagctgtcctaggccatggtttggacaagcttgcaattaaaccagagtcaaaaaggttttgttttggcagaacttcacaaattgttttttaagagtttgtgtctgggagtggcataaaccaaccagattttttcccaaacatgttttatgaactcattttctcagacataatttgcatttagttacgtttgggatcatatcatctacactataactcagtgttgccagtggaactgggtacattgaatgaaaatttaagtttcttgagttttttttaatcctttgcctttgaagaactggttgtatttgacacagtgtatttaactttaaaagtttgtaagtctgaatgtgtgatttttttttttttttttacattttcaaaggcaagatctgttttgctttacggtatggaaaatataacttggctactgtcaggacttggcaaggattaaatgtcaaaatattgtttaggtcatatttaaaacttacagaatcacttctgcagtgagcagatatgtagtatgtaatacaatagcagattgataatttgtgttcattgtttcattaaacatgagtatctaccatgttccaggtactcttgatacagtaagccttacaaagctgataatttagtaagaaggaaaaaaaaaaaagagaaaagattgcatatattttattcttcagatgtaaattttaactctttcctgggcctaaactcatgcaatttttgaggtagagactggagaagtgcctttgtctactttggaattatggtctgtaaattagtgaagtttctggagattatattgtcattagacttgggcttttatgaaatacattgtgttcacgtgtttacgttcacatgtggtaattttttctagtgcatatttgccaggaagtagcaattggagagtcttagaaaattgctcaggttaagttactttgttgaaagcaatgagtttgtacttaagtgagaacagttcaaatgtggatacagtatttgtgtcacatcagagaaaattcctgatgaatttaacttgatggtggttgtaaagttgaatgttgccttcttgacaagtttcacagccagtgaaaatattatttgggtttcagggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgtgagttgtttctgagaaaagttgggaggtgtttcttgatgctttctttttcaattgaaagttaattttgttttatcatttttaggatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggtaggttttgcataatccaaatgatttttgtagctgtttatttctcttctgctttaacagcacatagtaatagagtacatataatcagcggaagtttgtctctttcagaatttctgtcatattaacagtgaactaaacaaagtaaggtttcttaaccttgggattattgacattttgggatgaatgattctttactgtgggggatgggatgtttagcagcatttctggcctctacccactggaagttagtattctgaccccttttccctgcctcccattgtgacagccaaaaatgtgtccagacattgccaaatgtcccctgggaggcaaactcattccaagtagagaactagttatataaaatgatagtactgtcttccaggcaatttaaaactttcaaagttgggtgtatcctcagttcacacatttaaatttcatttattgaaaaatccactaaataggaaatagaaagatgtctgagatgaattctcctttcaagttaataacaaattgagagttttatagaaacaagtaattcatatagaatataaaatattgctattgaaggtcagcgatagtgctctggtgaaaattaactggtagggtatgtgatggttttactaacagatggagacaggaaagagcattcttcacagagtaaaagtatagatgagaaaaattcagggtttctttaggaagcaatgagtaactagtccgacaggaatttttttttttttttttttggttttgtgtgtgggtttttgttggtgagggaggttaggagaaataaggatgaaaaatcaggatccagctagactgggagggtgttgattgctgctctaaagaatttagaccttattgtcaggtgcggtggctcacacctgtaaacccagcactttgggaggctgaggcgggcggatcacgaggtcaggagattgagaccatcctggctaacatggtgaaaccccatctctactaaaaatacaaaaaaattagccgggcatagtagtgggcacctgtaatcccagctactcgggaggctgaggcaggagaatggcgtgaacccaggaggcagagcttttagtgagctgagatggcgccattgcactccatcctgggcgactgagtgagactccgtctccaaaaaaaaaatttagaccttgttctgtacttcaaggaaaagatttcttttggataatgacatcaggtatgtgctttgggagagtaatggcagcaatatgaagcctagatgggatggagaaagacaaaagatgaaaaggattactatgaaattacttggatagttaaggtagtccttgaactaggcacacagatagtgactatagacaagtgaaggtacatgagagatactggaaagtcatgttataatttaataattgctattagccagaaagagcaaggctagtatcttgcttatcacttactgtagcttgggaaattatttcacctctgagcttcagtttttaaatttcaaaaatgattgtgtaatagtttaaaaagccctcgaagtacctagctcataataggaatttcgcatgtgacagatgatactgttaacaaaaataaaaatacacttcagttgggcttatttttaataacttttaattcttggaatgctctgcttcccaaatgtgtctggcaaaactggcttgatgaagagagcctttgtgtgagactttccctgccattttttgtttttttttctttcttagtccaacagtaccctagtaaatcctctgtcatcatgcttcttacagtatataacatttacctgttaatgaatctgtctctgctgcactggactccctcagggcagggattctcctatctctatttaatatatttgatgtatagtatattgtcagctgttgatgttgaagttggtgagttaagagcaaaaggtgaacagtaagcttttgagtttggttgtggaaaagttgatgacattggagtcagacctgagttcactgacattgttcttaaccaaactcaaatcctctggattattttgcgctgggttttgtaaccttggtaaggtttacttaattcctcagatttccccaatttgtaaaatgagggaaaagagaaactatggagatgattttgtacaagattaatttgataatacataatacctggtaatgttgtaagtgttcaataaattattatatagcagttatggaaggaatgtgattggtagaagaggaaaatgaattggttttgaatatatcgtagtttgtaatgaggactggagtttaggaaggaagtcagggctagagtagggacatgggcattatcttcatagaaatgttgaaaccataaaatcagtataatttatgtagttgctgtacactgtcattacttaacggtgtgattcaatacgacacacctgaactttcttagacttttatttttttagtcaagtgcagtagtgagaaggggggaaagaggagaacaaggaagttcgatctgtaactgactgaacaatcgagataacccactaccttcagaccagcccttagattttttaagagttaatcattcttacacgtacgatgactgaaatgttgtttctccttgaagtctggtattaaaaaaaattgttgaaatactagtatgtcataatttttaatcatctactttatgtcaagtacttgaactgtgctagatcatacaccaaattatcctgcattgttaagtatattgattgacattatatattaaatactgtgcaaggtgctgtgtgctactaaaagaggatacttcagcagcttctttaggaaatactaaagcttcttgcccttatagaatttccacttccttggaagtaacatgcccagtttaatttctgattggctatgaggagcgcaggtgtattaaacattttcagtaagcttttttctcctcaatagcaaaaattagattcttaagattgaaagaccaattaaaaattacagcagactgagctaggcttaaggcaagactaccttttattcatatgaataatcttttagaaaatgctggaataagacatttttacagctgtaccaatcctttggcacaagaatatgtaagaactatagttgtttttattggtttttgttcttgagattgttttcattctgtttttgactgtatctctttaggaggctgaggatggcattattgcttatgatgactgtggggtgaaactgactattgcttttcaagccaaggatgtggaaggatctacttctcctcaaataggagataaggcaagataattctgctcattcgagagagggttaagagttgtcatcttaatcataaatcctgcaggatgggttcttcaaattttatcaagttttgctgaaatatattttgtgtttaagagaaatacatgaatatcttgtatttgaaagcagcttattaaaagtgtctgtcaagctctttgttaatcaaagccttgttaatctagctgtttaaacgttagataaaacatgcttaataaaatcgttattggtaagaaagttaaaacagttactactgaaacattatcaaagtaaaagcacaccaaagattttacgttgttgttcattttttctcatacttaatatgtttggtttttggatagccctctagagaaattcagaatctataaggaatacagactgaaagataaaagtttgatcctttgtgaaaagtgggatgagacataaatgttttggtgaaaatcaatttcattgaagtaataacaaaggatatttggaatgaaaagcatgcgctgggggagttataggtcttgttttctgagttaaggagattggtgtggaagtgatatggtgttaatgagcatccttaattttcacaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacaggtaaggcgtgactttcaggaactttacagctaacttaccatccattctttggtgttggaataaaaaacatttagtattgattgattatacttgttgaggttcagatttcatattggtagaattatggcaagatataaactgaagttaatcactgatcttactatatacagagcctgtggccaaaagaaatagaaaggcctgtgccaccttattttttgtgttggtaccatagagttggccatttggtgtataatgtagtgtaagagtaaggggtctgactgggtgtggtggctcatgcctataatcccagcactttgggggctgaggcaggtggatcccttgagcccaggagttcgaggccagcctgagcaacacggtgaaactccatctccacaaaaattaccaaaattagcctgacatggtggtgcatacctgtagtctcaccaactcaggaggctgatgtgggaggaccacttgatcctgggaggcagaggttgcagtaagctgagatcgcaccactgtactccagcctagccaacagagtgagactctgtctcaaaaaaaaaaatagaaagtaagggttcttagaaccagacagttcagtttttgaatccaggccctgccactttatacctgtgtaatttttaccaaataacttcttggtatcttagtttcattatcctgaagttagggataatgttacctcttcatggggcattcttgaggattaaatgagtcaatacatagaaattacttaaaatggtgtctaatgtaaataagcatgccatgccatgactgttactgtaaaataaagactgcctgttactgttgatgtttatggtaatgtttagttaaatgtcatttcctttctccttagtgagttctctggtgatgttgatagcctggaactgggggacatggtcgagtatagcttgtccaaaggcaaaggcaacaaagtcagtgcagaaaaagtgaacaaaacacactcaggtaataaattgtgacttcttattcagcctgtgcttttaagtgggagataaaggatggagtagtagagggagatgaggcctaattattctacatcagtcattctcatgtgcgattccatagaacagcagcatcacctggttgcttgttagaaatatacgttctctgaccctatcccatacccactgaaactctgtgagtgggcattcttttttaataaatcctttaggtgattctggtatacactgaagtttgagaaggattggcctagatattttaggaaatttgctttatattttcaattcattgtcttcttttgaaaaataaacccaggatagccagctgtggtagtggatgcctgtagtcacagttacttgggaggctgaggtgggagggccgcttgtgctggtaggttgagactgcagtgagccatgatgatcctaccactgcactccaacctgggtgacagagcaagactgtctgaaaaaaacaaaaataaccccaagatatgtatacatcaccatggagtagggaagagaggcatttccctagaagattgttttgaagaagaatgaatctaaatgtgaaaaataatgggaagttaaaaaaattaattgtaatttaggatcttggatctctgactttaaaagacctgcaacttatttttggctctcatctgaactcttaagtgtgtgttatgttttagacactggggatacagcagtgaagaaatcagatacatccctgtattcattgaccttattttttggtggaaaatatggggcagactagaggagtaaaatactgtatatgatgtttagaaagacaacaatacatgtaataaagatgaatcaggacagtatgtaagtattgtgatttacattttagagaccaggaaaggcttcttaaaaaatgacatatggtcacctggaaaaagtaagagatcaaggcatgttttatttatgaatacttattaattccttaaacaattttatttaaacaattctatttaggaaaagcaggcattttggtagtttagaagtatttaaagtccagcagctgttctaaaaatagaacttggcttcaggttccctaccccatttcaatagcagccagccaacctaccctgttaacatttgtgctgttattttttgcttacttgtctttctatgtagtagagatgaaataaaattgaaagatgtacctgcctttgttttgtagtgaatggcattactgaggaagctgatcccaccatttactctggcaaagtaattcgccccctgaggagtgttgatccaacacagactgagtaccaaggaatgattgagattgtggaggagggtaaggatcatcactatcaggctgtttgaaatttgccataacttcagatgagcacctataaagttttaaaatatggtgcttattgcagttgtttttaggtttaaaactgaattaaggaaaagtgacctctctcatgcttgctttttatttttataccccttgaaaatgaggtcagtctgggtttaaatagtgaaaacgtgactgctttgtgagcacatgactgatacatgagcaactatgagttatattgagatagacttaacaacaaactctgataaccaaagcttttactgttgagtgtatgataatcaaatattcagttccttcattagtatttaaatcagtaagcattcagttctgtatttttgcttcctgtaaaagtttactgtttttttcccccctacactacacatatgtacataatctgtttcttaatagctagagttctatgaggatcctatttctcgtttctagctcaggcttcctttcattctctactttcttcttcttttttccccatctatcttcaagaattcccagagttccagtgccgctgttcccccaacagtcaccatcagaaaggccaactttgtatgatctgtatgcataaaataaatacatgatagaaataggagagaactctgtagatgattaggatagcagaattacatgatgtggagtagatgagagggcttgagtattccaaccaaagatgatggcttggtaggccgggcgtggtggttcacgcctgtaatcccagcactttgggaggctgaggcgggcggatcacgaggccaggagttcgtgaccagcctggccagcatggtgaaaccccgtctctactattaaaaaaactaataataaaaaaattttaaaaagaaaagatgatggcttggtttacaaagagaataaagtccttgcatcatctaagagtcagcgaacataaagtgctgaatagcaggtcatttgggagaaggaaatgaaccttgataacctattcctttaccacatgggattcttagaatttctgttctacataaaaccactgttctcccacctctaaatatgaatttttaaacaaatgccatgacatcacacccctaaaaaggccatgggagtatggactactaactttaactcataatatgatatcaaattgcccttccatctcctaacgtgctgcttttacttccttttccatccccacttcccagtccactcattcttcagcactggctgtgggatatagtccaaagcaagggttttatttaggcatctctaagcctggtgggatatagtccaaagcaagggttttgtttaggcatctctaagcccgggactagacagattacattttcccacttggtaagaactagctcttttattcaggaacacaactgtaacttatactaagactttgaagttgggcagacctagatctggacaccgttctagcatataatcttggacaaataacttaaatctttgctagctcagtttcttcatctttaaaatggtaataccttcagccttagatggttctataaagtatgaatcagtatgtgcatcataaatggtaattattgatattgcatgaggtcagaccagcttcctctaatcactcttcccatgacttgatctctttggattatctcctcaaagttttttggttcctgtatttaaaattaaaagtcagctggggtcgagagtaggggctcacacctgtaatcccagcactttgggaagccaaggcaggcagatcacctgaaggtcaggagttcgagaccagcctggccaacatggcgaaaccctgtctctcctaaaaatacaaaaattagccaggtatcatggtgggtgcctataatcccagctacttcagaggctgaggcaggagaatcacttgaacctgggaggcggaagttgcagtgagctgaatcatgccactgaactccagcctggttaacagagcatgactccgtctcaaaaaaaaaaaaaaaagtcaggtgtggtggctcacacctgtaaacccaacacttcgggaggccaaggtgggcagatcacttgagcccaggagtttgagaccagcctgggcaacatggcaaaaccctgtctctacaaaaaatgcaaaaattagccagtcatggtgtgtgcctgtagtcccagcgactcaggagctgaggtgggaggatcacccgagcccaggaaatcaaggctgcagtgagccgttgatcgccactgcactccagcctgggtagcagagcgagaccctgtctcaacaataacaatgacaaaaattcttcacttaccctgtaatcatcaagaggatggttagaagcttctgcttcccacctgtttttctcatgttttccactattgttgactgagtacatttgcctggatgctgaaaattgttaggcagctgaattctttggcatagtttttatctgtagcctgcaccgggctccaggcaacttcatactgtagggcagggctcagcatatatggtggccttttcttgtgatcacagccacaaccatttgtttacatattgtttttcgttgctttctcactacaacagcagagttggttagacaggatgacttgcaaacctaaaataatactctccggccctttaggaaaatggtttttggtctctgatctggaaaaaggaacctatgtgagggagccagaattcgaacaaaaaaaaaggaggtggggtgtcaaatttatctaaattgtttttgcctgtgcccgcctagttgtttactggctcattgagtatgggacaaaagtatttttggttggctcatattgtgaacttgggaagaagatagtcctgtgaatattggcaacccatagtgcttaaaatttaggcaatgggattgtaaatgacagtattttttgttttaatttataaatgcagtttaaaattgttcatcagctaataaagtactgatgggagctgtgacattctcatttggttccatggtagtatttaacatttaggatttcatttaagctttaaggtgaaacttctgagtactgaaaatgtaaatatattttaagtaacataacacatttttagcagttatataaacttcctagggtcatcagcagaggactgttgtgaaatactagcttttagactttgtacctgttttacaggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcaggtaagtgccagcatctctgtatctgaatttgatccttctatgagttggtaaccaaaaccttcaaatattttcagccaaggggaaatcatcaacattcattcgtttttttatttctacttcaccttttttcagtcatttgaggtagcttaataaaaacagaaaactacacaaaaagtgactatattagcaatgagaaagtaagattggtattagtaactaatattatgcaatggggaaaataagttaggggtgagatttccagaatagaaggactatatggttttgtacacttttgcttagagcttcttttgcatatcacacaaacacagaaaccacgttcaaaagtacttaaaaaataagcttagggcaaacaaacttagtcttactcctgagatctcagggaaatctgagtcctcagaatgtttttcatcagtacagagaataataacattttgtatggctgctactataacccagcttaattctagaggggatccaaacaatatatatgttgaagtaacagcttcctgatgagtttgcttaattcaaaaagcttagttcataatatacgaaggaacaaggcaagttttatttgtttggttcaagtttgtgatatagtgaatggcactttcagagatacatttcttccctgacaggttttgccacaggcagctggactggagtatcaacattaataccatgttttatacatccttttagataggggcaggcattgtgcttcattcagagtgaggtgtggcatgccctctcttttttacctacttttttttttcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctggtgagttttgttgttgtggtttgattagtaactaccctggagtgtctcaactttatagtctctgttttgtcacatcacttttctgtgccttgtcttctgccacttattatttcttgatacttcctacttctagttgaatacaaaaagattgtttagtacatgttttttaaaatttttgccaaattcttcttcttccattaagtcatttctaggttatatgctacttaaaattctaatagtttagccatgctgattcataatgccgctttgcttccccagagacagtctcacagtctgattcggttacccaggcgctatcacgactcactgcagactcaaccccctgggcctaagcaattctcccacgtcagcttccccagtagctgggactacaagcatgcgccaccacatgcagccaattttattttttgtagagacatggtcccactgttttgcccaggctgatctcgaacttctgggctcaagtgttcctcctgccctgtcctctcaaagcgctgggattacaggtgttagctaccacatctgctaccttgtttttttatgcatctgtggaactggtcactcttgattgcattcaagtctagggtctgcaaatgattccttccattcctattaagttgggaccttgagttggggataataatacataaacaaacttgtctgtcctgtctttctagctaggtatatgaggcaagagtcccatcataaaaagtgagtcatttgggcagttaggtggaaaacacactcctttgcaagtgcttgctgtctgcccaccaagtgtggtttcttctcatcttttgacttaattacagtgagggccccaaggctgttgcagctcctcgacctgatcggttggtcaatcgcttgaagaatatcactctggatgatgccagtgctcctcgcctaatggttcttcgtcagccaaggggaccagataactcaatggtatgagggcatacaaggcttgggggaggccaactgatagaccaacataaaatatgtggtcctatttaaacaataggtcaggaaacttaatgaagcagggagacttccatattgcttataactagttaggactttctacacattggttcagccccctaacctaatggttgcttacagtaagaagcacatttcttttcttgatgctttgaagacagtttaggtaatgaatgggtcaggagtgcttactgtggattttctcctctaggaaagaattagtactgcataagatgattaaaaataatgcttttgtagtttcatttcggaatagtgaatgtactatgattgttgtgcgctcaaatcattaactgcagggttttttttttctcccccccacaggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctgaaatgaatcttgtttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacactagcacctagcgctttcattattgaaacgtcccgtgtgggaggggcgggtctgggtgcggcctgccgcatgactcgtggttcggaggcccacgtggccggggcggggactcaggcgcctggggcgccgactgattacgtagcgggcggggccggaagtgccgctccttggtgggggctgttcatggcggttccggggtctccaacatttttcccggctgtggtcctaaatctgtccaaagcagaggcagtggagcttgaggtaagtttatctcatgcatagtgttcggctttgggctgtggaatgttcaggcgtttcactgatgccagaaatggagcagaatctatcagctggagacaaaggccttgggcgggggtccttccatttggtgcctacgtggggagatctttggagacagaagggagaatgggaaggagttgcggcctggaggcttcctgctagagctgagaagccttcggggagtaataggaagggggatttccattgcttaggctgagggcggggcccaaggactgttgaaaaatagctaaggatgggggttgctagaaaactactccagaagtgtgaggccgatattaatccggtgtttttgcgttctctagtcactttaagaaccaaatggaaggtcacactagggttttcatttccattgattatagaaagctttaaagtactgtagatgtggctcgccaattaaccctgattactggtttccaacaggttcttgctggtgtgaaatgactgagtacaaactggtggtggttggagcaggtggtgttgggaaaagcgcactgacaatccagctaatccagaaccactttgtagatgaatatgatcccaccatagaggtgaggcccagtggtagcccgctgacctgatcctgtctctcacttgtcggatcatctttacccatattctgtattaaaggaataagaggagagaaagtaaaaagttattttgggtatacattcagttatgcaataagcttaacgtgtttatagagaacagttcatttttattagctgctgaagtttctaaaacctgtccagtttttaacagttctgtaaactattgcaaactcagtgttgagttcattcatgagtttcttcatatataacagctctattacatgagaaacacaggccatagtagcgagactgtctgattgtatgggagataataggatggagataaaggattcagagatgagtgttcttcaatatttatttattagctagttgaagcagctgagaccagatgattggagtagcaagaacttgagatttttagtctttatgcctaggattttggtccctgtttgcagtttatttagttgtgtgatattgagcaactgaatctctcccaacctcattttcctcatgttttaaattaccataaacttgtcctgcctaccacacagggatgttatggaaagttaaataatatatttaagttatttatgaatggtaaagcactatgtaatagtacttagggattctattgttattatgagagttcatggtacagattgtcttcagtaagtggcacctaaggctctttaaataaagggttttgccggacacggtggctcacgcctgtaatcccagcactttgggaggctgaggcaggcggatcacaaggtcaggagttcaagaccagcctgatcaacatggtgaaaccccgtctctactaaaaatacaaaaattagctgggtgtggtggcaggcacctgtaatcccagctactcaggaggctgaggcaggagaatcgcttgaaccagaggcagagggtgcagtgagccgagatcacaccacagacctccagcctgggcaacagagcgagacttcgtctcaaaaaataaataaatagataaataaataaagggttttgtaattttgttcagtttagaaatgcctaactttagagattattttaatcaacacctggcctccctaccatctggctactcgtgtttaattgatgaaaactaactctaatgtagccactataaaaaattggttgctaacccttggcaaaatctttattttgagcttaacagctttaatattttacatgaaatgtttaatattttaattaaatatttttaaatgtttgatttattgagcaatttacataagtaaaatacataaattttatgtctacagcccagtgctttttgcgtttctatatagtcatgtagctaccacccagataacagtatagagcacttccagtactccagagagttctccaagtgtgatgacattaaaatacaagtaaaagtcctgttgccataaaaccaaaatgaaagtattttttatatgatctatgcatgtttgtcttcctgagaaattaaacataactataccttgtttggaacctttaagaatttgattcaggaatatttcccaaaggtacatctgtcatgataaaaaaaaaaccttctctgaaacaaaggtatttgtatatttagtcataaacacaaatgatgtatatagggccaggttataattggtggaggtatgtttagatttctttaagtaaaataaacagcacaaataaaacagtccagttcatagcttagtgaaatacactgggtacttaatctgtagcctcctggctgcagtagagttgtcatttgagttactgtgttttcttaatcttttccaggaacacagtgaccatatttcttttctgcaggcatatagaatttggtgggttttcttttatgtagggtgatattggatactttttgtttgtgattatatattagcaatttgagggacaaaccagataggcagaaatgggcttgaatagttagatgcttatttaaccttggcaatagcattgcattccctgtggtttttaataaaaattgaacttccctccctccctgcccccttaccctccacacccccaggattcttacagaaaacaagtggttatagatggtgaaacctgtttgttggacatactggatacagctggacaagaagagtacagtgccatgagagaccaatacatgaggacaggcgaaggcttcctctgtgtatttgccatcaataatagcaagtcatttgcggatattaacctctacaggtactaggagcattattttctctgaaaggatgatctttgtgttctgaatctttatggggaaatgaggttaccacactagggaagatagagctttttaattatgggaagagttggttttaggttgtttgacattgagaatctagggtaattactgaaagttaatactggaatttattttacataatatactgttactataaagtttgataatacataagtgaagcttgctactgggaatgacttggaaccagagttgttgtaattagagatcacgaaggaatttcagagaggaaaacatctccaagaaacatctttcagtatgtaatggaaaagataggccaggcacagtggctcacacctggaatgtcagtgctttgggaggccaaggcgggaggatcactttcagcccaggagttggagaccagcctgggcaacagagcaagaccctgtctctacaaaaataaaaataaaaaaattagtcacacatggtggcagctactcgggaggcagaggtgggaggatcacgtgagctcaggaggtcgaggcatgctcactccactgcactgctgcactccagcctaatcaacagagcaagattctgtctccaaaaaaaataaaaaataaaatgataggagtaagcaaataggaagtccataaagatgaaaacaaagcaagggaacataaagatagactttgtccatagaaccataaagtttcaaagctagattggaccataaaaattctagtacaatattcttattttgcagaatcagaaacagagttcagaatgtcgtttgttaggttttggagtcaggattgttattagtagcagagccaggaccaaaaacccaaagctcctttttcttagcacagtgttcttaaacagaataatataatggttaagaatgagaactctgcctggattgaaacctagctctgtttattagcgacgtgactcaggggctatgtggctttcctaacctataatatggaaataataatacctacctcatagagttgtgaagattacagttttaataaatacgcaaatcactcagaatagtgcctggcacacagtaaatgctacttaagtgttctgcctaaaggcttgagtcttggcttattttctatccatgtgaagatgtctgctctcaaaagcagattggtccaacactgaattcaagtgttcttttcctaacctgttgtacttcccattttttttttgtctaaaagtaatagcagtacttaataaaatgcccacacttggcatgcatctaataaatgttttttgaatttctagaagtcatttttcttctttcttacaagaaatttattcatttttctatatgccttagctcaaaccaaagagtatttaaaacatcttatgaaaatgcatatagtagagcaagataagattaatgaaaaataggcttaagtgagaccaaaaaaataagggtaaaataaacaaatttaggagtgagcatattctgtgattgtgcatgaagttccagtggctttctaaaggtggactacaaatttggtcactgttgtgaaaaggaaagtagccagctgaaagattcagtatctgtatgctgaaagccgttaagttgctcggactagaaggaaattttcccatggatcctcaaagaggcttgtttaatgtaaaaatcagtagtaacctgacagtgacatggtccaggtactttaggctgtcttatcccttaatgtaggctattaccatcaagcacagttttgcaaatagccagtggaatgtagttcagatacatgactttgtgggtaatccaggggtagagactaaaacagtactgtgcagtatgtggttatttacagttaattaagattaaataaaatttaaaaattagttccttgactaccaaatgctcaatagccactagtaggtaccatgttgaacagtacagatatagaccatttccatcatcacataaagtactgttggattgtgttggtcaagacaatctaaagcaattgtttcccaggtgtgctgtgtggtgtgccttacatgtcattgaaaggggtgctgtcaggagttctagatgcttcagcctccctttactaagagcagttcttatgttttctattttatcgcttgggcttccagatacaatgttttgttttaggtttgttttttttgtttgtttgtttttttttttttgagacggagttttgctctggttgcccaagctggatggagtacggtggtgcgatcgcggctcactgcaacctccgcctcccgggttcgagagattctcctgcctcagcttcccgagtagctggaattacaggcgtccaccaccatgcctgactaattttttttgtatttttagtagacttggggtttcaccatgttggccgggctggtttcaaactcctgacctcaggtgatccacccgcctcggcctcccagagggctgggattacaggtgtgaaccaccgtgcccggcctgttttagttttttagagatggagtctccctctgttgcccaagccagagtgcggtggcatgacactctcagggttcaacctctcagggatcaagggatcctcccacctcagcttcctgagtagctggaaccacaggcacatgtgccaccatgcccagctaatttttgtattttttgtagaagcaaggtttcaccatgttgcccaggctggtctcggactcctaggtcaagtgatcctcccacctcaatctcctagagtgctaagactataggcgggagtcaccatgcccagcttcatctacaatttatttgaagaaaatgtttgagcaccacccatcttgaaaagtgatagactgccttccattaaatactgtcacacctagttatttagcagcagtgagcttcactttttatactttagaccttaatctaaagggtgatttctagttgccagttaaatccagagccaagctctttggagaatccaggagcctcactaggtcatgtatcaggataaaatacccatccactcccattagaaggtgagcttgtacttatggcttcctgatggctgctgcaacaagtctaaagcagtctccttagtatacaatgtcttctctaagtggtagaaaaaagcaaaaatactacaagttaatagggctacataaaatttgctagtttcttttttgccctagccatttattccttcctgaaatcttgtctctctctcgctctctctttctctcgctctcactttctttctctttttcttttctcttttcttttctttcttccctttcttttctttcttttttcctgttgcccaggctggagtgcagtggaacaattatggctcactgcagccttgacctttctggacccaggtgatcctcccacctcagtctcccaattagctgggactacaggcatgcgccaccacacccagctataatatatattgtatatatattttttatttataaatatatataaatatatatttatatgtgtaaattatatatatttatatattataaattatatataaatatatatttatatataatatatataatatatatttatttttatatattttatatatattttttggggggggttgggggggatggagtctcactctgtcgcccaggctagagtgtagtggcgtgatcttggctcactgcaatcttcgcctcccaggttcaagcgattctcctgcctcagcttcccgagtagctgggactataggcgcctgccaccacacctggctaatttttgtatttttagtagagatggggtttcaccatattggccaggctggtcttcaactcctgaccttgtgatctgcccacctcaacctcccaaagtgctgggaatacaggcatgagccactgcacccagcctaatctttgtatttttttgtagagaccgggttttgccatgttgcccaggctaatctcaaactcctgggttcaagcagtctgccctcctcagcctcccaaagtgctgagattgcaggcatgagccactgtacccagcctaatcttgtttttcttatgttctgataatatattcccgtttttagggagcagattaagcgagtaaaagactcggatgatgtacctatggtgctagtgggaaacaagtgtgatttgccaacaaggacagttgatacaaaacaagcccacgaactggccaagagttacgggattccattcattgaaacctcagccaagaccagacaggtatggtacagctttcagcatttgtgcaagagtttgcatcagttgattaactctggtagagatgtgatccatattcatattctttgttgttatgcatttttttcatttttatttttttattttttatttttttttaggcagagtctcactctatcttctaagctggagtgcagtggtgtgatctcagctcactgcagcctctgtctcttgggttcaagtgattctcctgcctcagcctcccaagtagctgggactacgggcacatcatcatgcccggctaatttttgtacttttagtagagacagggttttaccatgttgcccaggctggtctcgaactcctggcctcaagcaatcctcccacctgggcctcccagagtgctgggattacaggtgtgagccaccacgcccagcctgttgttaggcatttttagtagtgttctttttcttaacgcttgtttaaacccaaaatgaacttactaatattctgttatggcatgtttactcctgcattaacatccacaaatatttcttgggaagatccttgactaaaaatatttataaacattagttatttctctgtcaacaccagcccgtttatggcttaagcctcctgaatggagtctttagtttaatgtagttttgttccgtgtttctcacattacccttttcctttgcatgaatgtttatttggcaaaatgtgccatttttatatcagcctgttcttgtgattcaataggaatgtgaaatttagtgttctcttccttaaatcaccatattttattttatcagctattcgtttagtaattggaatcttatgtccacataaagagatacaaatgcaagagagcttataatttggattgtgtccgttgagctagctctctcattttttttcattttttccttttatagggtgttgaagatgctttttacacactggtaagagaaatacgccagtaccgaatgaaaaaactcaacagcagtgatgatgggactcagggttgtatgggattgccatgtgtggtgatgtaacaaggtgagcatatggtttcttggcataattacaaatcttagtatatagtattgggcaatttggaggagtgctggtgttattgtctatatgttttttgagtttctgcctatcctcttctgcacattttccatatgacaccctttctgaaagtactgaggtctaaagtgtttaaaacatttgattattccacaggtatctttatatttttggtaacattagaaattataagacattatttatgaaatgtaggcataccctattcctggcaatgaccaggaatttgaaggatcactactttgaaactagttaataaggacatggtttctgttctttttttacagatacttttaaagttttgtcagaaaagagccactttcaaggtaggacaagtttggaaatgtattctcattcctgttaattttgtatatttgtttttcttatactctgaatgtgtcacttatacaaattctgtttctatttcagctgcactgacaccctggtcctgacttccctggaggagaagtattcctgttgctgtcttcagtctcacagagaagctcctgctacttccccagctctcagtagtttagtacaataatctctatttgagaagttctcagaataactacctcctcacttggctgtctgaccagagaatgcacctcttgttactccctgttatttttctgccctgggttcttccacagcacaaacacacctctgccaccccaggtttttcatctgaaaagcagttcatgtctgaaacagagaaccaaaccgcaaacgtgaaattctattgaaaacagtgtcttgagctctaaagtagcaactgctggtgattttttttttctttttactgttgaacttagaactatgctaatttttggagaaatgtcataaattactgttttgccaagaatatagttattattgctgtttggtttgtttataatgttatcggctctattctctaaactggcatctgctctagattcataaatacaaaaatgaatactgaattttgagtctatcctagtcttcacaactttgacgtaattaaatccaactttcacagtgaagtgcctttttcctagaagtggtttgtagacttcctttataatatttcagtggaatagatgtctcaaaaatccttatgcatgaaatgaatgtctgagatacgtctgtgacttatctaccattgaaggaaagctatatctatttgagagcagatgccattttgtacatgtatgaaattggttttccagaggcctgttttggggctttcccaggagaaagatgaaactgaaagcacatgaataatttcacttaataatttttacctaatctccacttttttcataggttactacctatacaatgtatgtaatttgtttcccctagcttactgataaacctaatattcaatgaacttccatttgtattcaaatttgtgtcataccagaaagctctacatttgcagatgttcaaatattgtaaaactttggtgcattgttatttaatagctgtgatcagtgattttcaaacctcaaatatagtatattaacaaatt

SEQ ID NO: 36218 - DNA, 41914 bp, Homo sapiens
tcgggctccagccccgtccgcgcgtctcccggcgtgggtgcgggaccagggcgctgcggggcgcgcagggtgagtctgtggaatagtagtggaggacggcgccgcgctaggcgggggtcccagggagtcggctgcaggggtgtctgctgggagggctggaccgcggggctcaccgaggtccgagggccgcccgcagggtgaggcccccaagaagctgcggcaagtgccgcgcccgccgagctcgctcccgcgcccgccccaagatggcgcccctccccctccccttgcgcgcgcctccgccgctcggggcgcggccccgcggcccgcgcgctcctgggcgggggatgttgtgatggagaagccgcggcggagcccgaaccccgcagcctgagccacctccgtcatctgggcccggggcctcaccgcgcaggtaggaggtgtccctgccccggcccagccccggtggctgcgtcccgatcaccagcggccggcggaccctgtagcccctaccctgcggcagcccgggtcccccggccggccccatcccccatccccgggtcgcccttccaccgcgcgcccgcagaccgtcctctcatacccaccatcgcagggtccactcgggccctcacaccgtcccttccgctgccctttacctcctgcccctcggggtgactaggggcgggtatggaggacgcgaagcgaggggcagtgggtgttgggggaggggaggcccaggtccgggaaggggacgtggggtggggtgggctggcaggccgcgccgattccagcaggggtcccaggccctggatctgtcaagccgcattctgttgccctcagcgaccgaggggtgtgccctggggcggctgtgtccccagctcagccaggaggcctagcactgccaagaacactgattagaagcagttttcccactgccaattcctaacctgttttgtatcggcctgtgtatctcttgcattctgagcccctctagctatagtcccagctctctccgcccttcagagtcaacgcttgctgtcttcatttccttacttcccattcattcttaaaagcactccactctgtgtccctgacacccactgaaactgtctaggccaaggtcaccggagacctccttgtggagaactccagtggacactgttatctcctttacctttgagtagtattcggtggggtatgtcaactcactctccttgaagcattttcctgctttctgccctacagcattgtctgctcttctcaatctcatttgcttcctctcctcctctctttagatgctggtgaggctcttggctctgtcccgagctgtcttctctcagtatctgttctttctccccagatattttatctactcccaaagcttcaaatttcatatatatgctaatgattcccaaatttatatatccagcccagacttctttcctgaaatccagactcatatgtccagctgctctcttgacatctccttgaaagacaaacaggagttccaaacctatagattccaagctaaattatcttctgtggttttctctgtaccccacttccaaatctgttcttccttcgaatctcaaaaatggctctttgccaatctggagtcatgagcaagacttgagattaacccctctctcactctctgcatctcatttcaccaagttctgtcacatccactgcctaaatatttctcaaatccattcatttcgctctttcctcactgccaccaaagttaatctgggccaccaccattttttttccttgactactttaatagcataccctcttgcctacctccctttaactgttctcaacacagtacccagagtaatcctttgaaaaatgcttccaatcacttattcatgcaataaatatgatttcagcacctaatatatgccaggcactgtgttatgtcctgaagatataattgtgagcaaaagagactgagtccttggagctgacaatctaggagaaaaatcaaataagaataacattacaaatgtaatatgtaccatgaagaaaagctgtatggtgccttgagaacgcacaagagcagtagctaaactggtctcggggatagggagagagggttggaggacagcttctctgagaacatgacgtttgaactaaaatatagtggatgagtagaagttaattcagcttagagagtaggagaagaggtcccaggaagcatggaaatcacatgcaaacaccttgtagaaggaaaacacatgtcttcgaggaatcagaagaaggctactgaggctgcagagcagtgtgaccaaagccaggggcagggaggaggaaggcaggcgccagactgagcaggaaatttaggccatgttaagaatttggtcttaagggccaggcgtgatggctcacgcctgtaatcccagcactttaggaggccaaggcgggcggatcacctgaggtcaggagttcaggaccggcctggccaacatggcgaaaccccatctctactaaaagtacacaaaaattagccgggcatggtggtgtgtgcctgtaatcccagctactcaggaggctgaggcagaagaatcgcttgaacccgggaggcagaggttgcagtaagccgagatcttgccactgcactgtagcctgggtgacacagcaggactccatcgcaaaaaaaaaaaaaagggaattttgtcttaaggtctttgtccttgatggtagtggatgtggagagtagatgaagtccagaaatttttctcagagaggaaatcatcagtacctagagatggattgaacatagcaagtgcaggagaaggacatgtcaagatgtacccctacttcagattcacagaataggatggattctatcattccatgagccgggatcctgaaagaggaccagttagtgtgtgggagtgggaaacatgagtgggtctattagcttgagacatccaagtggagatgttgagtagaaagttgaatgtacttgtctggagctcaggtgaggggtctgaaatggagatttgaattgggaaatcatcagtgtataactgaagctgtgggcattaatgaatacttatactgattataggatgagaaagaggaaggggcatgagaataagccataagaaactccagcaggtaatggctaatagaggaagatgagccagcagaggagtctaggaacccagcaaacagtaacaagaagtgtaaaagatgagatgagatgaggagtgtggagatgagagtgtggaggccccggatagaggctggatgagagattcacggggtcagatgctgctgggaggacaaccaagacgagcactgtgtctgttggattgaatgacacaggggtcatgttgaccttggtaggagctgttactgagtcgtgttgggagtggaagcaggtttggaaagggttgaggagtgagtgggaggtgaggaagtggcaacagtgagtggagacaactctctcaggaagtttgcctgtatgggggaggaaagagagcagtgagtggatctggaggagcgtcaggtcaagttgggagaccgtggatcctattgagaaggagaggttgatcatatagaggagaaaatagataaacagtggtataaaattcctggaaaggcatcataggaagaatccaaatcataggtgaagcagttggttttgggaaggagagaaagggataggtgctgaagtttggttaggtttttatgtttgaggatgttacccagttggatggcttccctttcctctgtgaatcaggaggggagatcagcctctgagacgggtggccaatggagagttatgtcctagtctcaggcaggcctttgctgatgtcttggctgtagtaagccccaggttcctgtaatgccctcctcttcctccttcatgatattcagtcaacaaatagggaatgctatgggtgccaggcactgttctagatgttggtgttacactgcattgtaacaagttgttcaatgactgtttcccgctgaactgagaactcctccagaggaagaaccatttcttttgtcttcatcactctcccctgtgtctagcacagtgcctggcatatgggaagctgtcagattagacaactcctgactttgagcaagactcaaccccaacccctgtggtctgatgccaggatcttcaggcttagtgactacttctttcacttcctgccccgaggcccctgcccaactccctgccttgagccagaacccagttggctctttgcatcctttggtaactccaatgagaggggagagattaggttgtgttccttctttaaaaaattggactgagatcatctttttgacctcgagcagtggggtgttggtgaccacaccacctcaggctagatgctcaggcttcagcacttaaacagtttcaccattcttcctctaatacttcctgccctggtgaccagattggcggggctgccctgaggtcaacttggctcttcactgtttcagcctcacagtgcatgcactcttctcagatcatatctcctagtgcctaggaggttggtctctgcctgacctttgagaaacctggctctgtacactactgcttcagagaagggtttgccatccttaaggtcctctgagcatggcagagtcgtggagtcttctgcttcctgacacccatggagatgccactcttgaacagtgtctgtgccaagatgttggtttaagctacctccctcgctcccttttcctagatctcagccctcacctctccaggattcctgtcccatcttacttcccactcagggaccctttggcattctctgacaccctcccaaacactccctttgctcctccccagcccattgggccacacagcctttcttggtatttattcccagccagttctgagcttcctggatcctcccaccccctgtgtctgtcccgttcatccgtcctttccttctgcaacagcccagtctgtgtcggcacacggcacactctctttggtaatgggaatgtgaaattgaataagacaccgtctcagatattctgatagaatgtggttctgggtgttgtgagacacgaaggagagaacagtcacttgatggtggggagagaacaggaaagactgcttaggagctgtaactgctgaggttagttttgaaatacaagcagaggttctcacaaggggagacagaattccaggccgagggagcagtataaacaaagacccagggctttaagagtgtgcgacatgtttcagaatccgccacgcttcatgtggctagagtataaggtataaaggaggcgggaggtggggaggggactgacaggttatagaggccggcttaagagggctcttgggtgtctgcgaacgagtgcaggcgttatccgaaaggcagtggtgagccctctcattttctgaaccagggagtgacacaatctggtttccatttttggaagattactgtggttctgggaggaggtagagctatttttttcttcatttattccagtggctgtgagttttctcattggccaggaggagtcacactgagcagatcaacagccccacgtgaggcagacacgtgcgcagaaacctttttcatcttacagatgtgtgggtagcatagcactagtgtctgaggaactagagacgtagaaaggtgagctatggggccgggcgcggtggctcacgcctgtaatcccagcactttgggaggctgaggcgggtggatcacctgaggtcaggagtttgagaccagcctggccaacatggtgaaaccctatctctacttaaaagaaaaaaaaaaaaagaattacaaaaattagctgggcgtggtggtgggcacctataatcccagctactcaggaggctgcaggaggttgcagtgagctgagatcgtgccattgcactccagcctgggcgcaccgcacctggagagatgggcaagccctgctcaggtagctgcaagacctgtgctcagcgctgagaacacagagggaaggggggtagtggtgagtcagggaaagaaagaactccttagtagaggaacagggagatagggaactctcagataagacatcaaggagaaaggtctgtacagtgggaatgagaaagagcacagtgcagtgtttgttgggatggtcagtgagggagaattgtctgttgggggaagggtcgggtagggcaagagaatcagtgaggccatcgagggaggagagagtaatgtggtaggggctgtctgaaggagggcttgcatggagggctcaggatgagagagaagtgggcagtggttggtcagggagaaataactgaaatcgggggctggtgagggtccagggagagagcactttctcttgggggtccgggaaggagagcagcagagcaactggaaggtcagggagagtggggaggatggaatggggccgagggtgggtccctgggtggcgggctggaaggatagttgggactcaaatggttgcggagaaactgacccacgaagggctgtgaggaggcagagggaggggtctggagggggagctgtccttgcggaacaggacgtcctcttacctgagaggcaggtggagtttgtttggggcaccataaggcatagtaacgtaaccaaagtgttttctgacactggcagaggagatgccaaagcgaagcctggaggaaatggggactgattcatacattcattcagcaaatattaatggagttcctgctctgtgccaggactacgctaggcactaggcatactgtatttaaccaaaaaggcaaaatcctcaccaacatggaaattataaattatagtcatgaggagacaatcattagacaaagtaaataataaattggcttgtcagatggtgacaggcgctggggaagagtttagggattgctgaggaggggcggaggtagcctgtggttttaaaatgggtgttcagggaaggcttcactgaggctgtgacatttggtcaaagatctgaaaggctgggccggacgcagtggctcatgcctgtaatcccagcactttgggaggccgaagtgggcggatcacgaggtcaggagtttgagatcagcctgaccaacatggtgaagccccgtctctactaaaaatacaaaaattacctgggcgtggtggtgggcacctgtaatcacagctactcaggaggctgaggcaggagaatcacttgaacccgagaggcagaggttgcagtgagccaagattgtgccattgcactccagcctgggcaacaagagcaagattctgtctcaaaaacaaacaaacagacaaacaacccccaaaaaacaaagatctgaaaggctgaggggcccaggggaaaggctcccatagtgatccaggacagggcattatgagggctggcagagggaccagtgcccaaggggagctacttcatggaaattgtcaccaagatgtagcttcatctggccagagaagccatgaattgcagccgagcgccctccctctgtgacctgccttccagtgccatgccctgtagggctggttctgcagcttatttgctcctgtcctcacagtccctagtatggggtgggcttgggggctggttgagctgagtgatttatgggaataggaacacagccggaggagcttacagtgatggggcttgggatggaagtgcggccggagaggggcagtcagtgatcagtgtccaaaacacacgagccggtcccactctagtggtgttcctggcacagtaagccccgggtggatgagctggggggtggggaggcacagagagccattgtgtggaggccttgctggtgggaccgagggcaggcgccagctgtgccatcccagaaagctcagggcaggggatatagggatggggtgggcctcagacctgggcctggactgtgatggggatgatagtgctgggacagaagttgaacccagtcattctcataggatagagagccatgggtgctagcctgcttagtgcagggagatgaggaggcacagggcatagccctggggcagaagcagtgatgctgctgttctggaccagaggctcaacagcatctcccctccgcaccccacaggagctgccaaggccatgtctgttccatcatcactgagccagtcggccattaatgccaacagccacggaggccccgcactgagcctacccctgcctctgcacgctgcccacaaccagctgctcaacgccaagctgcaggccacagctgtgggacccaaggacctgcgcagcgccatgggggagggtggtgggcctgagccaggccctgccaatgccaagtggctaaaagagggccagaaccagctccggcgggccgccacggcccaccgtgaccagaatcgcaatgtgaccttgaccttggcggaggaggccagccaggagcctgagatggcacccttgggccccaaaggcctgatacacctgtactctgagctggagctctcagctcacaacgcagccaaccgaggcctacgaggacctggcctgatcatcagcactcaagagcaggggccagatgagggagaggagaaggcggccggggaggccgaggaggaggaggaggatgatgatgatgaagaggaggaggaggacttatcttctcccccagggctgcctgagcccctggagagtgtggaggcccctcccaggccccaagcccttacagatggcccccgggaacacagcaagagtgccagcctcctgtttggcatgcggaacagtgcagccagtgatgaggactcaagctgggctaccttatcccagggcagcccctcctatggctccccagaggacacaggtaccttgtggagcttgacatgggcatgtgggagggtgtgagggcagaggttaggactctcatacagaggccagtgccagcctgatgtgagctgagagcccataccctgaggccacagcaggccatgtccaggctttttcattcagagagtgcttggacattctggtagatctgaccatcatgcatgcccggatggatggatctattcattatgcatgccaccatggttgataagtggactagtttactgggcactgactaggtaactggccctctgctcagcattttcaggctttatccttacaataaagctgtgaggtaaatattatgatgattcccatattacagataacaaaaaagagatccagagaggtttagtagctttctcgagaccacagacaggctgagattacaatagagctgaaatctaaaccaggtctcagtccaggcctgagctcttggccccgtgttatgctgccgccaatgcatagagcacaatgcactcaggtgcacttgggacagtcggccccgttttttttttttttgagacagagtctcactctgtcgccagtctgccccgttttaacaggtcacgcctgttgggagcagccagcagctccccacagaggtctgtttggaaagactgggaatgttgtgtgcttataatccacatgctccagcaccattgcaaggatacagttttgtcaggagtaggatattgactaaaagttagaaaagaaaaccctttgggtagggggaggagaatagatactaggactccagggcttaatcattaaatatgtccatttaaattaagctgagtctccacattttctaatgtcgtgtagcgaatacaggaaaagctgaggaacaaagagtggagataatgggctatagttacaaccaaaaccctggagttttgtagatggaggtctaagaaagattaggaaagacccctatccttaccaggtggcggacacaatacccataccccaaactgtgcaatctttgtggagaacatgcagttcagatgagcctagggctgcacaccatcccctttcgaaaaactcattctggacattttcaaacatacacaaaaatagagagaaaagaataatgagcctgatttacccacgagccagttttaccaattatcaatacataactaatcttgctacctgcatgctctcttccgttcctaggcccagcgtaggttattctgaagcaaatacttttatctataaatgtttacagctgggtgcagtggctcacacctgtaatcccagcattttagaaggctaaaatgggtagattgcttgagcccaagagttcaagaccagtctgagcaacatggcaaaacctctcctctataaaaaagacaaaaaaattagccgggagtggaggcatcagccactgtggtctcagctactcaggtgactgacctgagaggatcatccgaacccaagaaagtcgagactacagtgagccatgattgagccactgcattccagcctggatggcagagagagaccctttctcaacaacaacaacaacagtttacttttgcatttctgaaagataaaactcttaaaaaaaaaacccaccacaatatcattattgtacctacaaaaatttaataataattctttaatatcattaaatatcctgccaaaaaaaggctggattgagcctgggcacagtggctcacgcctgtaatcccagcattttgaaaggctaaggtgggtggattgcttgaggccaggagttcagaaacagcctggttaacatggtgaaaccctgtctctacaaaaaacacaaacattggctgggcatggtggcttatgcctgtaatcccagcactttgggaggccgaggcaggtggatcacgtgaggtcaggagttcgagatcagcctggccaacatggtgaaaccttgtctctactaaaaatacaaaattagctgggcgtggttacaaacgcctgtaatcccagctactcgggaggttgaggcaggagaatcacttgaacccgggagacagaggttgtggtgagctgagatagagccattgtactccagcctgggcaataagagcgagactccttctcaaaaaaaaaaaaaagaaggaaaaaaaaaatgtagagacagtgtctcaccatgttgcccaggctggtcttgaactcctgttctcaaacaatcctcctaccttggcttcccaaagcactaggcttacaggtgtgagcaaccatgtctggcctgatctatctgttaaagttatgtttgatcaagttccccttctatttttttcgttgttgttgtttgcagttttgcttttgttttttaactggagaatcatgttgcttgtcctgagttttctatggtttggatttttcagactctctcctgtggtcatatttaccatgctcctcttcccctggatttcctgtaaattggtagttagttctagagccttgatcagattcagatttgagcatttttgtgttttgcttttgcaagaatatttcataggtggtattaaatacttctactaggccgggcgcggtggctcacgcctgtaatcccagcactttgggaggccgaggcgggtggatcatgaggtcaggagatcgagaccatactggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcccgggcgacagagcgagactccgtctcaaaaaaaaaaaaaaaaatacttctactaaaggcaaagtctgattgcctctcttttttgtgatgttagtggcctttggtggtcattgtctcaactccttttaaaaggaacagcccctcctgcactccagctgattatttttgggattggggtgaggaaaaatatagtctcaatgcagccagttaaagggaaactgaaaactagatattggtgtaaaatagcccaatttctaaacgttaacaacaaattctattttttaaaaagcactgtgcaggccacacacaatctatctgaggcttgcatcagtctgcaggttgtaggttggaagtttgcaagactagggggtgtgagtcagtgaccaaatagaggcctagttgctcacttgcccctgggatggtcactgtgggggctgcaactctgaactacctatgaagcttctaggagtagggggatagtactgctgaagagctggggcgggtttgctgggcagtgacctcagcaaggatgttggagtggcaagaggattctcaaggatcatgcactggtggagacattgtgaattgaggatagaggtgggggccagcccaggaaaggggccaagtcactcttttacaactgtgttgctatgaccatgagggctgcagagaaggtttgtgctcctgcagaaatgaggctagaattgagcaaaaattatattctccttcctattgtaggatattcatagagctatggattgaatgcataaatgcatgaattcatgaattaaatgaatgatgaatgaataaactttactacctgtattgaattcatactctgctccaggccttatcgtaaatgctggaaatgtatactatggggcaaagatgttcttacctcctggccttcacagcctggtgaggagacaaagaaagaaacaagtggttatgatcagtgcgatgagctctctggggctggggaagtacaggaggggcccctgaccctgcctgtgagagtggtgggggagagggcaatgggtcagttttaagaagggacctgtatactgatgtctgaaggagaggtaggtgatagccaggtgaaaatcgagagtaagggaggtgggctgggagaggacaagggggcatgtcccaagcaaagagagagaaggggagtggctggaggtaaggctgagaggcagacaggggttcatgacagcacataaaacctggggaggaatttggactttatcctgagggcagtgacaaaacaattaagaggattccgttggaaaattacttgattagtttagcatctcagaagaatcatttgggctgtactgtgcagctgagattggaggagaccagataggaagagaaagaccagttatgatgtttttgcaatgatgcaggttaaaaaaaaaaaagctagtagcctgggctatgttagttatgtggggtggagagaaggggaaagctttaagtcaatcactgattcctgagcaagtgagtacacctggcttcaccactaaggcatttgtggatgaacgaatgaaggaaggaaggaatgatacgtgaacatttaatgtattttatatgtaagtgtcgcatgaatcgatgcaggagtgaaggtgtgcgttctggaataaatgcatgtgtgtgaaagcaaaggccggggtgggctgcgcttggagggagatgtgccaagctccagaagggcctcccagatggccaaggggggagaaactgcccttccaggacagatcggaaggatgaagctctttgaagcaggaaggtacaggctgacagggatggcagatggattggtgtgtgtgactcagtcaggagatggtgaactggtccccagattccagaagtgtccagccagccctcatgaagcaggctgtggctgtggagggcatggaggccctagggtgctgttcctggaaggttttagcaggagagtcctgaggcaatggagggtctctagggaacagcaggtattccctgagcctcagctaagtttcaggtgcctattgaaaaccttattccatagagtgtgagttagggggaagtgggggtgaggagaggcggtgatggctgcctagaaggtggatgggcaagagcccctcctctttgggtgtctgtgggcccacgtcatttggaagctgaggatggtgaagcaccctgcctgaataactctcgtcaggtgtgcagccaccttggcgtaaccacgcccactcccagccctgctgtgtctggttgcccagcagcagggtcttgggactgcctgtcccttagtactgcctcttggaccagtcaggattcctggtttccctggtaacgggaagcacgtcagcagtctgggcgctcccagccggtcctggtgctgcggttgccgaggagacgctgcagcctagctgggccctggcaggtgaggggtggggggtggtgctgggaagccccaagcccagcctcaagcttgctggggctcaggacctcaaagcccacccttgggttcaaactgctgtgcaggtcctggacaggggcgggatccctgaaggccttgaaaccacaccctatttatgctgacagctataggctctgcagggccccaggcagctggggtattccttaggggctgagtctcctggtatccctaagactgggcttggcttaggcactgaggtaaccactggagggtgggatggagattcaggattgggggaggggagccagggcgaggaagaagaggtgtgagcagaaggggctggggtctcatgaacctccctttctcctcccttccccaccccccaaggagattccctagcatggtggtcctggcccctccctagcaagctccaagcgggggaggatcttgcctggcagacgctctgccctggtgagaagggggcgggatgagcttttctctgcagcccagcaccaggctgtgagcccagctggctgggctggaggggctgtgaggagggagggtggaggcaggaggggccgggaatgagcgccatgttctcccaggactttttcctggccattatcctgcaggacagcagcgcaggtgaggggcagcatgaggttgggcctcatgtggggtggggctgacagggagagaagagttagaggacgcatgagcgggttacagggttggagtggtgtggctctgccggcagacaagggtgtatgacacagatgcgaggtatgtgtgtatgtgcatgacatgtttgcttgcatctgtgtgcagcaagggtcaggaagtgagcgtctgtggtgtctgcacacatttggcagggtttgacgtgtgccgtgtgtctgagtgtgggtccgcctgtgtgtgtggtacccacacgtgtgttggggccattgtggtgtggtatctgcacacctgtgtggcaggggctcgtatgtttagctgcatgcacacacacctctgtggtgtctgcataagtgtatggctaaagtttgtgtgtgtgtgcccctgcacatacatgtgcacctgtgtgtgatacctgccatctgtgctggcattttctgtgttgcataccctggtgtttgtggctgcacaggtgtgtggtagggcttgtatgtgttgtgtgtctgtgtatacatgtacgtgtgcaggagctagaaagtgttcaccttcgtgttaactgagataatagatatgtatgaaaggaggttaattggggtcacccaacattcattgctcccttccttcttccctccctgccttcctcctttccacagtgtggccacattagccaccaacagggcccaggaggagacctgagccatgtcccctactggtggccccacatgtggtgactccagactataggctctaggcagaagcaggaactgtgttgtggtatagctcttccaccaccccttctcaaccatggggtctcagaggggaccgggcataggcaccagctgtctgctctttgggtaggctgaccctcaccaagcctcccacctggcagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccaggtgaggctcacaggcctgttgattttgggccaggggtggagggagtgtgtgctgctggagtaggataggacactcactcactactcccatccctcctcctagctcacctggacaggttttgctcatggagaaggctttgaggatggagaattttggaaggtgggtaaggggacctgctttaccacgggatagctggaggaggggcatcattttgatactgattcctcaatccccttcccaaggatgaacccagtgatgaggccccaatggagctgggactgaaggaacctgaggaggggacgttgaccttcccagctcagagcctcaggtgagctgccagatgcagtgagctggcagtgggatggatctgtctggaaggggccttgggacagctccatttatgggagccctgtgccaagtattaccatctgccttcagcccagagccgttgccccaagaggaggagaagcttcccccacggaataccaacccagggatcaaggtttgttcaagactgacacccattctgagtctggggccctcttatttgtcagacagcccctaatgttgtgctctgaggggtctcagcgcagttccccaggtcctgagttaggagttcttccagtctcagcacagagccctgtgtctgagctggaggcacttcagtttttaaatcaaccagcccaacagccaggttgggggcccttgtagtcttagttcaggtgcttttttgtactagctggggtctcatctgacatctccctcaccctaaccacatccccctctccctaaccacatcctgtttggggagcttctccgtcttagttcagaacaccctgcctcctgccacactctgtagtcaggaactctccagttttgactcagatcctctacctcctgcccctcttctgtgtctggcagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaagtaaggacctgagccgggggtagggggtggtactgtgagagtgtgaagggaattatgagagatgggaggtctgacctgcccacaagcaggctggggaagggggatattggcccatcctaagtggcagccctgtgggatggatgagcgaccccaggccaggaccttgggagatagtcgcctaacaacggtggagtcaatgtgagagatgacacgtgacctccactagagtgaggcctgcagggcgggcggtctgacaccaaagcaggggccccagagctgtggctaacatcccctgagctgcaggggtcagagatcagccaccatcctggctggagtcccactgagtgcctgcttctggtcctgcagggaaaggatctgctactgcagctggaggatgagacactaaagctagtggagccacagagccaggcactgctgcacgcccaacccatcatcagcatccgcgtgtggggcgtcgggcgggacagtggaaggtgggaatagggcttgggattcgagggtgggagttcatccagcatcagagtcctcctctctaactctgttatttgcctctcttgtgctgctggacccagagagaggtactatgcctattttccccctcctacacctggaccagatgcctggaagcacccaagctcccctcttctgccctgccccttcccacccgctatgctccaccattaccctccacctcagcatgcttgcctgtctacccctcccccccaagaaggcagcacctatgggggaccagctgtgggcagaagccctggaggagctgtgatgggcagggaggacgtgggtggggtggggaccaggctcagcactggatggtactgggagacactgaggtgccccttccccaacagggactttgcctacgtagctcgtgataagctgacccagatgctcaagtgccacgtgtttcgctgtgaggcacctgccaagaacatcgccaccagcctgcatgagatctgctctaaggcacggccccctccactccctggactagttgccacctttgctctacaagggtgtgggtggggtcactgagtgctgtaggggggccccagggcaatgaggctctaatagattctccctggctcctcgcctcccttccttcctcagatcatggccgaacggcgtaatgcccgctgcttggtaaatggactctccctggaccactctaaacttgtggatgtccctttccaaggtcagtgtcaaaacccctccaggtccagctcagctttgttggcaaaggtgggtgacccaaggaaaggcatgagctcctggacagcgctgatagaaaaatgaacacatgaagactgaatactccaatacgtggagggactccggttaaagggaggcaggggacgagatgaaagtagggcctcggctgggcaagtgtccagcttatgccctgctggtggggctgcgggtgagcaaggtctgccaccatgatcaaccttctcttctttcccatagtggaattcccagcgcctaagaatgagttggtccagaagttccaagtctattacctggggaatgtacctgttgctaaacctgttggtatgtgtgtccttctatacccaggggctgctaccttgatcctaaaactctgcccctaccctctgccttccaatacttcttctaccagaccttcctcatgcttggtgtctccctaccctttaaaatgcatcccacctccccatacttctgtcctagctctatttcctgtcctgcctatagcagcagtcagcacgccttcgctgagcatcagccacgtgagtggtgctgaaccaggcacaaagggagaccccactccttcatcccatggaaaagctttggtgggattgggaggctgatgttagatgactggaggacaccagacagcagcctgtagctgggtttagtgttacagcaccagctgtgggctgggagcatctggagaaggaaacagtgagcataattgtcacatacttcattgttgcaaagaatttttttttttttttttttaaagacaagtctcgctctgtccgccaggctggagtgcggtggcgtgatcttagctcactgcaacctccgcctcctgggttcaagcaattctcctgccttagcctcctgaatagctgggattacaggctcccgccaccacgcctggttaatttttgtatgtttagtggagacggggtttcactgtgttggccagggctggtcttgaactcctgacctcaagtgatccacctgcctcggcctctgagagtgccgggattacaggcgtgagccactgtgcctggcctgatctggttaactcttatatttcagtgctttcctagtgtctgctatttatttgtttattcacttaacaaatacctttgaagcttaccatgtggcaggccctggactaggcacagggagaacagtggccacagtcccattttcctagaggttatagaaggttatggtagaaaaaaaccaggaattaataaaataatcacacaaataaatgtgtgagttattcgttgagagaaagtagcaagatataacaaaggaatttcatctagtctgaggttgtaaaagacttccctgtgaaagtgacatttgaactgaaatccaaaaaataagtagaagtgaatgcggtcaagtggaatggaggtgggggtgggatgggggaagatcagggtctacagtgggaggcactttggcatttccaaggtactgaaagaaggccaatgcaagatgaggccgacagctgggcagtggtcaggctgccaggtcagggacctcaggggctatgttaatgattttttcttcatcctaagggcagcaaggagttattgaagtctccgagagtgcacttgccttaatcagatttgaattttgaaagctcactttggctatttcatggaggggactgttaagtgggtggaggtggatgtgagcagctcagttaggaggctcttgctgtagtcctggccagtaatgagagtatcttgggcaacaatggagctgaagaagagtgcgtggattcaagagctgtttagacgggtatagtcaacaggcctcagtgattggttcgatgtgggtgagggacaaggatgactcctaagttcctggctgttggaccttctggatagtggattatttctttcaaggtggcagatgcttgaagaggccaatttgagcgtagagattgtgagctcacttttggacatgctgagtttgagatgcctttggggaatctgagaggcaaagtcaggttggcagttagattcacagatctggagctgagaggagaggtctgggctggagataggagttttggcattattgggttgtagaggtaatcaaagccatggatgtagagtagcttggccctggaaagtgggcatcctgaagtgagaagggaaatgaagctagtcatagccttgaggccctccaacattcaatggatgtgtagaggatgaaactgccaaggatagtgacaactggagagaggcaggaagaagaaaagaggctacttgaaaaagaagtggtagggtatcatgtcaaaagacacacaggaagaactcaacaaatgtttgatgaatgaaataaaaaatgaattaatgaataaatgagacttgcttcagattacatggccaggaaagctagacctgggagtcaaaccccggtcatctttaattctctgcactttcccttataccgtgctgactttcacgtccaaaatcttacattgaaagaggggacccttcttagaaaaggtggggattgaactgaggttttgaaagaaggtttggatttgcagagtggagtgggtatttcatttggattcgatggcactgccaaagacttggagctggaggtgagaaaagcatgctgacccttacgcctttgctttcctccttctcgtcctcaacttctaaacccttgttggctcttccatttgttacccccattcccatatgtgcttctttccatctaccacttgactctggtcctccctatgccagatcaactgcctgtgacccttgactgctccgcttggacaagtggtctctaaacttacttcctgctttatcttatgctcgtttttaaacattagcccatccagaagctgcaatattcattcattaattattcatttatttaacaagtggtaatgaatgcctgatacatgtcaggcactattctagcttcttggcatgcattaatcaacaaaactgacaaagatccctgcttttatttagctgacattctagcaaggagagacagacaataaaatgagtaaaccatggagtatgttagaaggcaacaactgatacaaaaaaaaaagaagagaaaagcacagcaggattagggggattgcatgtggggctggaggtcaaggtcacagtgtaggttttagtcctgagttatcaaatctgacagcctttttccataccttggtccactgctttcactgcttccctgccaaacttcccaagactctgaggccaggctccatctcccacagccccatctattcagcagtttgactatgatgtccctttcacacacctgaactttgagatttccaattgccctggcctaaatgtcataaacatcacacccctctgcctggcttttgaagcactctgcaatctgacctggcccatccacttctgtgacacttggttttaccagttcgggtgcatttgcccttgttgccttgagagtgacttgctcatgcatctggaatttcttcagcagataagccctgtgttagaattggggacagagggatgaattaaattccatttctgttcttgagatggccacggcccagtgtggaaaaaagttttccagcagttacaagacgttatggtaagagttgtctcagagttgtcctctccctgccctgcagcaggcatggcttcctagacagcacctagttggagccctgaaggatgacagtctgaagtttctcagtccagcagggaaagggcactcaagacagaggcttttccctcagttgcagtctgtgtctctcaagggcattctcttctcttgctttgtattccccatctgctttacaggccatttgccaagattagttgttaataataatgctacacaaatcatctgaagctcagggagcagtaaaatatgaagcttgacagctctggtgaggccagtttttggaagacttgtatgcttttgggagcagtttggccttgatccagctagaagtcagatgagcaaggccaagatgggagaagacatgcaaggaagacatttgtcctctgcccaaaagagtccacgtggtctgctcctagtgggagctgagagccactaaaaggggcagagggcctgggagtggaccacagaggcatgtgccttttgcactggcattgtgcagagacagtagatcacacagccagcgtatgagtgtggggactagaactgatgcctttgccacaacatgtgctcctgccttggtgctctgctgagtgcaagcaaaagtgggatccatgaggggaaatgtttaacagcagtttgaggtggaggaggccatgtgttataagggaaagttgattgatctgaaagtcaggaaccttgggttccttggctcttgagcacattatagacattcttgagtagaactaagatcttgaaagcccttctagttctgaaaactagtaatatagagaagaggtaggagaaaggcatggctaagaacccaggctctggaatcagactgcctgagctcaggtccccattcctcgatgtgacctaaggcatattacctatctcttccgtttccttatttgtaaaatggaaataaagtaatctattgtgatgttgttgtgtgggcacaaatgaggtaatacactgtaatgacttagcacaatgtgatacagagtaatcactcctcagatagatatcttaaaaaataattgggtcttgggagaggactggcctgtagggtctgatttgggagttattgtggtgtgaagcaatgtgatgtctgagtgtgatgagcgctgagagagcatgatttggggaaatcagaactttgagaggtcagtcagttcagaagtgtggaggaataggcagagccggtgaaaataacgagcctaggatccaagattttaaaaagtaggaaaatgtccagttactgaagccaggggaggagagccccagggaagggatacttggacagcgttgtccaaaatgtaggctggcaaagtggggatggggcaaaggccctgggtttgattgggtggaactagaggtccagggtagagctggggtatcctctgtctaccctcagtggtatcttgtgtccatatgttctaggggtagatgtgattaatggggccctcgagtcagtcctgtcctccagcagccgtgaacaatggaccccaagtcatgtcagtgtggcccctgctaccctcaccatcttgcaccagcaggtaaagagctggggtagaagtcgtggctgcgccttgccatagaggggagactgggggtgaggggaagagctgctaagatggatgtggaacacagtgtggggttggtgttcctttttaactgagttccctccatgcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatggtaagctactagtagggtggtgtggtggtggcgtggccccatgggaggtaggctggggagtgactgccctgcttgcctccgcagcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgctgtgtgccttcttatgcctgtaccacaccatcaacccattagcctgtgcctcagttatgatcttgctccaaagatctccttgccctgcttgcctggaaagaagaaattgggacagtcacacaggggtctggagtccaagtctcttatctttattttaacagactggcagcatcaggtcgcagcagcagtacagggttcctggctgggcagcacaggcctggggcgacagctcctgtcttgtctgcccagggcagtgtcaacttaggcctctactccatggctgtgaaaggacagcagcctcaaggcagtctagctcctgggcacaggcagccaaaccccctcccatatccagctaaaccagctccaggaaaggagaaggtcctgtttccccggcatccttggggcccagggactggttctttcaccggatgatcttgcctggttgaaccacagcagcatttgggctttttcaccctttcctacatcaagaactttcccaaatgtgggccctggggccctagcaaaacagtggccttggccacaggctctgggcctctgggaggctcccatctggcatcaggtggcggcacagagcagggctgtcagcacgggcagagagctgggcacaaagagtagccagacggcagggcgtgccacagggctccgagggtgggtggcccttatggtagagaaaccagaaggtctggaaaagttgcatgtcgccccgcatgcgatataccaggttgtgccaggcggtaggcagtgtgttgggcagcccataggtttctcgagccctgtagagaagctgccagtgcggtatggctcccggtatgtttgcctgggtcagattcaggatgtaggtctcatggtccaggaccacgtgagagctcccggagtagtttccatctatttggtacacacggtaacctgcaaggatgtggggctgactggaggggcaaggagcaagggtaactccagggaggggccacacatcctgcccatgctttgcaggctctggctccaacctccttcccctatcccaccaactccaggataagggaggctcccttctgcctcactcaccaggattaaggccgatgtaggtagttgcactgggtgccaggaaggctacagccagcggccggctcagagtctcttcatcatagaagacctcaaattcatccacatgagtgtggccaaagaactgagcagccagggtgttctcatacctggccagaaggtactacattcagaagattctagggaggggtaggaagacatctggggagataggatgccctctttctccaacctgttctagtgaggagcctccccactccatgggacaacagggatggtgagatgctcaagggaattttcagccttcagacactcaccctgtccctattcccaccctcatctccgtcctacctggctacaattcggtaataattccagctccagctcttcagacagtgccctgggggaatgtggccaattatatgcacctagtagggagaattaaggatggtaatcagggcatccaggggtccaggcagccctggctagagaaagggggactgaatgaaggctttcaacagtgaccatgagctgaatccccagggaacacttgttgggaatgccaggaaaataaaacttctgtgcccagaggtgctccagctcaacaggagcctgcttgtcccccagcaccaccgtgttcccactactggccctcactttgtctcctcgatcctcagcagcctgaagctcccccaccagccactggagctgtcctgcgggatccgtggagttgatcaagagccagaagttctcacgggaacaaaaattcatattgagagagatgaggcggagaccggggtatggggaaagagcatagaaccccccaattctgaaacaaagtaaacatgagaggtcaacacttgttccaatcctggtcctcctgtgctgggcatttgggtggagggtaaaagcatacatgacatcttccccacctgcaaggagctcacagtctagccagagaccaaacagttctaattattgggtctgtgtgacacaaaagactctgagggcagagggctccaggagtatgggggagggataagagttagctagaatgggaagcaaggaccacacagagggaagatgacatgggatggataaggtgggaaaaactggagcacttaaaaaaaagggggaaatcatttccagagggccaacatgagcaaagacacagctggggcatagagaggttatgctgccagacctttgaaggagggtggctggagataagagtagaaagggagggctggaaagctgggtgcagtggttcatgcctgtaatcccagcactttgggaggccgaggtgggcagatcatgaggtcaggagatcaagaccatcttggccaacatggtgaaaccccatctctactaaaaatacaaaaattagctgggtgtggtggcgtgcacctgtagtcccaggtacttgggaggctgaggcagaattgcttgaacccaggaggtggaggctgtagtgagctgagatggtgccactgcactccagcctgggcaacagagcaagattccatctcaaaaaaaaaaaaaaaaaaaaaaaaaaaaagggagggccaggagcagtagctgatgcctgtggtcccagcattttgggaggccgaggcgggaggattgcttgaggttaggtgtttgagaccagcctgggcaacatagcaagatcttgtctctacaaaaactaaactaaaaaaaaaaaaaaaaaaaaagcctggtgcggcaaaacagtagaaagggaaggaggagtcagattaggggagccaaatgaagagcactaaggactcatgctagagcaatcagagacaatgccccaggttcccttctcccttcactttcattcacctttcttttcccttcctgggtttccacggacgataagtacctgagggtgcgcagggcttcggcaggcagccagggctcccaagccttggccatcgcttcatagagccagcgggaggagtggttgccctcaatgaaggggggagggaagctattgacaggtgtgctttcatggttacccacagcagggtacactggcactggccccaggaacttcctcacaagtgctgtgacggtggtcagggcccgcagttggtcctgacgagtctggtgccagacatcatgtgcggggatgtctcctgtccagtacaccatatcaaaagggccggctgggcccagcccactcaacaggctctccagggtcctcaggggcaggtcacacttgctgtattcgccccagtatccggcacctggccgggatgcgggcggcaggccagaaccccggcggcagcacagtgggtctgcacagtcagggtccgtgccctccaggtagtcatgatcccagtgcaggtcagtgaggaagaggatgcggctgacaggggcacctggggctggggggctagggggtttggggggcggcttcggcacagtaggcaaagagatgttccaagatgagaaaatgtcccagtgcccacaggtggagcccaggagcaggccacaggcctcagatgggctcagcactgagcgtctccacacctccaccatgtcatcctcaaagaggtggacaatggattggcacacggcaggtggtgctatcttcagcagattgcacagcttgatggccacggagcccacgcgagccacattgggttccttctgcagtgggaggagcgcatggtgagaaatcagaggcagagcagaggaaccaggccaacccctggccaccaccccttgggcctccatttccaaactggggctgggcaggactcagtgcaccaagctcagtgcacacctttgccttccagatattgccctgtaactcaggcagcaccaggccatcgcttcttctttagctcagcggcctgtggcatgaggcctttgcttggcaagctgacttcctcaggcactgtctgcattattttcttacttcacaaaggtcacaatggggtgatggtggcatgtagccatgggtgtccccaaaggggagcaaactcagtgatggattgtagatgccaccctctccatcagggatgcattctgagcccagcgcaccagcatcagccccagcccccagccccagcactcctttcggcctcctccactgcagccccttcagtgctcaccttcagcccgaggttgatggcggtgaatagacctttgcagattgggcaggtgaggttcccccacccaaagacatctcggagccggggcactatgcgatgtaacctggcaggatggccttggggagaaagagggtgagcctctgccggagcccagagaacccgagagtcagacagagccagcgccagcgccagcgccagcgccagcgccagcaccaggcccatccaaaggagtccgggggctccggcggtcccgtcttgtccctgctcccggccggacctggggcagctctggcggagtgacgctccgtagcggggcattgtcgcgcttcctacacggggctggttcgtctgtcccgtcccccccggcctggaccctagccagccctcagggccccgggcggcgccggggacacccgattacccttctctgtagtcggctgactgctccgcggccggccgcaaagcagctccgccccttcctcttcctctgatctctgacagctgatctctcggtggcgggcggctgtcaacgctgcggaggcggagggggcggggcgctcccgggaccgccccgattccgccccctctccctgcccccgccctgccccgggcgcacgggctgcgggggtggggactctccctgaggtcaccaggggctccgccttgaggtcacagccgcgggaggccgtgctcgtgctttggagctccatgtgatgtggtcggtggaagacgtctcctttgtcagaatccgcgctcagattcccggaatagctgccagaccgaccccagcgtttagcccgggaaggggaggtaggagagagcagggcgggcaggatcctcccactgggtgtgttgcctctgacaggaaggcgccttccctcgattccccatgctctgccactggcaccagccctcttgagtcaccctgagaatcactcacctgtgattcagatgaggaaacaaaccttagagatggtgaagagactaggaagccgtaaagaccatatagccgtgggggccaataacatgggcgggaacccaattgggtctcccacctccgtgtatccacgacagtaaaagcgagcatttatggagttgtttatgatgtgccaagcaccaacccaggcactttataattaataatcttcaattctcacaacaaccctaagaagtacctattatattggggctcagaaatccatacccaaaatatggtggtttgacttactaagttaagccttaaggtgtgtctggccttcctactcccgcgccctctctcccaaagccgttacctagcgtccagacccatcaaaaggaacaacggtttttttcttcccctccctacaaaaccaagaatataatcacacctgaacagaccccttcacatgataatgtgctagttaatctgttccctgatccattccttctccctcagcagaattcctcttcccctcactcccacaaccccctttgcctgaatgacacctaagcttctgaactcgtctgggaagtgggtagtcactctgtggttccccgtggacacattaatacaatttctatgccttttcttcaattaatctgttttttgtgggttgatttttcagcagaatttcagagggcgaagggaaagtttcccttggtccctgcaaatactattattaccctcctttacagataggatgaggcacaaagaagttaagtggcagaatagcaattaaaccctaagctgtttgacgagtgcttctgaggaatcctcagagctatcaagtcctgtcagttctttcctttgataattttttacaagtgttttttccccccagttctggggacatcatctcagatagagtactcacagtaataattagcatgcatttttaagattatgtactatgaaaaacaaaacaaaacaaaacctttttatctaaggaagatgagcccctttaaattatcaggcccagacaggcatttaaaatgtagcaacagtcactctcactcttctttgagctaagtaattatctcttgaaaccacttgctatgccaagtagccattaaatgccatacaccttatagttcaacaatgtatagccaagcgctaaacaatgtataaccagtgttatttctgtaaacaatgagaattcctgatgaacaacttttgtattcatttcctctcctaattcatctttttttctttgaaaatatgagcctctcttttgttgtccagagtgctcccccaagacaacttgcaagtgtgtcctgggtcgcagtcctcaaccttggcccttggcccgaataaccctctgtaggtacttttctgaggactctgccttacgttaatcctcacaacaaatttggaagtcggtattataattatccccattttacggagaaggaaagtaggattaagtaagtggctcaagatcccacagctagctagtaagtgctggaactggaatttggatgtgtcaagcaaaacatgtctgagacaggtctcaatcaatttagaggtttattttgccaaggttaaggacatggctggaagaaataaacacggaatcgcagaaacagtctgtggtctgtggctttctccaaagatgattttgagggcttcaatatttaaaggggaaaagtgagctggagggaaagaagaagggtatggtaatccacatgtcgcaagagaaaaggagcaggtagggagatactcaattatgtgttcgtctggcactttacataagataaagtaaatatgcctgtggagatatttaaccttttgtgttttttttgtttttttttttttgagacagagttttcgctgttgttgaccaggctggagtgcaatggcgcaatctcggctcaccacaacctctgcctcccgggttcaagtgattctcctgcctcagcctactgagtagctgggattacaggcatgtgccaccacacccggctaattttgtaaatatttaaccttttgtctgtagctatctgcttaggaacaaaaggaaaggcagcttcttgcatgactcagttttcagtttattttttttccttttggcatagtcaactggagtcctgagtttttattttcctttcacaaatgcaacattctggctctattctttgctgtgtggggacccattcagaacaccagagttggtataacaattattttaagccgaagacatttcagattcaatagatgcagaaataaaccttctgggagctttcttcatctgattaaaacttctgggaaatgtcaacctaaagggaaaaatctaaggcaaacttgatataagtagagagtttatttgggccaagtttgaagactgtgaagcgaagattcaagttgccctgagtatatgctcccaattagcagaagtcacaagtgggtttttaaaggagaagaagaggcagttcctaatgaggactaagctctgattttttcttatcttgctcaaattcctatcgaaagggtctggggagtcatgccctacaaaccataaattcttatcagttgggttttatttaacactatatattgtgactgccttttcagtcatactctggcataaaattacgtgataaagaagaaagtcaaaatattttaccccaaaacatgtttctttgccatatatatatatatatatatatatatatatatatatatatatatgttttttggtttggggtggggggcgggacagagtttcactcttattgcccgggctggagtgcaatggggtgatcttggcttactgcaacctcccccacccagattcaagggattctcctgcctcagcctcccgagtagctgggattacaggcacccaccaccaccatgcccagctaatttttgtattgttaataaagatggggttttgccatgctggccaggctggtctcgaacttctgacctcaggtgatccgcctgccttggcctcccaaagtactgggattacaggagtaagccaccgcacccggccactttgccatattttgaaatggccctgcaaagtcgtaccttatgggggaaaatttacatctgtaaagaatctctaataacacagatctttttcttctgggccctccaatcctgaagagattaactgagagtctagcaccttttaaaggtctgaataggaaacatttgtcgactgttgtctctaagggcagccactaagagacttcaaagaaccttggtctccacaatcttttttttttttttaaaaatggcgtctcactctgtcgcccaggctggagtgcaacagtgtaatctcggctcactgcaacctccgcctcccgggttcaagcaattctcctaccccagccccccgagcagctgggactacaggcatctgccaccacacccagctaattttcatatttttaatagagatggggcttcacgatgttggccaggatggtctccatctcttgacctcgtgatccgcctgccttagcctcccaaagtgctgggattacaggtgtgagccactgtgcccggcctccacaatcttttatcttaacctgaacatttcctttctattgatcccaggtctttagacaaactcaaccaattgtcaaccagaaaatgtttaaatttccctatagcctggaagctccccatcccccagcttcagattgtcccacctttcttgaccaaaccaatgtatttctcaaatttatttgattgatgtctcatacatccctaaaatgtataaaaccaagctgcaccctgaccaccttgggcacatgttctcaggacctcctgagggctgtgtcacgggccatggtcactcgtttggctcaaaataaatctcttcaaatattttacagagtttcactcttttcatagacactaagttgttcaccaagaatttacataaaaataacataagctattgattggctatgccttgttctttgtatcataaatcccaggaatgtgaagataaagggtgaggcatgtctgactaggaacaaacaattgcaccccacttcttggttttgtgggagcaagggtgggggtgaggggtggagtgtatgactgaagtcccatactcatgtctctctgggcctgatacattttgcgtacctcacatagttcagagtgctctgagctatttttcttttatcagaaatgaagactgccatacataccctcttcagcaaggcttccactctgaggagggagaccaagagtaaactcaacataaatacccttttcagggaagtttaatggctctgaagaagacaggaagaccacacatgctggcatagaccacagcatcacacactttctggcctcatgtttgttcttttgaaaacccttttgtctttccttaagaaacctctttctcccctggaactttctcccctttccctttctcctactaagttagatgtgtaagccttttccttccttccttccttccttccttccttccttccttccttccttccttccttccttccttttttttgagacagagtttcactcttgttcaggttggagggcaatggcgtgatctcagctcaccgcaacctctgcctcctgggttgaagcgattctcctgcctcagccttccgagtagctgggattacaggcgtgagccactacgcctggctaatttcaaccatttgatgagccagctacttcttttgtggttccctgtgcatatgaataaacccttttctcctgttaatttgtcttttgccagtttaatttacaggcctcagccactgaacttaagaggatagaggaaaaggcttttccttccttatagctacttctttttcgtaactgtaggcttggatctgtaatcttcaaggattcaaattttggcagtaggaaaaggagggaggagggatgtcatgaacaaagtacaaggcatgaaagagcctggtaaatttgctatgaaacgtcatctcccatttccctatcagggatttcaagttgcctcatttctccgtaattgttactgtccattcaggacagtagattcaggacagagattcactctgtccttccttatggaggacactgatgaccccagggtccaaatttattgatcttcaaggccttagcacatacccagtaacaacatctttcctgatcacatcctcttttctcatttgctgagtcctcttttttttttttttttttttttttttgagatagagtctcgctctgtcgcccagtctggagtgcagtggcacgatctcggctcactgcaacctccgtctccttggttcacgccattctcctgcctcagcctcccgagtagctgggactacaggcgcccgccaccacgtccagctaattttttgtatttttagtagagatggggtttcaccatgttagccaggatggtcttgatctcctgacctcgtgatctgcccacctcggcctcccaaagtgctgggattacaggcatgagccaccgtgcccgacccgctgagtcctcttttatgcagtgttttcatacatgttgtttttgatagaaccatcacttgctgccatatcacacacccttatccttctggataggtgatcaaaagcccgtcttccctcaaaattaatgacactgttctctaggaatcaggttctaagacagagactaatgagagagaaatgtattagaaagtgctttttaaatgaacacctgtgaaaggaaagggaagaaagcagacttgggtaaatgagcaagttgatctgtgatgccgtcagaggtctcgttggaccccataggagcgctgaagctgggatgacccttcagagttgtcctgaaatgggatgagagagcttgtttcatttaggaaaatccctgtagggggctgaggactttctgttgagaccattctgagcagctataattgtccaacaggttctccttgcttgctgccaagacagccaacctatcaagataagaattgcaatagagagagtaattcatgcagagctggctgtaccgggaactggagttttattgttactcaaatcagtctccccaaaaactcggggatcggagttttttaggataatttggtgggtaggggctcatgaagtgggaagtgctgattggtcaggttggagatgaaatcatagggcgtcaaagtgagtttttcttgctgtcttctgttcctagttgggattgcagaattggttgagccaggttactggcctgggtggtatcagctggtgcatcagaatgcaggatctggaaaatatctcaagcactaatcttaggttttacaacagtgatattatttctaggagcaaggtggggagggtcagactcttgcagctgaatgctgcatggctcctaaactgtaatttctaatcttgtagctaatttgttagttctacaaaggcagtttggttcaggcaagaaggggccttatttcaggaaagggctattatcatctttgtttaaaagttaagctataaagcctcgtgcggtggctcatgcctataatcccagcactataggggaggcggaggcggttggatcacctgaagtcaggagttcgagactagcctggccaacatggtgaatccccatctctactaaaaatacaaaaattagctgggcgtggtggcaggtgcctgtaatcccagctactcgggaggctgaggcaggagaatcacttgaacccaggaggcggaggttgcagtgagccaagatcatgccattgcactccagcctgggcaaaactctgtttaaaaaaaaaaaattaagctgtaaactaaattccttcccaaggttagttcggtttacgcccaggaatgaacatggacagcttggaggttagaagtaaggtgaactcagttaggtcagatctcttttgctgtcataatttcctgttataatttttgaaaaggtggtttcgcagctaggtattgatgaaaagagtcaaactttgttaaatatttgaagagatttattctgagcccaaaaggagcgaccaatggcctgtgatacagccccaggagaccctgagagcacacgcagagcatgtgcccaaggtggtcaggttacagcttggttttacatcttttagggagacataagaggccaatcaatacatgtaaaatgtacattggtttggtccagcaaggcaagacaactggaagcagtggaggctggggtggggggtcggggagaggagcctccaggtcatagattcaaagattttctgattggcaattggttgaaaagagttattatctaaagagctggaatcaatagaaaggaatgtcggcagggcgtggtggctcaagcctgtaatcccagcactttgggaggccgaggcaggtggatcacctgaggtcaagagttcgagactggcctggccaacatggtgaaaccccatctctactaaaaatacaaaaaattagccaggcatggtggcaggtgcctgtaatcccagctactcgggaggctgaggcaggagaatcgcttgaacccgggaggtggaggttgcagtgagccaagatgggtccattgcactccagcctgggcggcaaaagcgaaactctgtctcaaaaaaaaaaaaaaaaaaagaatgtctaggttaagataaggaggtgttgtgagaccaagatttttgtttgttagtttgtttttgttctgttttgttttttgagacagagtcttgctctgtcacccagggtggagtgcagtggcacgatcttggctcactgcaacctctgcctcccgggttcaagtgattctgcaacttccgcctcctgggttcaagtgattctcttgtagctgggattacaggtgcctgccaccatgcgtggctaatttttgtatttttagtagagatgggattttgccatgttggccaggccggtctcaaacccccgacctcaggtgatccacccgccttggcctcccaaagtgctgggattacaggcgtgagccaccaagcctgacccggagaccaagattttatcatgcagatgaaacctccatgtatcaggcatcagagcgcttatcagacctaaacaggtgccagactcttaattttctcctggatcagaggagagacctggagaaaaaaagggattgtctacagaatgtaggttttccccattaagatcttttatttatttattatttatgattttattttttattttttgagacggagtcttgctctctcgcccaggctggagtgcagtggtgcgatctcggctcactgcaaccttcgcctcccaggttcaagcaattctctgcctcagcctcccaaatagctgggattgcaggcacctgcccccacgcccagctaatttttgtatttttagtagagacggggtttaaccatgttggccaggctagtcttgaactcctgacctcatgatccacctgcctcggcctcccaaagtgctgggattacaggcgtgagccactgcacccggccagatctttttaaatgttaatgctcgtcacttgttcccaattctgagagagaagagtatgatgaggcatgtccaatccccactttcaatcatggcctgaactagattttctggtttagtttggaatgtctttgggagagaggggactctgtcagttggttgggggagcttagaattttatttttggtctacatgggggaataagccctttgttcctgaaggcaggtcaggtggcacatcacagtgtccaccacagactacctcttgtgccacttggattcatttcacagaagtctggaacagctcctctagcatactaatgactaatgagtctctcttcatggtggaaattagaagaaagatagtggaaagaattatagctctctgaagcctctctcaggacagcaactgatactcatcattttcctcttttatccattttagctttccttcacccttagagagcacctctgctgatttcagtggcttacctgatggtgtaatgcaaactttctccctggggggtctgagcctcactatccatgctctcctcaagccatgctcctgcacttgtctttttaccatcaaaatagggcagggactaccaagaggcacccaagtgggccagctggatgccaagcatattcccccatgtctccattttgtaacagttgtattatcaggatcaacaatgacaatcaggatcaacgctacagccaccatgatcatgcctcttcttgcctgctggcccctgcacgcaggagcccagagttcctaggcaacaaccataacccattcacctgctggacacatttccccattgggaatcagagcctctaaagcagcagagcctagagttgtaggggcagaaagcacaaatttcccaagtagattcctgggagtgatggcgaacagagccacgcctgctttctctctttggttctgaacccatgtgttttaccttttgggaacagaacaccaggttgttggtttaaagtgtatactgcatgctagaaggtggcacctcctcctctctaggaattacttccatgtttgtgcttcagctgtgcatctacagctgattctatcactgtgttaggctggcagtttctgggtggtcggctgtaatgtgaccagtggacacaaaagtcatgtgcccgctttacacctcttttgctgaaaagtggttcctggtacgacatgataggattccgtacctgttgctcagacactgtctctgtaagcccttggatagtggttgaggcctaggaggtgggaaaattcattatgaacaaagttttctgcagggctggtagtgggaaaggtgagacaaccttattcttgactttctctgggttttagaacttctgaaacctattgtgcaggcttctaggctattggataatgactagaacttggggaagggagagcaaggctggtgtttaaagatctaaagttatacagcctctgcctcagtggcgaactgagtccctggcttggagagtgattggcagagggacaaaatgggctgcttggttgggacagataacttcttagttaatctgggttaatttaagcagacattcgcttagggtacttacattttgttgtgtcaggaaacctgtacaaacagctgagcacggtggctcacgcctgtaatcccagcactttgggaggcctaggtgggcggatcacctgagatcaggagttcgagaccagcctcaatatggagaaaccccgtctctactaaaaatacaaaattagccgggcgtggtggtgcatgcctgtaatcccagctactccggaggctgaggcaggagaattgcttgaacttgggaggcggaggttgcagtaagctgagatcagaccattgcactccagcctgggcaacaagagtgaaactctgtctcaaaaaaaattaaaaataaaaaaaaaggaaacctatacaaattctgttcaagtggccagccaattcttgagctgtctgtgaaactgcaaattgaattcgaaattccagacagcagcccagcactgatggggaaaggtctccctcttgtggaaattttagggattactggaaagctagtaatctatacctttaagagctcaaatccagaagaaatttttcttgacaggcaattccaacgcagtgtatgtagaacccccaatagtaggggctgcaatttaaattcaagctatctggattagaatctttgttctgccacttattagttgtgtgacctggacaaagcacatcactttttgagcttcaatttctttctgtgtgacatgaagataatagataatataaggttgtgaagttacaatgagacagtacttagattaatagatgtgacagaggaagacttttagtatctgatgcaaacttttaaagttgcatcttatatttcattaccaactatacagaatctaccaccttatacatagtagatgctgtatctgtattgactatcattgatttaatgaggtctagctgataactctccccagttttccatgccttatccacactgtccattgacaggagagaggaaatctatggttacagtgaggtggaggctgaaggaaaagttaaatgttaaaaactgcccttcgccaccccgccctgtggaagacgtagggagtatttacttaatgacaataacttagctccatctattgtcaggaaatcatccatttattcccacccaccgccgccaacacacacactgttctgtgtcaggcccagaccaagaagctggggatatacctgttagtaggaaaagccctgccctacagaagactccagctcaggagaggataggggcaagaataacatacttgcctcaccccatcagccagcatgaggaagcaacatagaagctgtcccctgcagacctcctgtcaacagtcacgtgagcacccaatgtcaccagtgttgacagatgatcttccagtcgttcctgggagaaggctttccatccgcagctacctacatcttatataggatgaaggtcacctctctgtgtcctgagatattgccacactccaaccacactgtctcatgtggacattcacttaaaacgactcaggatacttgtaagctccactgaagcagtcagatctttgacacacaggaaggggagtgtaatgtggaaggaagtgtctcagccctgtacttgggtaggctgaacaagggtgaaatctagtcctgaaacctagacagttttacatttttttttctttaccatctctattctctgaagaagctaatccttgggaggatatttttcagcttccaaacagaaattgaactaggaaaccaatatatatggttgtgcatgcacatttgtgtgcacatgagtgcatgggtggtgtggtggatgggcaccacccccaatgcaatagctctctgacttcatcaatgcatccagtctatcttccttttctctctgtttacccacctgctcctggcttcctgtctgtttaaaataatactttataatctaacattatagtaattcctttgcagatatgctcagctcctgtgttcccctctcctctgtcattttcatctggctgaactccagtctcaaatgatcccaattactttcattttcttcttctgaaccagagtagctgaaattgttacagcaaattctatagctagaaaaagtgatataaggccgggcgcggtggctcacgcctgtaatcccagcgctttgggaggccaaggcgggtggatcacgatgtcaggggatcgagaccatcctggctaacacggcgaaaccccatctctactaaaaatacaaaatattagccaggcgtggtggtgggcgcctgtggtcccagctactcaggaggctgaggcaggagaatggcgtgaactcaggaggcggagcttgcagtgagccgagatcgagccactgcactccagcctgggcgacagagcgcgactccgtctcaaaaaaaaaaagaaaagaaaaaaagaa

SEQ ID NO: 36219 - DNA, 4278 bp, Homo sapiens
gcttcctgcggccagcccgggttcaatcagcggccgacaactgtctagggctcagacaccaccagccaatgagggagggcagcgtggagccgcccgtctgggctcgcggctcctggaccaatggggaagtggcatgtgggagggcgccggggggccccccgccaatggggagctacggcgcgcggccgggacttggaggcggtgcggcgcggcgggtgcggttcagtcggtcggcggcggcagcggaggaggaggaggaggaggaggaggaggaggatgaggaggatgtgggccacgcaggggctggcggtggcgctggctctgagcgtgctgccgggcagccgggcgctgcggccgggcgactgcgaaggtgcgggatagggggccgggggccgcgctccgtgaccgttctggcggcggcgctgaaccccacaacatcaccagacggccggggccaagagggcgagggcgggggcgggggcgggggcgacagcaggtccccgcggggcctgcatgaggaggctccggcgcccgccctagtaaatctttcttgggcctagaaaacattggtccgacgaagaaaagttgagactagatcccgttgaaaacttgtcctgaaatctccatcactcctgagttattgtccccaccaccatctagaggttaccgctccccgttcggcgtcgggagctccagggctggccgtgggtgctgcgccctgtctgttgggatcacgaagctgcacctctgggtccgctgttgtatttggaaattagcagcagcattttgatcatttttctcttcaccttccagtctctccatttatgaggtcacagtgagtcccgtctcaaggacacgtgttcaccatgggcttaaacttgatgaaaggagcagggagaagtcgtttataggtcattgggtgatgcttggtcctttgatgccctgggtgtaccaggggacccccgccacttggaaccgggttctgtctacctgtagacacctgagaaaaatcggtgatggaaaagctcacctctaatgattcatctccgtgtctcctattaaaattgctggcggagttcttttctggtggattggaacagcttggtgattgctgagcatctcccgtccctctcttttccagtttgtatttcttatctgggaagattttaccaggacctcaaagacagagatgtcacattctcaccagccactattgaaaacgaacttataaagttctgccgggaagcaagaggcaaagagaatcggttggtaagtagctggtgatcctccccaactggccctggctcatgttaaccctcggcttcaccagccgtttgataaaaggccttgcccacctctctgttcaggaagccagctactctctccataaactaatgtgagaagactgaagtgcttctatgtccttcccaaagcagcatgtgttctgcaactgtgatttttttttatcctgttagtctttattaagcacctactatgtgctaggcactgggaatatcaggggaaagaagtgacagtcggacacacaaataatgcaatgtctgggtgtcatgaagaaaatggaccagcaggtgctgatttagagtggccaagaagtctctgaggaagggttatcattgaagtggggtaagaccatcccatacagggaacagcagtgtgagtgcccagaggcctgaaagagtgtggcatgtatgtggacaggagaaggtgacagggtgcctacaggataggcaagggccgaatccaagacaaaagccctagtgaagcaatgggttttctaacttgaatttctctgacagtctctggcttttctctctgttaaaggtttgaaccctggtgacacttaaattcatttggtggctgtcagcttggactgagcatgtgttaagagtccagggtttacactggctgaatctgactaccagtacaggcagggcaccgaaaaatgccgctgtgggccaggtgcggtggctcatgcctgtcttcctagcactttgggaggccaaggtgggaggattgcttgaacttaggagtttgagatcagcctgggcaaagtggtgaaatcctgtctgcacaaaaaaatttttaggctaggcgtggtggctcacacctgtaatctcagcactttgggagaccgaggtgggtggatcacctgaggtcaggagttcaagaccagcctggccaacatggcaaaactctatctctactaaaaaatacaaaaattagccaggcatggtgacaggcgcctgtaatcccagctgctcaggaggctgaggcagggagaattgcttgaacctgggaggcggaggttgcagtgagccgagccaagattgcgccactgcactccagcctgggtgacagagcaaaactttatctcaaaaaaaaaaaaaaattgttttagttagctgggtgtggtggcccacaccggtagacccagctactagggtggctgagaggggaggatcaccacccaacagattgaagctgcagggagccgtgatcatgccactgcattccagcctgggtgacagggagccctatctcaaaacacaagtaaggccctacagagagatgatgtttcaaggtgtcagtatgtttggaggagatggctctcaagcacctcctgaaggccattgtcctttattgctccagtgctactatatcggggccacagatgatgcagccaccaaaatcatcaatgaggtatcaaagcctctggcccaccacatccctgtggagaagatctgtgagaagcttaagaagaaggacagccagatatgtgagcttaagtatggtgagtatgcctagtcctttcttaatgaatgctgtgcaccttctgggtttgtttcccatctgggagaggaaaatgatgagctagagtcatgagtgggttgtattgtatgacagatggtgctaaatgctggagggctctggcatggaagtgggtggaggtcagaataggccttattgaagaagtgatatttcagcaaactttgaaggaggtgaggattagccaagaggccagctaatggaagaggatacaggcaggataaaggtgtccagtggcatggcaagtcagagagcattgcaggctggtgagggcttttaatctgcgtgaagttaggagcattaggagtttttcagcagagaagggacatagtacgacttgggtttaacaggctggttctggctgcaagctctgaagccccagtgatttttactattctgaaaagaaacactatgtccaagcatgcaagcccaagagttaggaactacagcatctctcttgctgactgggtctctggtgtacatagtcccagtcttcagaaacagtcagggcctcttctgaaaaacttgaatggccaaggacctgtgttcacctacttgcgtcttcctggtacaggtccagttggctccaggtcactgtggtcatggagagtaagttcctaactcaaaggcctgagcagggctgctctttggcaccagcctggagttgttagtatgtggtgactatgtcagaggcacttggaagatgggaaccatgtttctcctataaggacagtgtggcctctgtccctatccttgttcacgctgcatatctgtagtagacataatatgtagccagccttcctggtgaagaggctagttccctcttgtgggggcagtaggcactgacatgcctgtaaatgtgtctggaaatgtctcttcctctgaaaccagtagggctggtttggccgttcagggagtgacatactctgggactactgggggactgcaggtgctccacccagtcagtgactctccctgctctctcctccagacaagcagatcgacctgagcacagtggacctgaagaagctccgagttaaagagctgaagaagattctggatgactggggggagacatgcaaaggctgtgcagaaaagtctgactacatccggaagataaatgaactgatgcctaaatatgcccccaaggcagccagtgcacggaccgatttgtagtctgctcaatctctgttgcacctgagggggaaaaaacagttcaactgcttactcccaaaacagcctttttgtaatttattttttaagtgggctcctgacaatactgtatcagatgtgaagcctggagctttcctgatgatgctggccctacagtacccccatgaggggattcccttccttctgttgctggtgtactctaggacttcaaagtgtgtctgggatttttttattaaagaaaaaaaatttctagctgtc

SEQ ID NO: 36220 - DNA, 104262 bp, Homo sapiens
gcagcgggaggaagcgagaggtgctgccctccccccggagttggaagcgcgttacccgggtccaaaatgcccaagaagaagccgacgcccatccagctgaacccggcccccgacggctctgcagttaacgggaccagctctgcggagtaagtatggggcgggcggtgaacctcggggcccggctggggaggcccgagccggggagcaggagcgcgcgccaggctccgatctggtttgtcacgtacgtctggggctggcagggggcgagaaactcccggccgccgaggtatcggtgactaagcactgattgtgttcctgactcagaccagttagcggatcccgcgggtctccattcctctctgtaccccttttcccgaccgttttagtggttcctggccactgtacagtcttctcccaagaaaataaaagctagcacgtctcccctgcctcctcccagttctgttctaaatgtgatcatctgggagtctggcctgtaacggggagaggaggctaatgttttggaaagaattaagatcgcatctgtgcttttgagaccagctcagggtattaagtgtggagcatcatcctcaccttcatgcctgacacctgtggggcctgagtgccttgttgcaggccaactgcctggccagcgggggcgtgctggaagtccgtgtggacttcgtggcttttccttgctgactttggaggttcctggtacttggccttcctgggaaattgctcaagaaagcggctttcttcttcatcctactcttcattcattcattgaacaaaccattttctcactaatgatttcctagctttccgtacttcaccaggagcccctaaactcctgacctgaggcatgaacaccatgacctagaaaccacatgctaggtgctccatctctgcagcttccagcgttgcttacaaacgagcactttatttcattaaataatcatgagtctgtttcctgggggtttctgagctcccacaactctcttgggttctaggtaagggacaagactatgtgagggaaagctgcttagctagctagagaaatagccagaaaagattaggttattattatttttttgcctttttttggttgttgtttgcccaaccttcaataaggattgggttcttaatcttttacctgcacactgcagactttaggaagctaattgatgaaatcagaataggcttggaccttatgctctttggtgatttctgtaacctcccttcctttctctagatttttagaaaattttattttttaaacttttatacagatggggtcttgctatattgcttaggctggtcttgaactcctggactctagcgatcctcccaaagtgctgggattacaggcatgagccactatgcccagccaactttctctagattttaataacccggggacctgttggcttgatgacttgttccatccctgtaatgatcacaaggtcgatggtggacctgtggtgtgtgttcagctgtgtttttcagacctgctcccaacagactctcttctttagtcccctctcaatcctgtggggtctattttgcataatactgacttgtataggtagttggattgcattattgcattgcaaacatttgttctttttttttttttttttttgagtcggagtttcactcttgttgcccaggctggagtgcaatggtgcgatcttggctaactgcagcctctgcctcccgggttcaagcgactctcctgcctcagcctcccgagtagctgggattacaggcatgcgccaccatgcccggctaattttgtatttttagtagagatggggtttctccaagttgttcaggctggtggcaaactcccgtcctcaggtgatccacctgcctcggcctccgaaaatgctgggattacaggcatgagccaccgtgcccagcccatttgttcagttttagtatacagtgtttcaccctcttaaaatagactgaaagtcatgactgttgttaggacaagttttgaccacagtggattctggctgagtgttatggcctcattatcctttcctatttgatttggaagtggatactgagtagaagtacctgttatcattctgttgtaatcgtgataccacaactgtattctctcaaggaggaggaatttcattaaaacagtaaaagcaggatgagaagaaactaccccagatttggtggcagaaaaatttggatggtactgggagagtctaaacagtggttaaaaggtaagggctctggagtcaggctaagtttgaagcctagctctgttgtggttttttttttttttttttttttttgacagtctcgctctgttgcccaggccagagtgcagtggtgcgatctcggctcaccacaacctccacctcccggcttcaagcgattctcctgcctcagcctcctaactagctgagactacaggcacgtgcaaccgtgcctggctaatttttgtattttaatagagacagggttttaccctgttggtcaggctggtctcaaactcctgacctcgtgatcctcccacctcagcctcctaaagtgctgggattacagcccggcctctgttgtggttttgtgacctggttcaagtcttttagtctaaggcttaggtttagtttttttcatctgcaaaaatggggctaatgatagaacctacttagcatagttgtgaagattaaatgaggtagtacatagtaaacttccaaagctgttggctgctggtgcctttgttactgcctaagtgttggaccaaaggaaactggaaggtgattttcattcatggtggtagattatgtgttaaggtgcctttgcttctggacaatcaactctccctagtttggttttttgtaccatctgcatctacctctatgactcattgctgtgttacaataggaggcatctttgtgtaggctgcccaagacaaacagggactgtttccctgtgtttcatagcactaatgagagggaaagctgtacacatcttcatctttcacttctgagagtgttcctcaagcaaaatgttccctatcttgggctaccagcagaaagaattctgttgctttcatgatttctgtgattagaccagggcacaattttgaacgttatcagacaatgtgaactaaagaggaagaaaatccattttgacagtaaagaactcttggtaccaaattggcaaggttgcttttcccttggcacctgtgcttacctctaacatagcccttacccagttcagagatggagttgggtaatacgggacctgaagttgatgcaagttgtaggggtcctcaaagaaaaatcatgcaaaaatagctttcttttgtgtattttgcagaaacatgtgagcatattactagggtcttaagtgttagaatgagataatgagataatattgttcctctgtttaaaatgttcttctggttctattgcagttacacaaaatccaaactccttatattggactatgagactgagtgatctgcctgttgtccccaccaccccctcccaccaatctctttaaccacatttcctgccactcctttcttccaccacactagtcctctttcacttcctctatgggatggtctatacgcactgcaggcctctgtacatgctgttccctttgcctggaatgaatcactcctccttccctaggtaggcaggaagcagtcttcacctatttgcctaaatgtcacttcctctgagatgtttataagcatctcagaggaatgtggtccctctttgtcatgtcacctgagctgctgcttttttttttttttttggtatgggggtcttggtatgttgcccaggctggttcttgaactcctggactccagtgattctaccacctcagcctcttgagtagctgggactataggtgggtactactgtgcctggcgctcacctgagcttttaataagacttaatcattgtaatttttcattggggtgttcttaatatttatctctcctgtacactataaactttaagcacagcactgcctttttgttttttgagacggagtctcgctctatcgcccaggctggaatgcagtggcactacctcggctcactgcaagctccgcctcccaggttcatgccattctcctgcctcagcctcccaagtagctgggactacaggcgcccaccactgcgtccagctaattttttgtatttttagtagagatggggtttcaccatgttagccaggatggtctcgatctcctgatctcgtgatcccaaagtgctgggattacaggcgtgagccactgtgcccagcctgcactgcctttttttgactcaccactctgtaagtacacccaaaatagttctggcacataataggtccatagatgtttgttgagtcagtgagtgaatgaaatttctaatatttgcacaacgggtttaataaacctttttatgtcttttccttttcttttcccctttatgctcattccttttttccccattttcttttgttttagtcacccactcaaccattctaagatatttatatggttttataattccacctgttagtctggttatgtgtatacccttgggaagtagaaggatggttttgtatgtatctgcttaggattctaaaatgttattgtgctacaaatctgcatttcatagacaggatagaataggttatgttgaggtaacaaccacaaaatctcagtaatttaacacactttcaggtcagtgggaggctctgtagattggagtcctttagggatccaggctgatcgaggcatcgtctctcaagtatacctacatgaggagggaatcttgtgaagagctacattcaggctcttaaagttttgcctagaggtgagccttgtcatttttgctgccatttctttggccagagcaaatcatgtggccatgttgaccttcaaggagggcagtgacctttttggaagggggagaaccacgaatatttgtgtgttttttttgggttttttttttttttttttttttttaagaaagggtttcgctcccactgcccaggctggagtataatggtgcgtgccaccacgccctgctaagttttgattgttttgtagagatggggtttcaccatgttgctcaggctggtcttgaactcttgggctcaagcgatctgcccacctcatcttcccaaagtgctgaaattataggtatgagccactgtgctggtgcaccaggagtatttgaacagaagcaatgaccatccctaaattttatatcagtttcttctttgttttcttttcttttcttttttttttttttttgagatggagttttgctcttgttgcccaggctggagtgcaatggcatgatctcggctcaccgcaacctccgccccccaggttcaagctattctcctgcctcagcctcctgagtagctgggattacaggcatgtgccaccgtgcctggctaattttgtatttttagtagagacagggtttcaccatgttggtcaggctggtctcgaactcctgacctcagatgatccgcctgcctcagcctcccaaagtgttgggcttacaggcgtgagccaccatgcctggccttagtttctttttttaaccaattttgttttgagctctattcatgatgctatacaatatgtgtctagttcattatttctcttggttgtagagcagtcatgtttgcctgccacattttacttatttatttctctagaattagacatctttgttgtttcccaaccccttgctgcctcaaacagtcatgaccatgcccatccttgcacatccttgtctcctttggatgttgtgagagagtttcctgtggaatgtactcagaagtggaattgctgggtcttagggtacattgtctctccttccaggataaggcatgttatctctttctctctctctttttttttttttgagaccgagtctcactctgttgcccaggctggagtgcagtgttgcaatcctggctcactgcaacccctccccacaaggttcaagcaattctcctgccttagcctcctgagtagctgggattacaggtgcctgacaccatgcccagctaatttttatatttttagtagagacagggtttcattatattgctcaggctggtctccaagtcctgaccttgtgatctgccctccttggcctcccaaagtgctgggattacaggtgtgaaccaccgcaccggctattaatctctttctttaaaacaataccgttaatccagttgcagtagtgaggcagggtacctctcaagatctcactttttctttgaccttgggcaagtcctttctactttctgactcttggtttccttaatctgtaaagtggaggtgataattgtttacaaaatctttaccatggtggcctacaaggccctacctgaccaggtccttagttttcttccagtgttctcttcactcatgcactctagccacactgtcctttgtgctgttgggttgtaggttgggcacattcttatcttagaatctttgcatttgccattcctgctgcctggaaagcttgtctctcaaataccgtatgacttgcttcctcacttccttcacccctctgttgaaatgtctcttcacagaggccatctttgatcactgtaatacagaactccctgtcattttctaccctttgattttgccttatttttctttgtagcgctgatcactaactgatgttacatcgtgtataagtatttatcttcttctgccaccccaagtgtaagcttcatgatggttggggctttgccttgttcattgctcagtgtgtagaacagattctggcacatagaaaatactcagtagatacctgttgattaaatgattgactagatcctacctcagaggaatacctttgaagatgtataaaatttctttgaaggctataaggtgccgaataaccttaggagggttcactgcttggccttagtagcgttcatgattttggattttgaattgtttctatgtaaccctgaaacactcagacttacttattgcattcagggtgtagttcatagcatcagcagttctgccaggtttgtaaggaacacacatctgttagagtgtgaaggccctggaggaagaaaggttgagacaggttgatgtgcttttttttgtctcttatggctctttctgagatgtgtaccatgatgataaccaggaactttttttttttttttttttttgagagacagggtcttgctcagacactcaggctggagtgcattggtgctcactataaccttgaactcctgggttcagggaatcctcctgcttcagcctcctaagtagctagtactaccggcatgtaccaccatgcctggctaattttaaaatttagagatagggtcttgctgtattgcccaggctgggctcaaactccttgcctcatgcaatcctccctccttggcctcccaaaagtgctgggtttacaggcatgagccaccatgtctggcctgataagtaggagcttttgaagtggtttcacactgattttgtagttttgaacttggatgcttcttttgggtagttgatgcagtaactaatactggtgctgtctttcagaacagcttcatgtgaaaaaggcctgcttaagcctgtgtctttgggaagaacatctctgccgctgttacagcagatacagtaatagcaaagaaagtcttaaagatgatttagcccatggcaaggaaatatatgggactcttgtttgaatataaacactcacagaattccagtttcacttatttatgcacctttcaaagaaaggaagaagatactgtggtagagtacagtagtcctcccttatctgagtggcatatgttccaagacccctagtggatgcctgaaaccacagatatcaatagtaccaaaccctgcatatactgtgttttttcctatgcagtatatgcctatgatgaagtttaatttataaattaggcatagtaagagattaacaataataaccaataaaaaagaattataacaatatattgtaatgacagttacatgaatgtggttactgtactcactgtgggtaactggaattgtcaaagcaaaactacatttaagtgggtactcctgtagctgttggccctgccttgcctatctagcttaattttcctctgtttttccgttcacctgctgtggtccacttaccactttctttactctcctcactgtgccaccagcatactgttgcttaccttcttacatctgtctggtcttgctgacatggtttttttttttgtctgaaatgccctcctccactttcttgcatgatttttttttttttttttttgagacggagtctcactctgtcacccaggctagagtgtgcagtcacatgatcttggctcactgcaacctctgcccactgggctcaagtgagtatcgtgcctcagcctcccgagtagctgggattacaggcgcacaccaccacgccgggctaattcttgttatttttagtagagacggcgtctcaccatgttgcccagcctggtctcgaacccctgacctcaggtgatccactgcctcagcctcccaaactgctgggattacaggcgcctggccctcttgcatgtttttatttttgttttatacttgccactacactttaacttctgtgaaaacagggactgtgattgtcttgtgtactggtatttctccaccgtctgctgtggggcctagaataaaataaatggtacccatcttttttgttttgttttgtttttggagatgagtctcactctgtccccagactggagtgcagtggcgcgatctcgcctcagtgcaacctatgcctcccgggttcaagcgattctcctgcctcagcctcccaagtagctgggctacaggtatgcgccaccacatctggctaatttttgtatttttagtacaaaatttaaaaatgatggcctcgatgtcgtgatccgccctcctcggcctcccaaagtgctgggattacaggtgtgagtcaccgtgcccggcccttttgtttttttgagatggagtttcactcttctcatccaggctggagtgcagtggcatgatcttggctcacggccacctccgcctcccacattttcctgcctcggcctcccaagtagctatgataacaggcacacaccaccatggccggctaatttttttatttttagtagagacaggatttcaccatgttggtcaggctggtctcgaactcctgacctcaggtgatatgcctgcctcagccccacaaggtgctgggattacaggcgtgagacaccgtatctgccccggatggtaccgatctttcaagatcttacataaagcttatctccaatgtgtgtagtcttttctgagcaactccatgccatgctcagttacatcactccctacttagttataatagttcttttttctttttttgagacagagttttgctcttgttgcccaagctggagtgcaatggcgtgatctcggctcactgcaacctctgcctcctgggttcaagcgattctcctgcctcagcctcccaagtagctatgattataggcgcacaccaccactcccagctaatttttgtatttttagtagaggcagggtttcaccatgttggccaggctggtcttgaactcctgacctcagttgatctgcccacctcggcctcccaaagtgctgggattacaggcatgagctaccatgcctggcctgtaacgcttctttttttttttttttttttttttttttgagatggagtcttgctctgtcgcccaggctggagtgcagtggcacaatctcggctcactgcaagctccgcctcctgggttcacgccattctcctgcctcagcttcccgagtagctgggactacaggcgcctgccaccacgcccggctaattttttgtatttttagtagagacaaggtttcaccgtgtagccaggatggtctcgatctcctgacctcgtgatccgcctgcctcggcctcccaaagtgctgggattacaggcgtgagccacggcgcccggcctgtaacacttcttaatggtgtgacctcggtcatatcacttaacctcactgagcctagttttcctcattagtagagtaaggctggtaataagaaacccatgagggaagtagggtgggagagcatcatccaaaataacatacacggaagcactttatggggaggcaagagtgggaaaagaaaaaagcactttatgatcactggaatgctatgcaaatggatgtgttaatgatgccggcttttgatttcttccttcttagaaggctgaatggttccttttgttcttaatagcaaattgtaaatgttgataaatcatgttgatttagatatttcatacgctgcttgtccttcaaatctagcccaaacctacatctaatcaagcctttagacctaacttcctgtttatagcaaatacggggatagaggaatgagttaatggcaccaagaggaaacaatcagacaaacctaggatgtggaacattctctaagacaactgacctagtctcttaaaaagtcagtataggccatttgcggtggctcacgcctgtaatcccagcacttcgggaggccgaggcgtgcagatcacgagctcaggagttcgagaccagcctggccaacatagtgaaaccccatctctactaaaaatacaaaaattagccaggtgtggtggcacgtgcctgtggtcctagctacttgggaggctgaggtgggagaattgcttaaatccaggaggcggaggttgcagtgagccaagagcatgccattgcactccagcctgggtgacagagtgagattccatctaaaaaaaaaaaagtcagtataagggtgggcatggtggcacacacctgtaatcccagcacttgggcacttggggagacctgccaagtcaggaggattgcttgagcccaagagctagagaccagcctgggcaacatggtgagaccttgtctctacaaaaatacaaaaattagccagatgtggtggtgcgtgcgtgtagtccctgctatttgggaggctgaggcgggaggattgcttgagcccaggtggcgagattgcagtgagcggtaatcgtgccactgcactctagcctgggtgagagtgggaccctgtctccaaagaaaaggtgatatcaagggaaaaaaaggagagtggtgctgttctaggataggagactaaggagacatacagatcaaatgtactgcatgggttgggcatggtggctcacacctgtaatctcagccctttgggaggctggggcaggaggatcatttgagcttgggaggtccaagctgcagttagctatgattgtaccactgcacaccagcctgggtgacagagtgagaccctgtctcaaaaacaaaacagaaaaaaaaatgtactgcatgaatcccaattgtgtaccggatcaaaaaatagttataaaatgcattgttgagacagttggggaaatgtgagtagagtattgctaattttttttttttctttttttttttgagacagtctcactcttgtcgtccaggctagagtgcagtggtgcgatctcggctcactgcaacctccgtctcccgggttcaagtgattcttgtggctcagcctcgaagtggctgggattacaggcacgtgctaccatgcccagctaatttttgtatttttagaagagacggtgtttcaccatgttggccaggctggtctcaaactcctgacctgaagtgatccgcctgccgcggcctcccaaagtgctgggattacaggcgtgagccaccgtgcctggctgtattgctaaatttttaatgtaatgatggtacagatattatataggagaattcatattcatacataatgcacaaaacttactctgaggttcaggaaaaaaactcaaacatacacaaacagtggataaagcaaatggaacggaatgttcacagttgttttgtttagttagagttttacttttattctttcaatttttctgtatgtttgaaaaaaatttgtaatacatttaaaaagtaccccaaaagcaaaactcattccaagtcttatgtactttaatgtcaactaatatttgctctttcccatccctagattcctttgtgctgcttgtctacattgtatgataaacatcacattaaatgcaatctctcccctcccaccccctctttttttttgagataggatctcgcttgctgtgttgcccaggctgcagcgcagtggtgtggatcgtggctcactgcagcctcaccgtctgggctcaagtgatccctccccagagcctccacttcccagtacccgggactataggcacgtgccaatacacccagctattttttttcactctcgcccaggctggagtgcagtggcacgatctcatgtcactgcagcctccacctcccgggttcaagtgatcctcctgcctcagccttctgagaagctgggactacaggcatgtgccaccatgcctgggtaatttttgtatttttagtagagatggggtttcaccttgttggccaggctggtctggaactcttgacctcgtgatccgcccacctcagcctcccaaagtgctgggattacaggtgtgagccaccatgcctggctatcgcccagctgtttttgtatttaattttagattcagggggtatatgtgcaggtttgagcatgatgctgaggttttggcttcttgcataagtactttattatattactatataatttttattcactaaatctactttatgaatctttttcttattaggaaacatactttttttgtgtacagtgtacaattgaatgtacagcattgctgattcgatatatcattattggtagatttgagaacaccaaaatacatttaaacaaacaaactagcaaaaaaaaaccttttctgctggcttttcttttcttttcatttaagacaggttctcactctgttgcccaggctggtctcaaactctttggctcaagcgatccacctggctcaacctcccaaagtgctgggattacaggtgtcagccactgtgcccagacactttctctttttttcttaactccctctttggaactttttgctagcatttctctgtgtggatattccaccacatccccctgaagtatgagtcaagcagtggtgaatctttctgacacattgagaaagcaaatccagagaacacagagactaggaacaaaatgaggcaaacctgagaaaaaagcttagggttccagctttgtttctgttgttcacttccagaaactgccaatttcgaaaaatcgtcctggtctcttgctgcaacttgattgtgtttttacttcatgtcctgtgcccttgttgctcagaatcccaagagagctgtttagaggctcagttacatgtttgctaagttttcgtcttctcctcccaagatgaatagtgttttgttttgaaatagcaggtgttttctgaatcccatgaagggccaaaagctaaaagtgctgatcctgactctgatttcgctgcataactcccaggggcatcctgctctgatgtcaggaagggagtcaggttaagaagaggtcacctggaggttgaagagaaaatggacaaggtagaaagaccttgagcccctccctttgaatagttgcctgcttaaggacaatgctttaaaatttttgaatgtatgaataccttctaaagaaaaaacctatagacattacattctccagtttaactgtgtttattccattgtatatgtttttggatagtcgagatcagttgattttttcctgatttttacacatggacataatcctcatccttgtcatttttattggctgaagagtagagtttgataggatctggctaagcaaatgacactttgttgattattaggtggcttccagattcttattatttaatgataggcttgtaaatgtttttgagtccatttattttgttttgcttctagatgaattcatctaccaaatcagaggcaatggaccgtgctactgctgttgttacatattaacagaatatgttccaaaaaaagattgaaccaatttacaatgtatatttcaactgtttcctcaagcctcagaactttttttttcagtttagtggtttttgatagtttaataggcagtttaagggctcctttaaaggtcagcttgcttccctttaattgttgtatttttgaattgcatcaattcagtttaaactcatatttattgaatgcttactgaatgtaaatcactattctgggagctgcaggtaggtgactcaagatgagtaacattatctcagccttcaaggatcttaaaatctaatatgagagtgtagggggagattttaggagcacaagaaggaggaaacaatggctgcagagtaagaaaagtgccacagaaaagctacaaagcaagcactgttggagcttggcctgaggagggagtgtgcgcatccaggaggggagatgaagagagccttcatggaggagatgacagttgaactgggtcttgaaggatggctaggattccatgggaatggaggggcgtggcaggaagagagcacgggatgagcaacttcacacaagtgggaaagcctgggatgtgcagagaagccagcaagtagttgagtgtgacgggtgcatcggttcgggtcgaaggaaatgaagctggagaggtaggctgaggtggttttgtggttccaggctgaacattttgaaaaatcacatgcaaatttttcttcctttctgatcattttaaagtatttctgagtagtttttatatgctttgtattttgaagttttataaatgatgtggttactacattgttccattgtgtgtaatgtattaagaaaaaatatttcatttttaaatattcaaaagcgtgttttttgactgggcattatgtatagcatacttttcattagcggtttaacatctgtcatctctacacaactagcaggaatatgtggcttcattttcttctaacctttttcccccttttgtgattaactctttttcccatgtggaattaatatgctcggtatgaggtgtatgtctaagttaatttttctccacagtgaagtctagtgtcttactggagtttactaaacatgatgcatttatccatctgttgtattttcaggtttaccttggtctttatgatatttttatctactaaaacttttaacccactcttacgtagttttgagagtcatatatattttttaatttggtggggttaaggaaaacttcagcaattttcgtggggtatctttccatttgttcatgtgttcctctttctcattttagggtattatagtttcttaataattctcttgcgtcctgagttaatatttcaaatacgtaacattttgatgctgttgttattgaacatttttaagtttgtattttccatctcgactatggtttgttttgtatgaactggttatatccagcagctttgttaaatccacttaatctatctagtaacgttttttgattgaatatatatgcatttgtagatttactagtgtcatctgcaaaacaactttttcttttcaatgtgatagatattttatagctgtctcatcttgcgttgctctcagtagcagttctggtgtctcagggaacactattaagtgtaacgaggtttctcaaggacctcctgggccagggacttttctgttctttccaaggagctgtgaaaaaaggaagcagctgcccagatttatagaagcagagcttattagggctggatgggacctaacaggttctctagacctgggccttcatttgagagatgaggaaaccagacctagagaggtgtgaatttgccagagttcacactgctgcagtggaaggaggtggttgagcttttactcttatttttttatggtacatattacatacagtacatgttttcatttgggaaagttacttggtttgacagttttccaagtttacccaacattaaattttggtaactatgcaatatccttaaaaaaattattttcaagtaattatctgaagctctagaaaaggttacccctctatatcctcactctcctaggtggttgagggaaaagagaataaagaaaagttgtggggttggggctgggacagggaggaaagggtattttagtccttgatccttagtaggagggcctatttttaagcttcataatgtcagttttaaaagcagtggttttcaaaataaccgcagacgaaagtccccttgaaatggatgcctttctggaattgacctattttgagtttagctgttaccagaagggttcagaatctcgaatgctcttaaatgcatttacttttcagacaaagtggaaattgagtgcataatccacgtgggttccagattcaggttaaatttagaaatttggggagttgtggagagaagacatgaaatgagtcaatcgttgttttacaggtttgtccgaatccaggttaattatatttccttctttattgaattataatttgtatatccaggttagttttacaaattagatcagaccctcagtccatttgagagtagactcagagtcagaattatttgccccctttgctgctttcataccaccctttagtaaacagtcctcaagaatgtccttatgtcggggagggcagacctcagaagttagcaagaattccaagctcactgtaaaccttttgtttaatggtttactcaaatccagatagaaattctaccaaaatgccagcctgtatttcagctcctctttcttggagtctttaggatggtgggaaaacaggcagaagaaagctgtttaacattccaataattattaataatagaaaatgtatcctgctaatcaggcactcatttgcgtccactgataaaactaggtcattggagccaaggaaaggtaccgttcactaaaggaaagaccagtagatagtcaggcatggtggcgtgtgtctgtagtcccagccactcgggggctgaggcaggagaatcacttgaaccagggaggtggtggttgcagtgagcggagatcgcgccactgcactccagcctgggtaacagagtgagtgagactctgtctcagaaaaaaacaaaacaaacaaaaacagtggaatattgggctaagctcttaacacattatatttagagattgcaacacttcaatatttactggaatactcctataaaacggtctcttttgccttgttttattttggtaactaagtgaatgctgggttagccataaaggtagcttgctgcatttctatttcttgtgttctaaatcactgaataattttttaaaaaagtagttctaaagcatttccagttaaaaaggaaggcgtaacatttattaggggaagtcaaggggagaggtagtgaggaaagtaccagaaaccaccaacaggtgtttcggttacgttgaacaaagaatcagcttgatatgcagtccctgggaagagtttgtaaattcctgaaggagggtgagagctggaggggacacggtgagcggaaatggtgagcggaaatcagtggttcctgaggcacagaggacttgggttaccggaggcttgccctcagctgaggacctgggaacaattcctgagcaagttgcttttttgatagacaaggatgcatctgtaggaccactgctgttaatctgtggggcaataagaattgatcctactgcaagaaagagagtaggataagtcagaagacatggaacttgtatccctagaggacatcgcaactggaaaaatagctaccatttatgaaggcctacctcatctctttgcattcattatcttgaatttgcactaaaattctgcaagaaaggtcatagtattctattttacaaataaggaaaattaagctcagggaagttatttcataaggttgcacaactagtaggtggtagagctaagtttagactcaggtctgtcctactctgataggcatgctttttccacacggccctctcagtactgtgtaaaatgccagagggctttctggatcttcacttcccaaaactgctaaatttaaattaattaaaattaaagttgaaaaatcagttcctaggttgcactgcccacatttcaagggctcagtgtccatgtgtggctagtggctactatactggaccagcacggattagaatgctttcttcattgcagaaagttctattagtgctggtctagaggtcattcagttttgcccctttatttaattttttcccccttttattccacaaaggagaaaatgagggacaaagaaaggaagtaacgttcagcatcagacagctaattaatccagttttttggactggttgcctgttagattttcccatgccccacattcttcccttaaaaaaatgaacagaatggaaatgtgagaaatggagtgactccgctactctcccagctttgcctggcctttaaactagattctttctcccaaagaatcctgcattttaccaagttcaaagggcatgtccggattagtttccccaaaggaaatgaaatatatttgttggaaaggaattccattcttaatgtatgaaatagcacttggattccctctggttctttctctgacttcctaccaagcgctttgtaattgaacttgcagctgctaaccatttgtcttccaaaggagaccaacttcaaacagttcaaatgacagagggatgtatactttgaatgcaagcagctgcctattatttgccattgattcaaatggcatttatgttagagtcaaatagatttagattatggccaaaattacaacaatagatttctaacttgtatgttaagagtaagatgtattaacagtcattgaactgatgtttagtgtttaactcatacataccaggcactgggttgcaacatgaactaaaaggacttttgctgaaatggaaaaagatgtcttattatggacaagttgaatgcattttaaattcctgtctgaattatattgctggtatttgccatccatgtaccttcctgtttagccttgaaattcagtaaaagcctcagtgtggatcatacttcatagctctgaagtaaagtgaggagtcatgtgcaaatgtccttttagtagatgctattaaaaggcatttaaattatacactccagtgtctaaatgacagtctgaagtgtatgtgtgtttggaggatgggcaagtgggagcaaaaggaggcattgtgctggggcgattgatatttttaggaagcctaaatgtaatgtttgatttcggtataactaacagactcatggtttagaaaagttgtctatcaaaaactgagaaattgaggttttggtttcttcttaaagaaatgttcaagtcatgtgcatgagtatgctcagagagattaaaaatggagagaaattggaatggtggcaaggtatccaggaaagtacctgtcttctctgagagtccaagggcaggagcagaaaggactttaaagatggtggcaacaggctgggtgcggtggctcacacctgtaatcccagcactttgggaggctgaggcgggcggatcacctgagctccgcagtttgagaccagcctgaccaacatggagaaaccccatctctgctaaaaatacaaaaaattagccgggcgtggtggtgcatgcctataatcccagctacttgggaggctgaggcaggagaatcaattgtgccattgcagtccagcctaggcaacaagagtgaaactctgtctcaaaacaaaacaaaacaaaaaaaaagattgtggcaacagctggaaggggtccccaggagctctgacacagggttttccaactgcccaacatcacggggttggggagcagagcatccagagggctccgtgtattgttttgtagtatagggtctaacttctagaaagttgggaataggcttctgagagttttggagtcaacaggcctgaatgcagaatgatcaaaagaagatggctattcctctcagagtggtgctggttttgggggccagcagtgcagtgaaaagcccaatttcccaatcctattttgaatatttctgcccccacaagcgtttcatttgactccagagactaaccactcttccagagggtctagaagtcttcaggcttcagaatttttaggccatagtgctttggaataacagtcccttgtgtagaaaagtgtgagatctgagctcttttcctggtcaacctgtgaagtcactgcatgaccaactctgtgcctcaggttttttctctgcaaagtgggagtgatggtaatggcttcctacctttcagggtttgtatatgagctgcacatagtttcatgggttaccactcagcatgctttcacgcaagtagagattacattttattgttgaaagaaatcttggttgtcttctgttgtaatcttaccttgaatccagggctacaaagaagggttaaagctagatatggctcatgcctgtatttccagctacttagaaggctgaggcgggaggattacttgagcccagaaggttgaggctgcagcgagctgtggtagtgccactacaccccagcctggccaacagagcaagacttcgtctgttaaaaacaaaacaaaagaaaagaaaaaccaaagtaaggttaagagaagttggctatgtcacacagtatgttctatttggaattttgtgacttttgagtaacataacctaaaggccgtgtggcacagtggaaaggctttgtagccagcagactttgagtttgaattctgaccctgccttactatgtctgtggtcttgtgcaagtgcttttacatccttgggtctgttcccacatctgtaaaatgggcataacaacatttatccaacagaaaggattcatacactctgtgtgtaaactgctttttgtgattaacaagactaatgataacagccaagattagatccccagtgcaggttgccttactttctatcaggtgagaaggagagaaaattcttatttcccaaagaacttacagtgacggggctcttcagctgctctttatccaacagacttagaatagagacaacaccgggcatacttgcaattttttaggatgtgcaggaagcaaaagaattattttcagtgaaacaggagtctgcaaaaggtgccttaggaaacaactgccacacagtacatcccaatatagactcctcccagcttctctagggcagccatctgcctgacaggccccacccagataagcccagctttcttctcccaagagtttaaggaagatttcctgatgtatgtgtgcgtgtgtgtgggggtggtatggggttgtgttgggcgggggtcaagaggggtgttaatttgggatgggtagtcactggcttttggtggcataactggaaggtaacactccctgtggctgaatcctgatccctgtggggatcagcgcatggttcatccagacatcttcctcagtgggtcctggcctctgctcatactatgtcttctactggggattcccgtctccacctccaatatacgtatgttgaaatcttcatcttacgtcaaagctcaacttggaggtcatgtcttatgtaaatccatcacagacctctcctccaccccatctgggcagcggtcatctgctccaccctccggagcactctgtacatattccatcacacttcagttacttatgtaattgtctagtcagcagaagatactcctctccaaagggcaaggttctgctaaccgctgtgaagcctggctttgagtttatgaggggtgattcttttcagtttataatttcttggcacaggagggtcacagtgttgttggtaaccgtagcatctgtcctgggaggctctgtatgctcttcattgttcatacatccatttatttcttcactcagccacatgaggcatgtgggatgtatgttatctctgcttgatacatgaggaaactgattctggttaaaggacttgtgcctgtcatacaggcagctaagagtgcctatagtcctttgtattgccttttcagccaacagtcccatcccagcccaaaggaggaaacatttggggagcatatactggtgagaacatcttccctattctgtggcgttctcttagccttatgcctggcacagaggaaggctctgggaatgtttgggccggatggatctgggagcctcttttgcatgccaagctgcatacttatccctagcaaatgctggtctccttgatggatatgtgacatgggtggctgaatttacatggcacctggtggcttctcacactcctccgccacgcctctggggactaggataggacagatggccacagacaggattctcagctctgcaaatcacatttgggaaaaagttaagtttgtgcaataacacaattttggtaacatggtttcatgctgctggtaaattctataacactctctggataaatcacacttcagcagaactcacttgggaacagagtttaatttcactgtaggtggctgtgattcccacccaccagtcttcacacccccgctaatatatctaggctgataaggtgaatgctgtgctaagcaggctatttctgggcccaggatagaattacattgtggtttttaaagaatttttttctgtatatttttctattcacagaccctttgaaagaagaattacattatgttaatcatccgtttccccatcagcacctttaattccttctccccagagtataaccacttgtccttaaaatgacagaggtggaaaagatcttgatagttcagcctcctgtatgtatatatgaagaggttgaggcccagagagactgggcagcctactcagttgtcagatggctggtgaagacctgcatccggatccgttgacttctctcctgtgcagggcccttgttttttgccctgccctactgcttaaccttgtcttctgtcttacaactaggggagagtctatggcatgttcagtttgaaatgaataaaagtgaatacttgttcattgttaaaggaccccaacacagaactaatttcctgttaacccttacattttctcttgacatatctttggtgaggaccattaaaggcttaacacatttctgtacagtgacatgcagtcctaggggttaactgtgtgggtttgagcgataggatttaacttttaggaaaaaggggaaaaaagagagaaggttgataagtgtatttggagagagagaaaaaatagttaatttttctcttaacagttaatctgaaatgataacacaattgtgccttttggctctaaaatcaccatatttttgatatataatccaaaggcaggtatccagactgctgaaggcttattaaaatgtaacaataggtccaagtctagaacttgaaaaaacttctcatttgtcaaagaagttccagtattctacattctcttgctaatgaatttggggagccttggaagctcagcaactgggatgccatcgacaggtttgcggtcctctctagtctggggtaggtcttaaggggaaacttttgggagggacacacatacagtacagtgaaactgtacatgaactactcaggagacagatcacttggcagggatgtggcgatctttgtacatatttgttctgctttactagctacattgtaagcttctgcagatgaagagttcagccttgatgtcccatctcccgcccaggcctgccatgtactagttgatcagtaaaagtggaatgaatgaaagccagtgttagtttacagagcttctgtgggacagaagctttgttcagttgagtttccatcaatatcaaatgcaatgttatgtgcgttgagtttcttgataactgttcttgaggtttctttttttttttggtcctttttgactgattaagcaaggctggactggttggagaccccagatgggaccaagaaatgcgaatcctgcctggattgttgtaggtagagtgcttaatatggggcctggcatgaaggaagttgggagtattatctggtcaactggagtttagttattaggttgtaaatgactatggtaggtacagatgtcatgaatatactagggtctcagggtctgaaagagttaaagctcctctcagaatagcccaggcagttcccaggaagtagcttcttaggcaggatgtggcaaaccagtgggtaaatgagagcccttctcctttggaagaaaaggaagtaggtggggagaagtgaagaggaagagcttggtagacaaatctttttatctgcttcttttttaagtgccagacagaccctgcagatttttgatccaaagtgaccaaagtcctaagaatgccaataatattggttttgctattgtcttttccctgcagctaataactcaagtttaagatccactagagtgttgtttcaatagattttgttttctaattttgatcattggtgtattcttcagtgcgctttcaagattcacagtgaatgtggtgtcatccaaaatcacattcttttctaaccaaggataagtcagaagaaaagatatatatatgtatattagaaaagtgtctctttaatgtgtttacctatttatccattttaaaacacattcccacccattctctgtccaggtgctcataacagtcccttgtgatacaggacaagagtgtgcttccatttaaggcaggagagagatcttgcccatggttagatgaccagttaccagcagagttaatagagggctccagaccctctgacttcaagttcagggttgtttccacaattttggtcctttttgttaagaatatagtttatacattggagacaaattattgatggaggctgcaattttgcaaataaaaataaccctcaaaaatccagtaatgtgtatgtgaaatgaaataggtgaactgaatttggtgagctttagtgtcgctgtaaaagcaactatcctttgtaaacttactgcatagctaataatgtaaatcagtgttgtgtttaggaatcagctccaggactgtggtttgatatgtggaaacacctctgcgtttgctgtgggctggtagacagaatgggctggacctggctgtactgtgaaaggcttctttgagctggttctttgaccaggtaatgaaaacgttaagcatctaaaaacgaagtctttaggaggcttccaaggatctggaaagctgaactcagcaatttttagacttcagttttctggacaggacagctcttctagtcaaggaagccagtatctcctgcatttgtgtagctcttgactccatttctttgaaggtttcaaatgataatttttacacttacccagataatctactctgcctgagcacataattggtaatttggcccaaagactgcatacttagattgcatcctggtcacactgatatcttacatgcattttagatatttaaatattaaaacaaatattcttatggcaatttttgtttgttttgagatggggtcttgccgtattgcccaggctggagggcagtggctattcacaggtgcagtcatagtgcactgcagcctgaaactcctggcttcaagccatccttacatctcagcctcctgagtagctgggactacaggcgcatgccactgtgcctggcccttgtggaaattttatttatttatttattttattattttattattattattattttttgacacagtctctctctgtcgccctggctggagtacagtggcgtgatctcggctcactgcaacctccacctcccaggttcaagcaattctcgtgcctcagcctctaaagtagctgggactacaggtgctcgccaccacgcccagctaatttttgtatttttagtagagacagggtttcaccatgttggccaggctggcctcgaactcctgacctcaggtgatccacctgcctcggcctcccaaagtgctgggattacaggcatgagccaccacgcttggccccttgtgtcaatttttagaagctaggatgtcaggctgctctttactgaaccctaaatatcctgaagcattctgggctggtgtctaggaccatcttgatcctaagggaataagcttgactcttctcctcttggtgcttcagcactgcattttcctcagtgggattggaacaagcattaaagcaaaacaaaaagttgtaaatgagacttagggcaactaacctgctctagccagaatgaaaaatttgttgacgtttaaagttctctgacctccctgtgtctacctgttcataatactaaaacaaattatgaacttaagtaataagaaaaaagattatggcagatttcacacagctaaaataattacaagaattcagcaaccacaaaaatatttctcactgcaaattctcatccatttctgtattgtaggcatttttttttttcttttggttttagtgtttattgtatacctcacactgggttagactcaagtttgggggatacttccagcttaattgagggtatgagcatgtaattgcaaggcattgtgacacatgctctaactctggtgtgtgatacagcacaggctatgggaactcaaagggtgagtgactaacgctgtcttgaggagtgaaggactgtatccccaaagcagggatctgggcctgtcttggggtttttgggtcttctgttttgttcttatttttttcttcttcttcttttttttttttttttcctgtaaccttatttatggtgaagggacttttttttttttaattgtttacacttgcccttttgatatcctctgcattcgtggctcttatcatcatcttagacttgtgaacctgcctcaggtctctgttaggagtttctggcctatctggtcagccatatactgagtagctccacacgtagagcctgcaggttatctccaactcaccttttccaaaaaatagatttataatcctcttgtcgcctgtgatgacctctcatgctaactacccagagtcaggcagacctcataggttaaacacacagtcctctgtaagactgcccttcataagactgttacaatctaaggggtttcctgaccacacacacttctgttgaactagctacaaattggggttttcactatcctctcaggttccatagtttgctagagcaattcacagaactcaggaatgcactgtacttctgattacaattttattatagcaaaaagggtacaaatcaggagcagccaaaagaagaggcatatagggtaaggcctgggagggtcccagatgtaaagcttctggtgtcttcacctcttggaatcagggcacagtcactctcctagtacattgatgtgtaacaatatgcacagagtattattaaccagggaagctcccctgagcttcagtgtccagagtttttactggggccccattacataggcatgattaattgaatcattggccatgtgattgaactgaatctctagcccttttactcactgcaggttaggctgtattacatggctcagagccccaaccttgtaatcacatgattggtctttctggtatggccagcccccatcctgtgtctttttttttttttttcccccagtcatcttttatttggaggttaattcccattaggatatgaaaggattcagcaacgatcgagactgtgttccttatggaggggctcgggccaagaaggtcatggcggggagtgcagagcatgccctcttcttcagtggtacttgcatagccacttgtgcttgagctccttgtaggaaaggcagtagctgaagagcacgtagcttgccagcaccatggtaacccctgagatgctccccttcttcatgtcaatgcactgcttgtagtaccagtaataacctcttcaaaatgctccggtagtgccactattgctgaagtcctgcatcaagctccagcttggcagctcccctagtttgacctccagaagtttcttgttcttcactggtatgactgatgccatcttggagtcctggtgtccactgtccctgtgtcatctttttaagcaaactgtgggcccacattgaatcaccttattggcgtaaactatcagggcccactgtgaataacaaagacactcctattacttgagaaattccaaagatttagaggttacctccagaaaccagggacaaaggccagccaaattctttattatacaacatcctcctaacccccaaagctgtctagtcctcatctttgtgatgtggtaagtcagatccctctggatgcccagccagaaacctggcatcaccctcaactcctccctccctccccccatatccagatcatcacccagtcttgccaactctgccttcagtttctgtcccagctctttattgcctggctgctgtggtgttcaaattctcatcttgtcttgttttccttgttgccttcaagctgactttcctggcttggctctcccatttctaagttgccagactcttggttccaaaatataaaactgatcttgtcactttctttagaatttgctgttgcagaacaatgtgtgtattataattccattttcgttaaacaaaacatactatatatattcactggaaatgtatttcaaagaaatctagaagtgtatatattctacagtgttaagagtagttatctgagggaaggtggaacatagagttttactttagactatatatttctagactagttggattttttcatactgagcacacattagtttttttaggcctggtaatattacagaagtcaaattacagaagtcaccctagctccccactcgccttctaaacctaattctttagcatggtgtgctgtgcccttcatggtctagctcagtttacctgcagccccatctcatcactcacctggatgcatccactctcaggatattctcaggattaaacttggggattacattttctgaccttcactttccctcccttatcttagatggaattagggagtttttctgtatgttcccatagctcccaatgcctaccttgcttttagcattttgacctaccctaccctgtagattgttgttacacttgtatagttgttgctgtacttcttcttagtatcctttcctatgtttggcttacattgtgatacacacccccctacaatcccccccaaacacacacacccacccacacacccacctttcagactgccttgtgaggacagggatcttgttgtcttcatagcctagcctctagtatacatagtgcttgtcatggagtagacgcttcatagtaaatctgcattgtattttcacagctgtaggcataaatggatgtaacccagagattcactcaagttacctatcccatgcccttttctagattggagcactccccgaggtttagattctcatcatcagttctgctgtgggactcacatttccctttctatgttttttctctttttgctctgttcttgaactagcttggaatttggctccttttccttggtttccactataacaacagtgagaacaaagtatacacaaagctatttgtgtgcacagcagattggacttggaaggtttggggtggggagggtatattatattacagcaatacaggtaacttaaaatctaatggtgttaggtgtctttggtcttaaatgacctttgctaccctgccatggtacctcctttccttctgctcttgctgctcttaacgagtccccaaacaagcttttctcattttattttgcaacgtaattcagctctccagctgcacctctacatgctgttcagggctgcttctgcccaccccaaggctgaggagcaggcccttctaaactatgggcaagctttctggttctctagtaggaccagatcccactgtgaacaggtattgttagcccaaagacttatttccccaccccacatcttttttcagaagacagaagcaagcactatcagttttggttttaattaagtttctttctgtgatattacttcttctaggtaggttttgactttactagaccaattgctgttaatttgatggtctaactagtaattttctacccctagtttaacatgttgaatgttgaccaggtgcagtgtcttacgcctgtaatccccgcactttgggaggcttaggtgggtggatcacctgagccctagaagtttgagaccaatctgggcaacatagtgaaaccctgtctctacagaaaattacaaaaattagccaggcatggtggcacgtgcctgtagtccagttacttgagaaactgaggtgggagggaggatcgcctgagcccaggagattgaggctgcagtgagccatgattgcaccactacaccccagtctgcgcaacaaaatgagaccctgtctcaaaaaaacaaaaaacctatgcttaagtgagcacctgcattgacttccagtcctgatcctgaaatcaggattccctgaaggttgttggaaagtgatctgggggtagggttttttcccagaggtgatacgtgctcagggatgagatttgctgaccctcctgtgtgtatttgggcagggagaagggtccagctgtaacaaacagctgttcttgtatataagggggaagcaagtctggagaattgacaatttctcctgtggactagaattggagacatattttgagtgctgtgtttcatctgactgtatcttcctgcccttgggtgtgcttctgggcactggctactgaccttttgccttggggacccgaccgtacttatggttctgttaaagttggagggtgtccaggttcttggcatcttcaacaaagaattggacaaaatgcacaaagcaaggaagggacgaagggatttattgaaaatgaaagtaccctccacaatgtgggagcggtcccaagcataggagctcaaaaggccccgttgcagagttttggggaatttaaataccccctagaggattccatttgttattttgggtacgctgtatgtaaatggagaggttgaagtaaagttacaaagtcatttgcggcctatgacctatggagaggatatttcctgttatagctgaagagtgaattggccttatgttccctacctccagacccaattttcctgcctcagttctgagttatgaggtttaactgattgggtcacattggatcctgtaccttctccctcattgaagagcaaactgcattcctgattgatagaccagcatgggccattattatacagggattttctaaaaagctctttttctttttttaaatttatttaaactattttttcctcattatgactggaaggataaaagatatttttctatatcagcttctcaagaacagggaatgggtaatgtccagtacgtcatctttctaaggccatagccagcttgtcttttcagtaacagccagccccactgtttagtggtcaccaccagacccagggctccctttgtttttctgatgctgaccacattttttttttttttgagacggagtctcgctctgtcgcccaggctggagtgcagtggcgggatctcagctcactgcaagctccgcctcccgggttcacgccattctcctgcctcagcctcccgagcacccgccaccacgcctggctaattttttgtgtttttagtagagagagggtttcaatgtgttagccaggatggtctcgatctcctgaccttgtgatccgcccacctcagcctctcaaagtgctgggattagaggtgtgatccactgtgcccggccttttttttttttttttttttttccttttttcttttttttgagacagagtttcactttgttgcccaggctggagtgcaatggcgcaatcttggctcactgcaacctctgcctcctgggttcaagcgattctcctgcctcatcctcccaagtagctgggattacaggcgtgcaccaccatgcctggcttcttttttgtcttataacttctgtttttttttcccccctctccctccaaactccatcacttttccttttgtacttctacagaagcctgatcctttaaaaattatctggctgggcgcggtggctcacacctgtaattctagcactttgggaggccgaggcggatggatcacctgaggtcagggattcaagaccagcctggccaacatggcaaaaccccgtctctactaaaaatacaaaaattagtcgggcgtggtggtgcatgcctgtaatcccagctactggggaggctgaggaaggagaattgcttgaacctgggaggtggaggttgcagtgagctgagattgtgccactgcactccagcctgtgtgacgggagcgagactccatctcaaaaaaaaaaaaatttcatatgcggctaatatgaaacacattttatatactgggacagaaggaaccataggctgtcacttgttttaagcaacaatatgacaccccctgtctgattcaggatgttattcaatatttgaggaaagtctttgtgagtgggtggtcctcatgactccagaggctcctctgtgtgtgtgtatgtgtgtgtttttcaacatgactgcagaaacatgttgtgggaaggtaatttatgtgatttcagaagactgtttgattcccagggggtgtttttgtttgtttgtttctttttaaaggataggaatatgtgattcttattctacctgggattctttttaatcaaacctgtttttatgacataaacaaaaaaaaagtctgttggcttggaaactacctgatttacagtgaaattaaaaataaatgccttggccaggtgtggtggctcacacctgtagtcccagcactttgggaggtgaggtgggtggatcacctgaggtcaggagttcgagaccaccctggccaatgtggtgaaatcctgtctctactaaaaatacaaaaattagctgggcatggtggtgggcacctgtagtcccagctactcgggaggctgaggaatgagaatcacttgaaccggggaggcggaggttgtggtgaaccgagatcacaccactgcacttcagcctgggtgacagagcaagactctgtcaaataaatgaatgaacgaatgaatgaatgaatgaatgcctttcagccgtgcacagtggctcacacctgtaatcccagcactttgggaggccaaggtgggtggaccacttgagcccaggagtttgagaccagcctgggcaacatggcgaaacccagtctctacaaaaagtacaaaaattaaccaggcatggtggcccagctaccccaaacgctgaggtgggaggatcacctgagcctgggagatcaaggctgcaatgagctgtgactgcactgctgcactccagcctgggtgacagagtaacaccctgtctcaaaaataaaataaaataaatgtctttcaacctggggaagccgattgaaaaggtaaataaatttaccttatttatttttcaaaataaatttacctgtcctttcattttcttatttttttattttaagctttattcccctaatacttactcttggcatatatatatatatatgtgtgtgtgtgtgtgtgtgtgtgtgtgtgtgtgtgtgtatgtgtgtatatatatgtgtatatatatgtgtgtatatatatgtgtatatatatgtgtatatatatatgtgtatatatatgtgtgtatatatatgtgtgtatatatatgtgtgtatatatatgtgtatatatacacatacatacatacacacacatacatacatatatatacacacatacatatatacatacacatacatatatacacacacatacatacacacacatacatacatatatacacgtgcatatatatacttataatttttatatgtacaattttatatatatgtacacacatacacacacacatatatacacatacacacacatacacacacacacacacacacacacacacacacatatatatatatataaatttttttttctgaaacagggtctcactttatcacctagactggagtgcagtagtgtggtcttggctcactgcaaccttgacctcccgggttcaagcgatccttctgccttggccccccaagtagttgagactacaggtgcatgccactacacctggtgcatttttgtattttttgtagagatagggttttgccatgttgcccaggctggtctcaaactcctgagctcaagcgatccgctttggccttccaaagtgccaggattacaggtttgagccaccttgcctggcctggcttataatcttttttttttttccttaagtgctaactgcgagttaatggtttataatattcctaatcctaattctataccattgtcgctgggtgcagtggttcacgcctgtaatctcagcactttgggaggccgaggtgggcagatcacttgaggtcaggaattggggacgagcctagccaacatggtgaaatcctgtctctactaaaaaaaatacaaaaattagcctggcatagtggggcctgtaatcccagctacttgggaggctgaggtgggaggaacacttgaaccaggaggtggaggttgcagtgagctgagatcgtatcactgcacttcagcttgggtgacagagtgactccatctcaaaaaaaaaaaaccaacaaaaaacagcaacaaaccaattctataccattgttcacagattagcccctactagaatgccctctttctctttttttttttttgctatctcattattttatatcattctagaccagtttgagcctcatatccccacaaaacttactctagcatatcctcaactacacagctgcctgtgttctaggccctttgtgagaattaggcgaactgtggtacagtcattgccccagaatcacttttgaagttggtggtgaaaccataaaagcaataaaggtaattaactacattgtgcattttccccagattatttattgcatgaacaacatgaaaacgtggggattaaatcaccttctaccctgccacagcaactgatttcatttatctatgtttctttgcagtgcttgttcgtatacattcatttttcccccataggtaatacaatataattcatttgcacctgagagtgtttgtcaaaatttctgatacctataagtgtgtgtgactttggataagtcacttctcctgagacccagtttctccgtctaaaccaggggtttagactacatgtcctgtaaggcaataatcatgaaaatatcttctgttgtggagtatttcacagttgcttgaacatttgtattgttattctttaccataactacatgggattgagtggaatatgatattccttttttacggattgggaaactgaaactgaggtagccaaagaaaacactcttaggtgaaaatgaattatattgtagtacctatgacgggaaaaaaatgaacgtatatgaacaagcactggaaggaaacatagataaatgactttaaggttgactttttatctctggtttttagcagtttgactatgatgtgtctaggtgtgggatttttctttttttaagtattgcttagggtgccctgtgttttttcgatctggatgtttgttgttttttgttaattttgggaaattcttggcctttatctcttcaagtatttcttctgtcctgttccctcttgttcatccaagaccccaactacatatatgttagacgattggatcttgtcctacaactcttggatgctctgttctgatttcttttattctttttttttgctttagtttggttaatttcttttttgtttttttgtttttttgagacaagctggtcccaaagtctgggcctcaagtggtcaagctggtctcaaactctgggcctcaagtggtcctcctgccttggcctcccaaaatattggtattacaagcatgagccaccgtgcccagcctccatttaaaaagttctgtcgacctatcttcagggtcactgattgttccctcagctccatgtaatcggctaatgagcctgttgacctctgatgccacgtttttaaaatttctagcattttaatttgattctatttttagttttcacctttgctgaaattcctcatttgttcatacatgttgtcacctttaacatattaatcatagttattttaaggcctctgtctgatagttccaacatctgggtcatctgagtctggttctgtttatagcttatctcttgataaggttgttcccccccatcccacttcccaacccttcttgatttttgtgtttttctttccttttttttttttttgaaacagagtctcactcttttcacccaggctagagtacagtggtgcaatcttggttcactgcaacctccctcccggtattaagcaattcttctgccttagcctcctgagtagctgggattacaggtgcctgccaccatgccaggctaattttttttttttttttttttgagatggagtttcactcttgttgaccaggctggagtgcaatggcgcaatctcggctcacggcaacctctgcctcccaggttcaagtgtttcttctgcctcagcctcccgagtagctgggattacaggcatgcaccaccatgcccggctaattttgtatttttagtagagatggggtttcaccatgttggtcaggctggtctcaaactcccaacctcaggtgatctgcccaccttgacctcccaaagtgctgggattacaggtgtgagccactgtgccccacccatgcctggctgattgttttatttttagcagagatggggtttcaccatgttagccaggctggtctggaactcctgacctcaggtgatccacctgccttggcctcccaaagtgctgagattatggatgtgagccaccgcacccagccatgtcttgtgcattttttttttgaggtggagtttttcttttgttgcccatgctggagtgcaatggtactgtcttggctcactgcagcctctgcctcctgggttcaaatgactctcctgtctcagcctcctgagtagctgagattacaggcatatgccaccatgcccagctaatttttatattttcagtagaggtggggtttcgccatgttggccaggctgatgtcgaactcctgacctcaagtgatctgcctgcctcggcctcccaaagtgctgggattacaggcatgagccaccgtgtccagcccgtgtcttgtaatttttgattgaattttggatattatgtggtagaacagagaattaggtaaattgtctttatcctcagaaatgggcatgcttttctgtcatgctgttagtttgtgttaggctgttagccagatttgagctgggtttgggctttctttttaatattaacttaaatgcatcacatgcttcaaatttctccagtaatgggtttttatcttgcacttagcggggagcctgagttgcatacatttattttttttctcagtctttctactgcttcttcagctctgaactgtcccttaatcctttgccacaaagggactctttctctacactcttgcccctttcctaggggtaagctgcagttgctttttagtggttcttggcttgaagtagaggtagggaggttctcattgtcttgatccaatctcaatctttttttttttttttttttttttgcgatggaatttcactcttgttgctgaggctggagtgcagtggtgcaatctcggctcactacaacctctgcctcctgggttcaagcgattctcccgcctcagcctcccgagtagctgggattacaggatgtgccaccaagcccggctaattttgtatttttagtagagacagggtttctccatgttcgtcaggctgttctcaaactcccaaccttaggtgatctgcccgcctcggcctcctaaagtgctgggattacaggcatgagccactgtgcccagcctcccgtctccatctttagcagaccctgtgagtatagaccttgggtttggggttttcccagcattctttcccttcctgtgtatggcagccagactttgccttgtatctgcggcaggtcttgggcaggagaaagttttgtatacctccttcagcagttagtagacttttgctttctgttggtgttgagcacagctttaggcttagattcttcatcaactaggagaagctgtgcttcaatacagttattcgtttgcatggttcctaatgtgcttcactcaatttagcagaatttttttttttaacctcttccttgacgctagctgcttgtgcaaatcacatcttggccgcctactcttcttcacttgctgacagatgtgtaggtgagaaaagtctcatagtcattgttcctgaaagaagcttccagacccacttctagggccagtgacatatgcaggaaatcagctgcttctgggccaggacagagctggtcttttttttagtgggggatggcgggcagtggggcaggggacattcaaaatttattttccaacagacagatagcatcagcaggtacaactacaagggtatctacatagatcatacattcacaaggcattattagttcaacagtgagaaagccactcgtgggttttctgtaacaatatcccacttcatagtgtaaacaggtactattttgttcacttacaattccggaaggaagggcacaccttgcaggggggaagaaaaggggaatcctaaagtaaggtgcaacaattaagagacaacactttggctaacaatcttggatccacatttcagtcagggccttccacatagaggggaaagacttttctctcagaagttagaatctttcttcctcctttcttgttaaactgagagcagtgttttgtttgctcaatattacatgtacaaaaggagattagaagaaaatgcatcacaaaaccatcttgaacgttcagctcttcctgccaatacatcacaactcttaggttttagacggggcctgggaatacgtaagtgttttttcttttttttttttttttaagtgaaagcaagtttattacgaaagcaaagggataaaagaatggctgctccataggcagagagcagcccagtaatcttaaaataggaaaatagacactatggctacaaaaaataaaaaataaatgaggtagataaaattttcacacccaggacttgcctgttccaacttcatagccttcatgaaatattcatcaagaagacaaaaaaaaaaaaaacctttataattacttggcataagtcgcaacaagaaaattcaacaaaaaaattagcatgtatacctgtgataggaaacacatccttccatgagtttcttctcaagaatgaaaacctagttcttcagtagagtaggcactggcaaactaagtcacctgagatttcctgctcaggtgccctcttcttctggggttcaggaagaggaaggcatctaagaagtgtgggaaaggacattggcactctcagggcagagctggtctttcacattgtggtgaaactactagaaagaagaaaaacatgcttgtggctactctgtgcctgcgaaataggtgtgaagcctttaggagtcagaagacctgggttcaactctaatagtcacttactctgtgaacttgtgcaagtcacttctctgtagtttttcttacagttaaaactttaaagttttgtccagtgctaaaattctctaatcctaacatatccttctgtagtgttacaaggatagaactctccaggtaaataccaaggctgtgcttttctgcaagcatagtggttagcttctcgtgttatatggtttgaagccctagttgttacttcttgcctgcatataaaccccattgacgatgatctcattttgtttttcctttgagaataaattgattgttttgtcttcccaggtctttgagaatgcgtaagttccggcactagaaggccctcagtaaagtaactaaaggagtatatacagctaagggcaatttaagtcaaaatgtgataataagtaaaaagtggttgtagaaattaaatgagagtgaaatatttttttaaaagttggaatcatctaaatgctaaatgcatatttaatattgttttgctactgtaatctaattagttaaaaagaataacatttgggctgggggtggtggctcatgcctgtaatcccagcactttaggaggccgaggcgggcagatcacgaggtcaggagatcgagaccatcctggccaacacagtgaaaccccgtctttactaaaaatacaaaaaattagccgggtgtggtggcgggcgcctgtagtcccagttgctcaggaggctgaggcaggagaattgtgtgaacccaggaggcggagcttgcagtgagccaagatgcaccactgcactccagcctgggtgacagagcaagactccatctccaaaaaaaaaaataataataataacatttgatagtatttattgagcacctactgtgagctagatgagtgtgggtgagctcctttagtctcctgacaaccccaagatgtgtttactactgttagccccattttactgatgaaaaacctgaagcttaaggcttttaagaaacctctctggccaggcatggtggctcacccctgtaatcccagcactttgggacgctgagcctggcggatcccaaagtcaggagttagagaccagcctggccaacatggtgaaaccctgtctctactaaaaatacaaaaattagccgggcgtggtggcaggcacccataaacccagctacttggaaagctgaggcaggagaatcgtttgaacccaggaggtgaaggttgcagtaaaccgagattgcgccattgcattccagcctaggcaacagggcaagactctgtctccaaaaaaaagaaacctctccaacttgacgtggctattcagtggccaaatagggcttcatacccagatagcctgactcccaggttcgggtcagggtacatttttatgtatcataaaagcatagttgatgaattctcagaaaccgaacacaccatataaccagccctcagatcaagaacagggcattactagcacccaggaattcccctccttccctatattagggttcaccagagaaacagaaccaacagcagttgtgcgtgtgtgtgtgtgtgtgtgtgtgtgtgtgtgtgtgtgtgtgtgtgtgtgtgtgtatgagagggttattgatgtttattttagggaattggctcatgtgattatggaggtctggtaagcctaaaatctgcagggataagccagcaagctgaagacccagggtagggttgcatgcggttcaagtccagaggcaggctaccagcagaattccttcttttgggcaggtcagtctttgttctcttaaggttttcaactgattggctgaggcccattcacattatggagagtaattcactttaagtttaccaatttaaatgttaatctcatccaaaaaacccccacaaaaaccaaaaacattttcacagaaacaccatggcccagccaagttgacacgtaaaattaaccatcacacaccccctcttagttacttccccctgaagggtaatcactttcctaatttataattgcaaagattagtgttgcccttttttgaattttctttccttttttttttttttttttttttttttgagacagggtctcattgtcacccaggctagagtgcagtgacgcgatcttggcttactgcgacctccgcctcccaggctctggtaattctctcacctcagcctcctgagtagctgtgattacaagcacacgccaccacgcctggctaatttttctattttttgtagagatggggtttcactatgttggccaggctggtctcaaacaactgggcttaagtgatcctcccgcctcggcctcccagagtactaggattacaggtgtgagccagcatgcctggccttgaatttttgacagatggaatgacatagtgtattagtctgttttcacactggtttataaagaactgcacaagactgggtaatttataaagtaaagaggtttaattgaattacggttctttatggctggggaggcctcagtaaacatacactcacggcataaggcaaaggggaagcaaggaccttcttcacatggtggcaagagagagaagtgccagtaggggaaatgccagacacttataaaaccatcagctctcatgagaattcactcactgtcacaggaacaatgtggggaaaactgcccccatgactcaatcacctccctctctcaacacatggggattacaatttaagatgagatttgggtgggaacgcagagccaaaccatatcatatagtacatactcttttcgtgcctggcttctttcacagagcacatatacacattcctagaatttgatttcctataggtagttgaacagcctctcctagagtaacctgaaggattgaggtatgggaaggtatagaacgccttccccaagatgttgactggggctgtcccttgccactgggtctgcactgcggcgccccccccccccccgtcccccccaacacagatgggctagcctggggtggaatctggaagttggtaagctgtgcttttggcactctctgccttcctctttcaggtccattctcctttcctgtcttactactccttatacgcctaactctcaatcctcagccatccatggtttgactgttcagagacccatggtgccagttctttttgttctcatattgccccctgtccattgaagctcctcagcccctcaacttgaacacgcccccgttcttattctgtacctcctcagattactgtcacattgacggacttgaacctcagagatagacaacttttcccttccctcctctcctccttcccatatacttttcttatggatatggaactgaggaccagaaaggaaggtaacttacccaagatctcacagatgggtaaataggggtagaaggtgtggatcaagggattgtatgcagcctttatctctaggtgctggtctctcttaccttgggtctgtctcttttgcctctcctttcctctttccctgctacttgacttgtttcctaccctggtagcattcctgcttgccagatgccacaggggaaggagaactttacaactccctgggctctctggtaagaacacccacctgcacggggacccttcctctccttcctacagtgattggttgtcatcctcttcccttcctgcagtgtaccctcctggcagaggcaaggctgccatcgaggctagagcaaggctcagattgggtggcatgcagttgtggcctatttctgtttgctgtgtggcagtttggagatcccatttctttttctggatatcacccccctacctcctcctgtcattccttaggccagcctctaaattcagtgaccatcagggttgaaaagggcagtgtggggcctagaaaggagctctctcctaggagttaggagacctgccagcagtgaactgtgtgaacttgtccctttgggcctcagttttctcatctgtaaaatgagaattggataagttggtcttcaaggtccctccctgagatacattttatgctgctgcttgatttaaaccactgagccacaaatgaaaggttccagttgcaacagtgtaattaggcttagcagatgggtgagatgaaaggaaggacatgttcttgcccataggattatcctttcccacccatttccttgcacctcactggtgtttccaaaaagcaaatgacaacccttgtttttctctgcattcccattcaaacctttaatcttcttttatcttgatgaacttgtatttaccgttagacagccatgatgcagaattcacattacagtgtgtggttctaactctgccatggtgaatgtgatggaggttggagccgatcacagctggtccctggagagagggctgtgtgtgtcagatttattgtgctgcagctccagttttgttttggtttagtttttaaatccccagtgtcagttttgctgatttcagttaaaactaaagattgtgaagggagacagagacaggttcatgccctctgagttttagagattggtgatatagtcgttgggtgagggccctctgtcttatatcctttgcttaaaacatttcaccttggaaaggcagaaattagccttgttgaacttcaactccctctgcaagaggaagaaatactgaatactgtttcattattgatatctttttaatgagtactgaaagccactacaggatctttgtttcaccttcagataaaatgtttcatctttcattctctgaaaaaaaaaattgagtattttaagaataattaaaggaaaggcagtagtttctggatcctgccgttgctgccttggcctctcctgccttttctccacttccactcctctccctctatattagtgtagaaatgtgtcaaaaatttcttgcttcttccattagtttctattttgacccaccccagtgaatgaaataagcatagaattgttacttctattttacagaagagaaattcttatttttttgttgtttttatttttaagttcaggggcacatgtgcaggatgtgcagatttgttaacataggtggacctgtgccatggtagttttctgcacagatcatcccatcacctaggttttaaggccagcatctattagctattcttcctgatgctctctctcctcccccactgacaggccccagtgtgtgttgttcccgcccctgtgcccctgtgttctcaccattcagttcccacttactagtgagaacatgcggtatttggttttgtatacctgcgttagtttgctgagaataatgacctccagctccacccatgttcccgcaaaggacgtgatctcgttcctttttatgtctgcatagtattccatgatatatagaggagaaatctgaaatgtggcaaggttaagtgacttgtccatggtcacacagctggttgatgaacaatttgtgataagaatccaggactcttgaatactagtgatttgtcaacacgattccatctccagtcctcatccatacacacctgccattaggaaagtctttaccaccccagcctatagtctttgtcatttctctcactggccagcttctgaaagtacaggtcagaagccagttcattagctggtagggtgggtggttaaacggcaaggcataggaggtagaggagggagaaaggaagcacaaagctcaggcttagtttttcctccagaaggtgtaagaattacttatttcaaagagtcagaaaagtgaacagagtcagcattcccttttcctttgcaaattgattgaatttctatggcgagtattagctgcaaggcagtgttaatctgctccagcagatccatcatcagattgatgtgcaggggagacaggattgtctctggtgcaaaggcctttttgtgtagggcacaccatctttatgtatgattgaggcctggtgtgttaaatgcctcacactgggatcttacccatgtttgtcagttgcctcccttgaaagtattgagctttttgaagataatatagcatcatggttaaggtaagacattcgttctctctgcctgaatttgaaacgtggctgtgccacttaccagctctttgacctttgacatcttagttcacctgtctgtgcttgagtttgctcatctgttctaattaggggttgtggattaaatgacttaataaatgtaaagcactgaggagagttacacagtgttgtgaggaaagcagtttttcttccatgcagccctccttccattcccccatcatgcacagtgtgtgtgtgtgtgtgtgtgtgtgtgtgtgtgtgtgtgtgttgacagcttttcgaatctgcatttctagctggcctgctgagcctgtcaggcagctgtaacctcactcaggttttagctgtggggtccatctacatttgacatgtgtttctaaatgtggtcctcagtaagctcctttgtggggagaccttggagaaaggaaaccagagagtgtgcactgtgcacccccagccacacatgttctgggttcccacaccttagggactggggacactgcaagacatagccgaaccttggatgaaaatattgagtagctgcctcagtttgcttggactgctatgataacatatcatagactaagtagcttagacaacaatagtttattttcccactgttctggaggctgaaagtctaagagcagggtgccagcatggttgggttttggcaagagccctcttcctggcttgcagatagctgccttcctactgtgtgcttgcatggcctttctttgatgtgtgcagcaggtggggtggggggaaaatcagtgaggaaaatcagtaacctcggccttgcatcttctttggtcccatgcatgatgttatttgtaaggcagtgtcagatctcctcatacatggagaggcattaagtcttcatttccctgtcttctagaggtttgggatagagggtgtgaaggaagagcagattatgcttactctatcttttaagctcagaactggggtgtgtgtgttggcaggaacaccaacatgatgatgtataatgaaggcctatcttgtcacctgtgtcacttcagccaccccacacaattgtcactgacatgcttcacctcccgggacttcaatttgaaacccaatgaaatccagtgaaacacagtggaaactcttaccaccttcctgttaaccaactcacaggagtgatgaacacttttcagttccctggatgaaacactcttgagcaatgcccacagcatgctgaatgcactgcaggcaggctgctctctgccatacccactcgcttcagcacccactggctgaattatgtgcttaccaagagccagcttgttcccaaacccatttgttcagctgtagctggtattgtagttaagtaatgtatttaggtatcagataaactgatgaaatgtagctgcaaatgaagtgatttttttcccctatgaacactagttaaaagctgtggaaagacttataagtccaagtcactaaaacacattactgtcaaactagatgaacattaagattgggggaaatcataaaactctagaattttatattgtgattactctgcaagtaatcacaatataactttaaccagctttaacaaatcaggaataggaaattgtcgacaatgtattatgttctggtccatgtgcgaaggatgatgtggacctcttaaccagtgggtcctctttggacccttattcaaagagtcttgccctatgttaaagaatgggcgaatgaatgcagatttatatacattgagtaaaaataagaattttagatatgtaatttttatgattttttgctgtgacttttttgattaacctggttcctggacctgattacattgaaaatgaggatttctactgttgtgattcagtttaaagttggtttgatttcattttagtgaatttagggtattttattttgcgtatggtaaaaacaataaaaccaacagtagtggggctttttaaactggggttttaaagcaaattaaggtggctcattctggattttagtaggttcttttgttcctctcattgacttgcagcatactgagtgagaaagacctaattttttcactttataaatgaggaaattgaagccctgagaggtaaagcatgttggtgatagtcatcccgggtggctggagtgaagtgggcagagccacagtgggagggggcctcctctctagcctcccactttgattatctgtctggccccagacctggagctttctttccatgataggagtacttctttgggttgacttctctggtgacagtattgacttgtgctccccactttggaacaggaccaacttggaggccttgcagaagaagctggaggagctagagcttgatgagcagcagcgaaagcgccttgaggcctttcttacccagaagcagaaggtgggagaactgaaggatgacgactttgagaagatcagtgagctgggggctggcaatggcggtgtggtgttcaaggtctcccacaagccttctggcctggtcatggccagaaaggtgagtttgccttgattaacaggtaattggattatttctcagggtacttagaagcctggggaccagggtagaaggaagactgattttactcaatacctttttgtgctgtttgaatttttttttttttttaagacggagtttcattcttgttgcccaggctggtgtgcaacctccatctcctgggttcaaacgattctcctgcctcagcctcctgagtagctgggattacaggcatgcgccaccatgcatggctaatttttttgtatttttagtagagacagggtttctccatgttggtcaagctgatctcgaactcctgacctcaggtgatacgcccgcctcagccccacaaagtgctgggattacaggtgtgagccactgtgcccagccgtgctgtttgaattttgaatgcttgttatctatattagattatggataaacacactaatgactgtgttagtgtattaatccccatcccatctggaaaataataagtgactcttttttagccttctgtgtgctgtggaaggaatgccaggatacctgtttattacttatcaagtgctggagaagctgctttcattcacccagccccagcgatgcacaaaacaaggatttcaagttgtttccctcttgtgctccagccctgccagtgaatcccctttatcttcctgcattatagcatctgaactcctatcatagcatgtacttgtagagctggacttccctttcctatctacccttggtcctcttttggaatacagccccttgctccagagaggttgggctcttcaatgtttttttgcacatggtgttcactcctgtgcccataatttttttgtgtgctgttgcttctgtcttttcaaacagtgcccattttctaggtccacctcttgtctagcttttaccaggtgccccagcccacactggtaaccactgcatccatgttctctgacactcgctgtctgtgggatttttttagaagttcaaccttactacgtaactatttaatgtgactgtcacttgtctccccagctggaacaagggaaaatgttaggatgacataaggtagcaccttagactttggcttagtctcaaccacatcaggctcctgagctcaaggaagaatcttttgggcagcctaggttagcatacctgagttcctcatacccttctactttcacaactcttgagtgtgaaccaagtcctcaaggtcaatttcttttcatatctgagctccaaagcctctcttggagtaagccctcccttaactttgttcctgtctaggctcccaggagccgaggcacagctggaacagcctccagtgccaatgcctgccttagtacaatgacactcatttcttggttgagcagaaacttgtttgtaacaacttaacctgtttctcctccctctaccttaaagagcttaaacatttaacaagactatatctttcatcccttcctccctctttctttcataaaacctctctttcttccacctttctccagctaattcatctggagatcaaacccgcaatccggaaccagatcataagggagctgcaggttctgcatgagtgcaactctccgtacatcgtgggcttctatggtgcgttctacagcgatggcgagatcagtatctgcatggagcacatggtatgtgacaccctctcagcctctggagcaatggccttaagagttgggtggctctggcctaatctttggtctgggaggtgaccagctacctccctgctgctcctgggatccacatcactatctggggcatctgggaagtctaactgtagagcttgggatattcacaagatggcaggcctcctttctaggtccttgcctctcttgaaggaagtgggcagtattcctggtgggtgtacctagagcacctctcatagtttttttgattctgattaccctaagatgtgatgtaagtaaaatctggtaaatacagtttaaatccatttcttgtgtacaatgctgtatgctaggtgcaaggctctggagttaaaaagatgacataatctactgtaagggcagcctgaagggtttctctgggtttctgtatgatgcacgttagtggaaggagagggcaatggagagagagggcattcatgggctaattaatcatatgcatgttagctgccaatcattttaccactatgttcttggagtccctccttttcttcagatataagtcttccaacacactgtgcaacttagggaattctgcaagtattagtctttgctttattctccctgggctgatggcttagagatgagggctgacgtgagtctgcacacttggtggctgttgtgctttcagtccagtattgtgtctctcagctcctaccccattttattcctgatacttgagacctgccctgacctttagaatagggatcctggtgtgcagccttaatgaactttagaagaaccctcctgggaggattctctacttgtgcctccattattttgaacctctcttcattgtaatgatcacgaagtgctgcatccactgttataggcatctgctgacatttgtgggtgccatatggaacctaaatcctaaaaacgtcttctgcacatctaaaggttagagaaagtgcttgttccttctttcctcaatgagagcagagcattctctgtgggaagcatatgaacatttctggcttggtcctagtgcttggcctggggtgctgattattttctgcttgggtcttggcttcccctcagggagctgtttcttatcccttgggtctcttgtgttcttttttttttttttttaatttatttttattttttagggtgatgaagggtttttttcccctttctttttttttctttttgtttttttagacagagtctcgccctgtcacccaggctggagtgcagtggcgcgatgtcggctcactgcaacctccacctcccaggttcaagtgattcccctgcctcagcttccagagtagctgggattacaggtgcgcaccaccacgccccgctaatttttttctatcattactagagatggggtttcaccatgttggccaggctggtctcgaactcctgacctcatgatctgcccgcctcggcctcccaaagtgctgggattacaggcatgagccaccgtgcccaaccaatctttttatttttcttacattgacctcttttgagatactaggaggcttcttcatttacattgaccttttttgagatgctaggtggcatccttattctggaattctttattcactttgaacttacagatgttgatcacatctcttgtgcccttgccatgtcctccccttccttcaagccttcctcctccttcaggagaaaatgacactggaaatgactggagttggtttcccattctcttagcccatttccagtgactgcaggtcagtttttccccccatggatttggctctctggaaatagtgagatgttcctgcacaagtctctggagttatcgtggagagcatgagactgggaggggaaaatgtttcaagggccaagcacagtgtctggcacctgttaggtggtatgtgttgagtgactgaatgagagtggccaggatggggaagacctggtcaggcttgggactcgatgggggagggttaggccttggagcctgccataggaccttttggccctgggtgtacatagacccagagggcagctagaatagtcagtcagtggtagtgaagaggctcaggtgctgccggagcgtctagatgggaccatgtaggaagcagctgtggcctgaagaccaggcagccatgagagccagagtggctttctgcttcagctctgggcactctcagcccttccttattcctgagcaggtcctgttgcaggaaaggccctgccctggcttcctctggatggaaaattctgactatgggctgctgcttcccttggaccttctgctttgcctcagcttcagtttttcaaaggtgttgtcaggtagagagacctctgttcgatagccacatcccagcttctgaaggtctttggtcctctctctgtcacagtctttgcatgagttttgtgtcatgaatattattttcccaacactttattatgaaaattttcacaggctgggcatggtggcttacacctgtaattccagcactttgggaggctgaagtgagcgaatcacctgagttcaggagttcaagaccagcctggccaacatggtgaaaacccatctctattaaaaattacgaaaatggccagacacggtagctcacacctgtgattccagcactttgggaggctaaggcgggcagatcacctgaggtcaggagttcgagaccagcttgaccagcatggagaaacaccatctctactaaaaatgcaaaattagccaggcgtggtggcacatgcctgtaatcccagctacttgggaggctgaggcaggagaatcacttcaacccagaaggtggaggttgtggtgagctgagattgtgtcattgcactccagcctggacaacaaaggcaaaactcagtctcaaaaaaaaaaattacaaaaattagctggcgtggaggcaggtgcctataatcccagctactcaggaagctgaggcaggagaatcacttgaaaccaggaggcagaggttgcagtgagctgagaccacgccattgcactcctgcctgggtgacaagagcaaaactccatctcaaaaaaaaaaaaaaaaaattctagcatgcaggaaaacctgaaggaagtgtacactcgtacacccaccacctagattctacaacttatgttttgagatatttggtttaccatatatccatttctccgatcaattttggggggcgcgtggggttctgtttttgtttgtttgtttttgagacagggtcttgcactgttgcccatgctagagtacagtggtgcaatctcagctcactgcaacctctgcctcctgggcccaagtgatcttcccacctcagcctcctgagtagctgggactacaggcacatgccactatgcctggctcatttttgtgtttttagaagaaatggggtttcactatgttgcctgtgctggtcttgaactcttgggctcaagcaatctgcctgtctcggcctctcaaagtgctgggattagaggtgtgagccaccacgcctggccctgggaatgtgttttaaagtaaatttgtgtcatcagcattggttgagccctgtcttctaaagcactcagccaggggctgatctttcctagaaataagctctgtgtgcactgcccagtctgaattttgagacccaaggagggaaattgatgctctctgatcagaacaggaatgcttttatctttggggaagtagattgctgctcaggttggtagctgagccaaccggagaactagggacccagagttaatggttcttgtgcaggaataaaagcttttgaactgttattttcataaagcatttgtctcttccatagaaaaccttcacaaaagcaccattgacttagttaataattggcttctaaaaataagcacaatttcagcagcttaaggcaaggacttggcaacagtgaattagaattagaaagttgtatggttagttgcaggcaaccctggggaatcctgactggtgtatgccccttacattttgtaattccatcgttcacactatactctgcttgaagctctgtggaggttaaagggaagagagccaatgtttcctttttgttttaaaattaactgattaattttacagatacggtcttgctctgttgcccaggctggagtgtggtggcatgatcataggtcactataactttgagcttctgggctcaagcagtcctcccgccttagcctcccaagtagcaggaggacaacagatgtgcatcaccatgtccagctaatttttattttttgtagagatggagtctcactactacgtggcccaggctggtcttgaactcctggcctcaagcaatcctcctgccttggcctcccaaagatttgggattacaggcatgagccactgcacctggtttgttttttcctttttaatagagatatttctcttaccaacccccaggggaagtgtaaaccaagacagttatctgggctgccccctgtcctaggctgcatttagggtcagttgagaggtagtgctggctgagcacagtgactcacacttgtaatcccagcactttgggaggctgaggcaggagaattgcttgagcccatgagttcgagaccagcctgggcaacaaagtgagactccccatctacaaaaaaaatcaaaaatagctgggtggggtggcacgtacctgtggtcccaactacacggaaggctgaggcaggaggatcacttcctcctctgagcatcagtagcattgtctgttctcttcattcaactgtttgttccctgccttgtttcagaggaggatttaaaatgccttacctcttatgaatatattctgtctccctaaggagagagtgtgttctatctttatcttaaaggtttaaaaaaagacaaaaaaaaaaaaaacctagttcttacatatacagaggcatttgataaatgatagaagatgatgataactgctcaatatagacaggatactttagaaaatttgttttgagttttcaggaattaggtctacatctgagagtaattttaagttgcaagtggtaactggctacacctgaagccataggggaacttaacctatttctgccttgatacatcaggatccccttagtgaggcatttcttcaagatcgcaggttaaaatgtagaaccccttaacgggagcccctggtatgtgagccctgcagagcctggcttcacaccatacttgcatcctctcttgtgctctctttccactgcctctgtccggcaccccattcatgtcatctcatctccttaccagtctctctgcctccagagtcttgtttgtctccctcagctgctgtgattctcatctttaaacactcaggttggattcttttacttctgactccataaagtcaagtcccggttccttggtggggttctggtcacagccggccatttctagcttgcacctcttcatgcaccaacagtgaaatgaccacatcatcccaggagtactcagcaacgtgatgcgtccctgctttgatcttattgcagtgctctgttcttctctcccttttctcctccccttttccaggtatagaaatcatgttcatcctttgagtaatattcagctcaaatgccatcttttaagtgaagtcagaattacttctcccttcttctgcatgtctgtatcactttcttaggcagttatggtttcattgtaatgttgggaaaaactcccagaccgtgtttttcctttactgtcacaccacaacaatcaacacagaagacttatgtgaccaaaagtgtggagggattttctctacactctaagcagtggacaccagctgggtgtcctcctgtttaattctgacactaccagatgatcatgtcagatcccatgggttcagggctcagtccccaagactgcaccaccaccagttgccagtctgggcctccaaaatgtctgactgactggctttaagttgggactcccatgatcctatctttgagttcgattaatttgctggattggcacacagaactcagggaaacacttaattttactggtttattataaaggacattgcaaaggatacagatgaagagacacataggacaaggtatgggagtggggtacgaagcttccatgccttccctgggcgcaccaccctccaggaacctccatgtgttcagctgtcctgaagttctctgaacgcagccttctggggtttttttgtgtgtgtatttttttttttttttttttttttgagacagagtctcgctgtgtcgcccaggctgagtgcagtggtgtgatctcggctcactgcaagctccgcctcccaggttcatgccattctcctgcctcagccacagccgaaagttatcacttgaaagaatagttagaacattgtcactaactggtctggtattctcgatcttaggatggaggttctctggatcaagtcctgaagaaagctggaagaattcctgaacaaattttaggaaaagttagcattgctgtgagtatgttatgaagtttttcttctaagttcctcattgataagttaatgagtcggtaagaaatggacaagagaggaagatgggaagtcaatgaggggaaagtttataagaaaagtggtattttctcactagactcttccctgtctggagtctatatacactattctctctcacattagaatgagaaaagtgactttctttatattaaaatctgtgtgtcttgaaaaacgggccaggcacagtggctcgcacctgtaatcccagcactttgcgaggccaaggcaggaggactgcttgagcccaggagttcaactccagcctgggcaacatgatgagacctcgcttctacaaaaaaataaaaataaatagctgggcgtggtggtgcacacgtgtagtcccagctacttgggaagctgaggtgggaagatcacttgagaggctgcagtaagccataatccatgattgtgccattgcactttagtctgggcgacagagtgagaccctgtctcaaaacaaaacaactctttataccatgtaaaaagatggttgcttgataaggcaggttaagaaaatgaaacaaaagagtaaaaaataaggggctgggcgcggtggctcatgcttgtcatcccagcactttgggaggcggaggcgggcagatcacctgaggtcgggagttcgagaccagcctgaccaacatggagaaacccccatctctattaaaaatacaaaattagccgggggtgttggtgcatgcctgtaatcccagctactcgggaggctgaggcaagagaatcgcttgaacccgggagggggtggttgtggtgagctgagatcacggcactgcactccagcctgggcaacaagagcaaaactctgtctcagaaaaaaaaaaagcccaggcacggtggcttacacctgtaatcccagcactttgggaggccaaggtgggtggatcacctgaggtcaggagttcgagactagcccgacaaacatggagaaaccccatctctactaaaaatacaaaattagccgggggtggtagcgcatgcccgtaatcccagctactcagggggctgaggcaggagaatcacttgaacccgggaggtggaggttgtggtgagccgagatcgcgccattgcattccagcctgggcaacaagagtgaaactgcgtctcaaaggaggaaggcaaatttgtgatgatgataaatgaagtattttcctagagtattttaaaatagattgagtatttttcttatcaccagtattttcttttcttttacattccctttcctctaggtaataaaaggcctgacatatctgagggagaagcacaagatcatgcacagaggtaagaagttatttgctagttattttgctttgaattttagatataatccaaaggctgttgcttcctcttttttctatgttttgttttcgtgtaaaagccttttaataacatgttaaatcttttattaaaagtctttgtttagtttggtggctgaggcagcaactcctaccctctttttggtcttgctacacctattgcctatagctgtgatggacaatagtcatagtcaccctggaagcccagctaagagcctcaaccagcacttagttacccagtctccggtgtcactattcactggaacagtgaacagtgcatgtgcatatgcctaaagccaggactggccagctgcatatgagttttactataaaagaaactgatttattgctgggtacagtggctcatgcctataatcccagcactttgggaggccgaggggcagcggggggaggtgggggggtggatcatgaggtcaggagttcgaaaccagcctgacccaacatggtgaaacccccctctactaaaaatacaaaaattagccgccagccatggtggcgagcacctgtaatcccagctacttgggaggctgaggcaggagaattgcttgaacctgggaggcggaggctgtggtgagccgagattgcactgctgcactccagcctgggtggcacagcgagacacagtctcaaaacaacaacaacaagaagaacaaaacacattaaaaaaagaaagaaactgatttattttaataaaggtacacatacacttaaccatgtgaccataccatcttaggcatttgtccaagataaaatataacatgcatccacacaaatgtttaaagaagctgtatttcttgtagaaacaactgaaatgtccttcaacaggcaaagagagaaacaaattgtagtatatctatacaacagaatactcttcaacaataaaaatgaaaagactactgataacacctaactttgaatttcaggaacatttatgctgagtgaaagaaggcagatacaaaacagcccaagctgtttccatttatgtgaaattagagaataacaacaaatccatagtggcagaaagtagatcagtggttgccttgaggggtctagggagagattaaaggagcatgaaggaactttttggggtgacacaaatgttacatctttttttttttttcaagagcacacatccacttctatgtattgacttctcattagtttaaatccttgaagggggctgggcacggtggctcatgcctgtaatcccagcattttgggaggtcgaggcgggcagatcacctgaggtcaggagtttgagaccaccctggccaacatggtgaaaccttgtctctgctaaaagtaccgaaaattagccgggcgtggtggcgggtgcttgtaatcccagctaatcaggaagctgagggagaagcttgaacccgggaggcagaggtcgcagtgagccaagattgcgccactgcactccagcctgggtgacgagcaagactccgtctcaaaacaaacaaacaaacaaaaaacattctggctaacacgatgaaaccctatctctactaaaaatataaaaaatagctgggcgtagtggtgagtgcctgtagtcccagctactcaggaggctaaggcaggagaatggtgtcaacccaggaggcggagcttgcagcgagcagagactgcgcaccactgcactccagcctgggcgacagagtgagactccgtctcaaaaaaaaaaaaaaatccttgaggggtacagcatcacttggattctgtttccaatagccatagtaggaagagtgcttcagaatttggcacaaactatgccactggttctgtgggcccgagttacctttctccagattactccagtgttgtttggtttaccaccaggagtcactgtgttgttctttgctttgtatacataagcacatctcttgcccaaatagaattctgtttcatctcgggcataaacactttcaattttaggaagaactgcctgctcccattggttccggataccctgcttatagccggcaaaaatggccttgcaccacagccttccacatatttccttttagaagtcctgttcccagcaggcctccatggcatccaagatggcgggaagtgcaaatgttatatcttgacaatggtgatggatacatggctatatacattcgttgaaagtcagctgtccactaatgtgactgcattttatagtatgtaaattatacctcagtatagttgcttttaaagaagatgaagccagaggacaggaaattggtaaacatagtgctgtcggccatgtcccttcagccacagcactgccaacactgactggtgttgagaggagagctgaagcggagatgagtggactagggtgggctgttggaactgactggacagcttacaagccccgtagattaggtgatacatcactggtgagcaagctgagcactgagtggagccacctttgacatggctgactcctggatgcattttttttttttttgacgtcccccttctctcccctagtgttctttttgttagtctaacttcttccagatactgatctttcaggtcttcagttagaggtcacttaattatgacagtgtttgcaagtgttggagggtggttctgattcagtaggtctggggtagggcacagggacctgaaaatttagaaataggcaattagctgggcgtagtggctcatgcatagtaatcccagcactttgggaggccgaggcgggcggatcacttgaggtcaggagtttgaaaccagactggccaacatggtgaaaccccgtctccactaaaaacacaaaaattagctgcgtgtggtggcgtgtgcctgtaatcctggctactcaggaggcttaggcaagagaattgtttgaacctggggggcggaggttgcagtaagctgagatcatgccattgcactctagcctgggcgacagagactctgtctcaaaaaaaaaaaaaaagtttaattgtaaaaaatatatacataaaatttaccattttctcaagttttcagtgtatagttcagaggcattaagtacattcacattcttgtgcagccatcaccaccatccatctccagaacttttttcatcttacagacctcaagctgtgtccatgtaacaactctcaccgggcgtggtggctcacacctataatcccagcactttgggaggatgaggtgggcagatcacctgaggtcaggagttcgagaccagactggccaacatggtgaaaccccctatctctactaaaaatacaaaaattagccaggcgtggtggcacacgcctgtaatcccaggtacttgggaggccgaggcatgagaatcacttgaacctgggagacggaggttgcagtgagctgagattgtgccactgcactccagcctgggcagcagagcaagactccatctcaaaaaaaaaaaaaaaaaaaaacccactatttccccctttccccatccactggaaaccaccaatctaccttctgtctctatgagtttgactactctaggtacctcatatgagtggaattacacagtatttgtcctttagggactggcttgttttagttagaataatgtcttcaaggttcatccatgttgtatgatgtgctagacactggttcttaagtaagtgctggttctaatgctgtggtccatagccacattttgggaaacactgcattgggggtagagtgagtagctaggtgggctgtgtagaaagaggagtaatggcagcttgtcctagtgggatttgtcgggagaaaagaaatagaaaatgaagcacaaagaagaatattgtgcaagtgttccctctcatttccagggaaaatttctcaaaatattgaaagatttctgtccatggcagacttgtagttggaatttgcatgaccagcttatagcttgtacatatggttcagttttgtgcatctattaatttcaacctgggccaccaaactgcattgttaagaactagagactattggctgggcacagtggctcacgcctgtaatcccaacacttggggaggccgaggtgggtgaatcacaaggtcaggagttcaagaccagcctggccaacatggtgaaacccccgtctctactaaaaatataaaaaattagctgggcgtggtggcggatgcctataatcccagctactagggaggctgaggcaagagaattgcttgaacctgggaggcagaagttgcagtgagctgagattgcgccactgcactctagcccaggcaacagtgtgagacactgtctcaaaaaaaaaaaaaaaaaaaaaaaaacaacaacaaccaaaaacattcagagagaggacaaccattttggaaaacaggtattaaaatttcttgttaaattataccaccatgaactgcactccttggcatttacctaagataaatgaaaacatttgctcatgcaaggacttgttacacaaatattcatagcagctttatttataattgcccaaaattagaagcaacaaaaatattattatcagatgagtgggtacattttagtgtattcaaacaatggagtacaactcaggaataaaactattgatacatataacttcgatgaatctcaaaaacatgctaagtggaagaagccctgtacaaaagagtacatactgtgagagcctgctaatacgaaattttagaacagacaatccacagtaacatatagcagatgagtggctgcctgagggtttagaggtagggatagtttaacatcaaagtgcataagggaacttttttggagtaatagaaacactaaatcttgtttgtggtaataggttcacaggtgtgaacatttttgaaaatgcatgaaagtatacacttaaaatggtaactgtaggctgggtgcggtggctcacgcctgtaatcccagcacttcaggaggccgaggtgggtggatcacctgaggtcatgagtttgagaccagcctggccaacatggtgaaacccccgtctactaaaaatacaaaaattaagccgggtgtggtggtgggcgcctataatcccagctacttgggaggctgaggcaggagaatggcttgaacctgggaggcagaggttgcagtgagccaagatcatgccattgcactccagcctggacaacaagagcaaaactgtcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacatacccacagccaatatcataccgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactcaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaccccatcaaaaagtgggtgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaataattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacttggacacaggaaggggaatatcacactctggggactgtggtggggtcgggggaggggggagggatagcattgggagatatacccaatgctagatgacacgttagtgggtgcagcgcaccagcatggcacatgtatacatatgtaactaacctgcacaatgtgcacatgcaccctaaaacttagagtataataaaaaaaaaaaaaaaagaaaaaaaaaagctaaatatagaaagccacctgctttctaattgtactggctgccatcttgtcttctttctactgacaagaaagtatcaataagaggtagtgattggtttgagggggaaacagtttttctaccagtttagtccttaatctgtggcttcttaagacctctgagttccatgttagaatattttaatgtattagtttctaggaaataggagtagctgaaaggagaggaggagtgaacattcttaagcatggagttatgttctaggctgcgattgacatatgcagtctaccactatgcaaggacgaatgaggtcagtgttgtaggaacatctggtggagtaaaggcatcccatcatctgtgaagtggagtccgcctgcctactcagaggttgctgtgaggattaagaaattacatatggaaagcaactggcaaagtgttttgcttatagaaagctctaatatgctaattgccttccccgtttctttatataatttataaggaaactaaaaaccagcgattaaaaccttagctttggtttctatatgtgtaaaatatagttcttatgtttgtctctcattaacctgtaagtttcttcaaatctgggaacatgtctaattgctgtgtatatatcttcagtcctgaagatgatagtagaaaacagttcttctttgaaggtttgttacatggatggatggatgattaacttgtgccagaacacacaggagtcaacagtgaaactgggccaaggacccatgtctcttactcttaacacagtgtttctttctagtcctgtgtttttctgtactatgtacctactatggatcatgccctgtgttttgcaatgaagacctctaactttatttccattccaaggagagggaggtttcagcacactcctggaacaaccagctttcttttcccttccgcctagtgctgcccccacctgcttagggctttcttttttggcttcaccaattgttgctctttggcatgaagagatgctttgtgagccagatgggtctctgaacagatgtctttgatggagagtttaccacttgcacagccaagaaagggaagtcactagaaggacttctgtgtgggctggcctggctgctcagcatttcagactcctgttgtttacaagtcttctccagaagccctggaagaatgaactgtaaggcctggactatggaatggtacctgtgcaccagcaattcctgagcaagcagcacagtgagtaggtgattcctggaaacctgagttcaggtgaaaatgagagagagcagtctccttgtccctgcctatgggcttcctcatggccagttctacctctgttctaaatatattcttcactgatgaaatttcaacttcatttattcttctgtccttgaggaaaagtggggaagagtaaagaggtcttttctctgcctcaaatttttatttgttcttatttgttgatacttatttgctggagatagcttagtggtttttttctctttctttttgagacagggtcttgctctggtgcccaggcttggagtacagtggtgcagtcatggctcactatagccttggcctcctaggctaaagcgattctcctgcctcagcctcctgaagtgctgagactacaggcatgagctgctaggcttgggttgattatttcaattaccatttgctatgtaacgaggctccaaaacttagtagtttaaaataataatttattaccttacacagtttattactttttctgtgggttggcaggtcctctttccccatcctctgtgaggctaaagccctggtttcttccagtagcaagagggggtaaaccctactacttaagtaccctttaagcctctgcttatgtcaagtttgttcatgtccatttggctaaagcgggtcatgtgtttcaagccaagatttaaaaagtagagtgaagtctccatctcttgttgggaggagctatgaaatatggtggcccgtttttttccactgtatcacagtgataaagttgaaggttcaaattgtgactgtgctacttgttgtgtaaccttggatgagtcatttaacttctccaaacctcaggaaaatggagaaaacagaacctacctaaagggttgtatgcagattaattaatacatacaaagcacttagaatagtacttaacatgtagtaggcacttaatacattttacctgttgcttagataaattggtagaggtttttatgattaccagcaacagaaaccagcctgacttggtttaagcttctaaaaatttattcattagaaggatctggctgggagcggtggctcatacctgtaatcccagcactttgggaggctgaggtgggcagatcacaaggtcagcagttttgagaccagcctggccaacatggtgaaaccccatctctactaaaaatacaaaattagctcggcgtggtgccgtgcgcctgtaatcccagctgctcgggaggctgaggtgaaagaattgcttgaacccaggaggcggaggttgcaatgagccgagatcgtgccactgcactccagcctaggtgacagagtgagactctgtctcgaaaaaaaaaaacaaaaaaagaaggatccaagggaagttcagagagtcctttgacaagctgatcctacaaaccacggtagggtgggaaccaaggctactctagttgggaggttggctcagtcaggcagagaaatagctccctggcgtacaactctaacagtgctattgctgctgggccaactgtcctctcctagccttatttagggggtaggcatgggctcagtgatctcccagaggggtccagagtcagtgcctctgaagaatccactctcaccacagtcatgcagatatcaaggggacagcatcctctcctgctcagtgttgggggctagttgatagtccattgcctagtccaggttgaaagtgatttctgagtgtgccctgctctaataaaaagtaacgtacaaaaatagtttataacacaaggtgctctgggtgcaatgttttgctctttcaaagcattcactctaggtaggattcttcaaatagaagttttcatagaatcttgaaaaaggcaagcaaattacatcaatttgattcatacatttcttcttaggaatatgtcagtgatttaaaggtaggtattcctgcacttaggaatttttaaatgagaagaagtgcctcgtggtattttgaggaagattagctgttttcaggtaccatttagttactgtttttccacctaggtggtagcctcttgaacatttttcagttatctttcttcagctgggtgagtatgtcctggtcctagtttggtacattgccttggttgtacacatggtagttttcctacatttctaatgtgtctgcaccaggtgggaacccaaaggcaagcatgttctcaccctcattcctgaagtgatttgtctctgccataatggagcaggacttcttgggcagaataagttcaactgacagtcccagtgccgaagctctggctagctcaactggtccactgtgatttgttctgttattatacagaacattgtattctatttcccctgggtgttcaaagggagaaacaatctgtgtggtttagcctgatgtatgtgatttgtgagctgttgatcagggggtgggtatagatctgtcacccctttggggagtgttaagtttctctaaaatctctgggtgacattctgacagtcatgggtaggtacaggtatatgctcctccgtgtctattcgcctacctcctcagtcttttcccccatcaaagagaagtaattcattttgtaaaatatttatagaatacctgccaagtgcaaggtattaggtgaattactcgttaggcataaagttggctcataaatgaattgtgtcctccaggagcttagagtctaatgggaaagggacatatctgtaaatgactcttgtatattgtggaacatagccaatatcatttttttgtgcgtgaatcactaccctgccaactttcagatagaatccgatgtgacatagtgacatagattattagtcagaattctttggtgtggcagaaacccacctcaagattacttaatcagaaaagagaatgtatggtttgggtcaccaggaggtcggaaggcagggatgaatatgaggttgaaatgatggcctcaggtcacctctcagctttgctcattcttgtgtgggcttccttttcagtcagattctcttcactggaggcaggatggacctcactagccccagacacatctagtccttagtgctccctatcccagagaaagtactccacccactctccccagcatccagatcagtgtttgaaccactgattggcagactgcctctgcttggagtgcttgcccatggctggaccattcactgtgtccaggggactagtgttgcctggtgggccaccctgggttatacactcacccctgtggtacaacagatggcgcctcttgatgaacaccctagcagaaacagttgatgctggggaggagtgtatcccaaatgaaaaggaggggctttgttaccaggagatggggagaatgaatgggtgctgaaagcaagcaaatttttaaaaagttttccgcttacaaattctgttaagcattgggtcagaaagacaaaacactaacataggatgaaaacaacaagcagttaacacaggtgtgagcaaactggtccatgggctaaatttggcctgctgcctgtttttgtatggcctgcaagctaagaatagttttcaaaattttgtgacatgtaacaattatacaaaattcaatttattattatttttattttttgagaccgagtctcgctctgtcacccaggctggagtgcagtggcgtaatctcggctcactgcaacctctgcctctcaggttcaagagattctcgtgcctcagcctcccaggtagcggggatcacaggcatgtgccactacgcctgctaatttttttgtatttctagtagagacggggtttccctatgttgcccagcctgatctcaaactcctgggctcaagtgatccacctgccttggcttcccaaagtgctgggattacaggcatgagccactgtgccctgctggaaattcagattattgtgtccataaataaagttttattggatcacagccatgcttgtgtaaatgttgtctgtgcctgcttttgtgctataatggtaaatttgagtagttacttgtgaaagagatgactgtgtggccctcaaagccaaaaatatttactctctggtcctttttttatagaaaaatcttcctaaccaaaaggggaaggagaatcccttgacagaagctttagaatttaagcacaaaactgggcttttaagcacaaaactatggtggctgtagcctgtaatcccagcactttgggagatcaaggcgggtggatcacctcaggtcaggggttcgagaccagcctggccaatgtggtgaaaccccgtctctactaaaaatacaaaaaattagccaggcatggtagcagacgcctgtaatcccagctactcaggagcctgaggcaggagaatcacttgaacccaggaggcagaggtttcagtgagccgagatcgtgtcactgcactccagcctgggtaacaagagcaagactgtctcagaaaaaaaaaaaaaaagaatttaaacacaaaactaaacttttaaatgtgtcagctttaagttctcaaggaaaacatgataagtgacgtgggtaggagacaggattatttttcctgatcctggagctctgaaaagaattagctgccaaaatttatgtcgagtcttttcatctgaagctgaaccaagtaggtagttgtgctgtgagttaaaaagggttggaggtgaagagggcgctaggatactgctctctttcattctatttaaagcaataatttgcattgccaccctgccgttcttaacctgctctaattatcaaggccttattttgactaagaccctgaaaaagcgttgcatgatttagatcaatacgcagttcatccaacttagccgtaaattatttctgccttggagttgttagctgataaagatcaataaatgttaacaacagttttaaattataactcaacttgtttttcttttccttctatctaatgaaaccatgtgtaacctagatttttaaattttacgtatttatgtgtgacatgtatgtgtgtatgtataaatgaacgaatgacaggtctcgctcactctgtcgcccaggctggaatgtggtggtgcgatcatggctcactgcatcctcaacctccccagctcaagcgatcctctcacctcagccttctgagtagctaggactacaaatatgtgctatcatgcctgactaattttaaaaattttcttttctagagatgcggtctctctctgttgcccaggttggtcttgaactcctggactcaagtaatccacttgtctgggtctccctaagtgtgggactactggtgtgatccactgtgcttagctgccagcttagatttttgaggggtacatagcccactgtaattggatacctctcttcagagccatagtagcttattataccttggggccatcctgcttggagtgtgcctcaaaagtgttcctttattccctaggttagagagttatgtaaaaacggggctctcaggtcagaatgagatttaaggcttctgcagagcctatatgaaagtgtttttgggccgggcacagtggctcatgcctgtaagcccagcactttgggaggttgaggagggcggatcatgaggtcaggagatcaagaccatgctggccaacacggtgaaaccccgtctctactaaaaatataaaaattagctgggtgtggtggcacacgcctgtaatcccagctacttgggaggctgaggcaggagaattgcttgaacccgggagtctgaggttgcagtgagccaaaatcgccactgcactccagcttggcaacagaacaagactctgtctcaaaaaaaaaaaaaaaaatgtttttgggctgggcacagtggctcatgcctataatcccagcactttgggaggccaagatgggtggatcacttgaggtcaggagttcgaaaacagcttgaccaacatggtgaaaccccgtctctactaaaatacaaaaaaattagcctggcatggtggcgggtacctgtaatcccagttactcaggaggctgaggcaggagaatcacttgaacatgggaggtgggggttgcagtgagccaagatcacaccactgcactccagtctggatgacagagcaagacaccatctcaaaaaaaaaaaaaaattttttttgtatccttttcctggggagagctgggagtctccaaagtgtctcacggtgtcccagtgacagcctccagcaaatggggtcttcagcaatggtcaggattacaacctctaaattcttcctctccattcagacttgttggcactgatagcaagatctgaagtggcttgtttggttttgttttgttgttttataagctgtttgtagcagactcacacgtaatgatttgagtggtttcttctgcaatttttgcaaggaactatgctgcctctgccaggcatcgctgagcagaagtcagagtggcccctgcctccaccagcctgaggctacacacaggattctgttctgagcatggttcctatctgtgtgtgactaaggactgttgtctgatccttgaaacacagaaggttgcccatggtatatacacaaggtgctcctggctacatctctctcccatcacagccatcccatagctgtgtggcttacacaggaagggattccttttgactgtgtcagactgccctgccttaaagatggagggagacagagtggctcattagtagtggaaaattcagtatgctggtctcttggttagaaatgtgagtctcgttttatctagaattatttcatctgctagattcacagtgatgattatagctccaggtgagtttgtctcttagctccttaagagaggcttagatctctttagggaagcatggaggagatggtatttgagctgagctttgaagcataggtagaagttatatatgtggcagggtcagggaaaggaattccaggtagagggaagcatgaatcatggcatagaggcaggaaaacacagacatgtttttacaggaaatagcaagtggttcaagttgtctacaacaaagggttcctgatggcaaggggtgagaattaaagtaagaaatagttgaagcagtgaggagggtcttcactgccatgttcaggaagtggattttatcatgggcaacaggaagcagtggaatgatcctgcacagagaagtgagatgtgctgtggtttaaggaagaggactctactgttacggctaaggtgagctggagaggggagaggtcaattaggaggccgttgctatgggccagtgagagataagggggggtctgagttaggatagtggcagagtgaagggacaggatggggacagatgggagagagatggtgcaaagggcagggactggtgtgggaagatgggtaggggagtagcagggagacttggccttggcccttcctggggtggttgtggtgggaaggagcctgaggcccatggccgtgctccagggctgtacgtggagagctgtgttctcctcctcctcagatcacaaagcctcatttctaatggaaacctgaggctggggctgccctttcctaagttacagattatttcctgaggaggatcccagccctaagagagctggtttgatttgaaaatctggacacataggaatgaaactcagagtgaattttattaaccactacccaaagcaagatggaacttagctcatgatgcccaacaccatagaggaacaagagtgggctgggcgcagtggctcacgtctgtaatcccagcactttgcgaggctgaggcaggtggatcatgggagggcaggagtttgaaaccatcctggccaacatggcgaaaccccaactgaaaatacaaaaattagccgggtgtggtggtgggcacctgtaattccagcaggcttaggcacgagacttgtttgaacctgggagatggaggttgcagtgagtcaagattgcgccactgcactccagcctgagtgacagagtgagactctgtctctaaataaataaataaataaataaataaataaataaataataaaataataatagagtctagtgatatagctcagcttgaggatgggaaccagcataaggcttgataagaccaaactaattagaaacaaacacgatggaattttcttttttcatttgaaaaaacatttcaaagtttattgttggaggtaagtgcttaccaccctgtgaagtgcgtgcagggctgtcattaggtggtggtaacaggcaccaaatccccaagaagctgctacccaccaagtgacctccgagccactgtgtcctctccctttacctttctggctatgcatagaaccttatggaagtttccttctagcctggctgttggcttcctgggtgatcctggcagagttgtttattatttctgaatctcaccttcttttagaggtaatctcaattccttttccatctcctggaactgtcctcaggatcagatgaaactctgaccaagtgttgtgtaatagcattaaagttatggcatttaaaagcacattgcgtatacaatgctgggctccaaagaggcagaagagatagttcctatcctcttagagctgtgagtcctagttggaaaagcaagactgtactttacaagtcagatgaaaggtttatgggtgaattaacacatgaggtctgggatttgccttaagacattccactccctcccaccctgcaaagaaaaagctgggggttataatgaaataagattggggcggggcacagtgactcacacctgtaatcccagcactttaggagctgaggtgggtggatcacctgaggtcaggagttgagagtagcctggccaacatggtgaaaccccatctctactaaaaatacaaaaattagctgggcgtagtggcacatgcctgtagtcctagctactcgggaggctgagacagaattgcttgaacccgggaggcggaggttgcagtgagccgagatcgcaccagtgcactccaccctgggcgacagagcaagactctgtctcaaaaaaaaaaaaaaaaaaaagattggtaaaaaaatggattattgttgaagctgggtgatgggtacatggttactgtctctacttttgtgaatatttagatttttctgaaaaaaaaaaattggctaaaagaaaatagcatatgtactgacataacaagtgacatacatgataaaaaacctcaagggttccaaggagagggactcttgtgggtggacagctgtcaggggaggcttcacagaggagctgggagctgggctttgtttcagtgaggattcttggttacacataacagaaaccaacttgagccagtgtaaacacaacaggggacttccttatagggatccagggggcccttagggaacgtgaggaccagatgtagtcagtgctcgggaagggatgggacaagacagggaccagaaagccactggaattctaggcggccttcctgcttattctgcgtgctttgcacttgtttctttgcttctctgtccagagggcaggaggaagacaccacctctcagcaaccagtgtgtatcaagtccatcccagacacagcccagattcaacctgaccctcttagcacaattcccaagtctctgagtaatccaccaacacttatatagtgtacattgtgggtggggctccttcgggtgagtgaagggaggtaattagggggatacatctgaattaggaagccctcctttctcccttcttcatttgtctgaatcagactggaaggacagtaggatatacgtgaagagagaagatatctcgattgaacagtaagtgcttcagagtcaaacacgaagggaacatatatggaacagtatagatcctcctggcactgagggggtgtgaaccccaaatatctgagactactctcagttaatttagaaagtttattttgcctaggttgaggatgcatgcccatgacacagcctcaggaggtcctgacaacatgtgcccacggtggtcagggcaggggttttttcattaatttttgaaacggagtctcacctcttgttgcccaagctggagtgcaatggtgcgatctcggctcacttcaacctccacctcctgggttcaagcgattctcctgcgtcagcctcccgagtagccgggattacaggcgcctgccactacgcccggctaattttttgtatttttagtagaaatggggtttcaccatgttagccaggctggcttcaaactcctgacctctggtgatccacctgccttggcctcccaaagtgctgggattacaggcgtgagccaccacgcctggccagaggttggttttatacattttagggagtcgtgagacatcaattaatatacgtaagatgtacactggttctgtctggaaaggcaggccagctcaaagcagggaggaggctttcaggtcacaggtaggtgagagacaaatggttgttttcttttgagtttctgattagcctctccagaggaggcagtcagatatgcatttatctcagtgactttgaatagaatgagaggcaggtttgccctaaacagttctcagcttgacttttccctttagcttagtgatttttgggggccccaagatttattttctttcacatttccccccttttctttttaaaaacttttgagaaagcattttagaagaaaatgaatctttcgtctcaggtttcatcggatctctcgcggctaggacagtttattcctagacaggtaggtaggtcccaagttactaggaaagctcatttttagcaggttgtggtctcatgtcctatgatgagaaaatagggggagaaagggagaaaaactacaataaacaaaagaataattctggaaaagtgatataggccacattattctgaagtccatacatcagtaggcaggtatgaaggtggcttatgtatgctgttattttcttttgaagttgtctagcttcggttcacagggctttaagaaagcacagcttagttttcagtaatttcaaattaggaaagatgggaaaaaggaaaagaaattgaaaacattgttttttttgtttttgttttgagacggagttttgctcttgttgcccaggctagagtgcagtggcgtgatcttggctcactgcaacctctgccttccgggttcaagcaattctcctgcctcagccatcctgagtagctgggattacaggcatgcgccaccatgaccggctaattttgtatttttagtagagacagggtttctccatgttggtcacgctgtggtctcgaactcccaacctcaggtgaatccacctgcctcggcctcccaaagtgctgggattataggtgtgagccaccgtgcctggctgaaaacattgttttagagacctgtagccaggaaaaattagaattaagtccaaactgtaaaaaatgataaaaattgaaaaactaggtaagactagaatctaacaggtgtactatagccaggcacagtggctcacacctgtaatcccagcactttgggaggtagaggcgggtggattacctgaggtcaggagttcaagaccagcctggccaacatggtgaaaccccatctctaccaaaaatacaaaaaaattagccgggcatggtggcgcatgcctgtaatcccagctacttgggaggctggggcaggagaatccttgaaactgggaggcggaggttgcagtgaactgagattgtgccactgtagcaggacaagtcgcagacaaaacccctcagacaccgagttaaagaaggaatggctttattcggctgggagcttcagcaagactcacatctccaacaaccaagctccccaaatgagcaattcctgtcccttttaagggctcacaactctaagggggtccacgtgagagggttgtgatcgattgagcaagtggggtacacgactgggggctgcatgcactggtaatcaggttggaacagaacaggacagggattttcacagtgcttttctatacagtgtctgtaatctatagataacataaccgattaggtcaggggtcagtctttaactaccaggcccagggtgtggcaccaggctgtctgcttgtagatttcatttccgccttttagtttttacttcttctttctttggaggcagaaattgggcataagacaatatgaggtggtctcttccctcaccaccacactccagcctgggcaacaagagcgaaactccatctcaaaaacaacaacaacaacaaaaaaacgggtgtactatagtttttgaaacgtattttttctctctccactttcctgtttttactaaagacaaatcatggtaggaccaatttgctttattatacttggacagattatttctatgaagtacagtaagaataattatttttcacataggcttttaaaattggccttgatggaactttgctctgtagaaggaatctcagataagactttttttaaagataagacttttttaaagctgagcccagccatggatttgtaccatcaaatacatacaagttgggtgaattcctctcctcttgatgtcccaagataacttggggctcctgggcctatcagaaagtgacattctttacttaccacaggccaagatccctgtacagggactgtgtagacaaggtatgaggccagttttcccaaggggcttttattggctttataaatcaagttggattccttaaaggaaagcacaccattctagtcaaagccttggtaaaacaaccagtttctccaattgtgtcctgttacaaatgaaaacagatttttattgcacatatgcagataactatattgccgtaagttaagaatactcccacatagtttccaaattctggagtaatcaggtagagagaaacaaatatgcttcaatttttttcataggcgtatgtatactttattgttaaaacctggctgggcgtggtggctcacgcctgtaatcacagcactttcggaggctgaggcgggtggatcacttgaggtcaggagttcaagaccagcctggccaacatggtgaaaccccatctctactaaaaatacaaaaaattagctgggcgtggtggtgtgtgcctgtagtcccagctactcaggagtctgagacccaagaatcacttgaaccctggaggtggaggttgcaatgagctgagatcatgccactgcactccagcctgggcaacagagcgagactgcatctcaaaaaaacaaacaaattgttaaaacctgtcaatagctcaaaagaaaagtttccgtgactctgaaaaacaacacaaagaatcagcagcatttaagcaaaaaaataaaaaagattacttcagtctcctgtaagttcagttcatgcagttaattcctgttctgcttgatattcatgaacatttcagctctccatgagtcatgaaagtttttcctctgttttgatgtcacagtctttaaagttatcagaagcctgtattcaggagcacctgttagagttttatagttgattataaaaccaccttttaaagagaaactgcagggctgggcatggtggatcacctgaggtgaggagtttgagaccagcctggccaacgttgtgaaagcctgtctctacaaaaatacaagaaattagtctgggtggtgatgagcacctgtaatcccagttactcgagaggctgaggtaggagaatcacttgaacccaggaggcggaggctgcagtgagccaagattgtgtcattgcattccagcctggtcaacaagagcgaaactccgtctcaaaaagaaaaaaaagagaaaccatcattgcaaaattataactgagacagtgaaaaagatctgaccgaactgactccatgttgcttctaatctccaagctgtccttgttcattcctgggcatagacagaactaactttgggaggaacttagtttatagttgagctttgaaacaaagacgataacagccttttccccaaacccccttcctgcctggggactaggctgcctaaagccacatgattagaagttatggttattttactaaataattcaagacttagctattttcactaaaccaatgtcagtctctttcaatatttacagaagcaaagatcttttttttttaaacaaagtctggctctgtcacccaggctagagtgcagtgacatgatctcagctcactgcaacctgcgcctcctaggttccagtaattctcctgcctcagctttctcagtaactgggattacaggtgcctgccaccacgcccaactaatttttgtatttttagtagagatggggttttaccatgttggtcaggctggtcttgaacttctgacctcaagtgatctgcctgccttggcctcccaaagtgctgggattacaggcatgcgccaccgcgcccggtggctcacaagcaaagatcatcctgttttgggctgggtttatagttttgtaatccctatgccaaattttgacaccttataatatttggcagggatacatatgaaatttcttgatcaaaaaatgcaaacaaaaatgtaccctggctattcttaaggcatttctaatagtactttaccaacaattttaaaggtagcttatctatcaaagattttacgtaaacttgagaaaacatttgactagtctttcattttctgataaggtatttgatttgtgcttttatttttccttaagccaattaattagagctgttttatattttttagtagtaaatcattgtgtacacaacacataaatacgtggacatattagacatactgatagaagtacatcttaaaggtaagacagacctcctttttttttccccccttctgtctaagacttgcaaactcttgataacctgtttcattatgcttggcagttgtcagctaaatagctcctaaatctgcgtattgaaggacacaactctttggtgaaaaatcagatagcaaaatttacatcataaagtacagagaggaaaagtctggtggtgctagaggaagattaaaggtggatgccaaatcaaacatacaattatagaaatctatcataggattgtataaggagaccaatttatttagataggtactacctatcttaactggatctctgagttctgagtagagcccacactgaattctgggtctccaaaaaggaggctagaccacatgatgcttttaaaaaaaatttttttttggctgggcgcggtggctcacacctgtaatcccaacactttgggaggccgaggtgggcggatcacgaggtcaggagttcaagaccagcctggccaacatggtgaaaccccatctctactaaaaatacaaaaattagctggacgtggtggtgcgtgcctgtaatcccaactacttgggaggcttaggcaggagaatcgcttgaacccaggaggcggaggttgcagtgagctgagtctgtgccactgcagtgagctgagtctgtgccactgcactccagcctggcaacagagcaagactccgtctcaaaaaaaaaaatttttttttttggctgagcacagtggctcatgcctgtaacctcagcactttgggaggccgaggcgggtggatcatgaggtcagcagttccagaccagcctggccaacatggtgaaaccccgtctctactaaaaatacaaaaattagcaaggcatggtggcaggcgcctgtaaccccagctactccggaggctgaggcaggagaatcgcttgaacccaggaggtggaggttgcagtgagccgagaccgtgccattgcactccagcctgggcgacagagcaagactccgtctcaaaataaaagttttttaaacaaagacatttctaagtgtctaaactacactcttcattaaaaacccaagagtagcctctgttgcaataactattttagtcagaaaatcaggtaacacaatacaaaagcagtttaatagctgagaggaacttgtttatactcttggggagacccataaggaaaaacaggtttctcccccaaagggagtctggtgcctcctttttttttttttttttttttttttttgttgaggaactccaggctattataaactattttaggtttctcatgcagcagagggtgcaagagaaaggagagagagcagaagtaaatgaagaaaacagaattctgtcaactgagaagaagaaaaatttgtctcaaaaaaagacagggtcctagacagagaaaaaacaaacccaaaacataaaatccttttaaagacacacacacacacacacacacacacacacatatcggatgttagcttttaattaagctgacttttaaccattgagctcctttaaaaaaatctgtttaaatctcattgccgtatttctgcttggacaaattgctgctgtttcagaagtaccaaatatcaaacctttcagaaagggcttgatttaggaaccaaacctaggctgtcatgaaaaaaagaaggcagaaccttatgtatggaactgcagcctgaggtgatagctattgctccttcagtttggcctggctagcaaaaacgtggcattgttttgtgaataaagccccttaaggagtcaaataaaaaatctttcctttttttcttttgctggccgtttttctccctccaccatgccacttttttttcttgttttttttttttttttttttttttgtgggaatttagccacttcagaggcctcgttccccataatttggaactttccttcaaatttgatcaagttgcatagagttggtcaaacccaaggggaaaaagaccgaaacaacaacaaaaagaaacagtaaagcaaaacaaatgatcacacaacctatacaagtactgagagctctaatggtaaggagaaattaagaccagctggttgttaatcataactgtagccaagacaaaccctaattcagttacttagggatgggtttcatgctgaagactgccctctaccatcctagaagcaggaaaagactcaaacctgtcctccctgttggaagcaagctcaaaactccgtaaaggagttacttgccttccattgtcacggaagcaggaaaacttgccttccttgtgtcggaagcaagtaaaactcagaaacaaaaaaggagttgtacagcaaaataaactttagatcacctccaaattttgggagatcggggattctctggaggaggtgcttccaggcgtcagcaaattgtctgattggtttgaggcacaaagatagctcaagctggtaccagccaccaataggagatttgtcaaaggtcaggggcacctccactcagaatcccttggtggttaccaaaatgtgaaccctgaataactgagacaggtctcagttaatttagaaggtttattttgccaaggttgaggaccctgtgacacagcctcaggaggtcctgatgatatgtgcccaaggtggtccaagcacaggttggttttatacattttagggagacatgagacatcagtatatgtaagatgttccttggttctgttgggaacggcaggacaacttgaagcagggagggggcttcgaggtcccaggtaggtgagagacaaacacttggattcttttgagtttctgattagcctttccaaaggaggcaatcagatacgcatttatctcagtgagcggagggatggctttgaacagaatgagaggcaggtttgccctaagcagttcccagcttgacttttccctttagcttagtgatttctggggccccaagatttattttcctttcacaggggccatgttatgtagaagccaggctgagaaggaatctgattccttatattggttatatttttttctgaaataaatgttagcttttattttccctccaagctgcaagagccattgaactctgacttctgtgcttctcacatttaaagcctcctgatttgagtacttagtacctgccagacattagcaggtaggagttactattcccacctgacagtcaaggaaaggctcagagaggttctgtaactgggctggggccacagagctagtagatgatagagctaggattcaaacccagatctgcctaacttcagatcaaggttagtggtgctgtttccacaccaccctaaatggcctacttaataatgaaatttatgatgccagctgatgataagaatcactgggtgttaagattcttggttgctaatgaacttgaattagctcaaacaataaagatgatttttttttttgtatcagctaaccaaaccccaggaaggatagaaatacagctggcctgatggataattgtatccagggactcaaatgccattagctcttatactttgattaaaatatactttaaaaagatgctgttagtggccgggcatggtggctcaccctataatcccagcactttgggaggccaaggcgggcagttcgtgaggtcaagagattgagaccagcctggccaacatggtgaaaccccgtctctactaaaaatacaaaaattagctaggcgtggtggcaggtgcctgtagtcccagccactcaggaggctgaggcaggagaatcggttgaaccggggaggcggaggttgcagtgagctgagatcgcgccattgcactccagcctggcaacagagcaagactccatctcaaaaaaaaaaaaaaaaaagatgctgttagctagcctggccaacatggcgaaaccccatctctactaaaaaatacaaaaattacctggatgtggtggtgggtgcctgtagtcccagctatttgggaagctgaggcagggagaattgcttgaatctgggaggcagagttgtagtgagctgagatcgtgctactgcactccagcctgggcgacagtgtgagacttcgtctcaaaaaaaaaaaaaaatgctgttagatctctccctctcacttgtttccctttcgatgttggctttcttctctcgggccagctgtctaccagatggaaccatggtttcctgctttacagttttgttatcagaagagtttttctcacttcaattagaaagttctgagtgaggactcctgattggactgttaggggtcgtgtgcccagacctatgagatcaccgtggccaggtgacagggagctgtaagtggcccagcctgggtcagggggctgccctgtagccagggacaaggttctcattgtgtcagtctccaccttaagctgcatttgccccaaagaagtatgtgtgatgaggagacaaggaatgcctgacatctgtctttaaattgtcaaacacattcttctaagtctttccattacgggttatcccaagctaggaataactggtgagtagtttcttgaccttttttccagaccttttttggtgaattatgttaagctgtgacccaggcacaaatggggaggccatactttggtggagcctgggtcacataaatatggtgaccttactagaaattctttcctacttactcattgtttaataatgaacagaactctggcctatcttcttttgtcattgtttaacacccacctcactacctcccacctctcctgctaaacaaaattagccttcagcaggtcaaaacagatttttagctaacttccgtttcttgaatagcatatgataagaactcaagttagccaggtttgttctcctgcctgtaggtggttgattgggtttgtgatactgtgatacattgcatatctgctcctctgaggtagcccaaataatctggtgggggaaatatgctgttttaatgttattttgtgacctttggcaagagattttatcctccagcctcaacttccatatctgtaaactaggactattctgccaaatattacgaagggtcatgaaaaatgagagatcaggctgggcgtagtggctcacgattgtaatcccagcactttgggaggctgaggcagtaggcttgcttgagcccaagggtttgagaccagcctgggcaaagctgggagaccctgtctaccaaaaaaagaaaaagttacttgggcatggtggcgtgtgctgaagtgggaggatcgcttgagcctaggaggtcgaggctgcagtgagccatgatcatattactgcactccagccaaaaaaaagagtgctgtcagggaatctgggattcataagcatttcccttgactgctcttctttcctttcttttattatacctctcttctctctgtaccccctataccttttgctctggcttttgttacatcctgtattaaaattttagataatttatgttatttttcttttttgagacaaagtctcgctctgtcacccaggctggagtgcagtggtgcaatctcagctcactgcaacctctgcttcccgggttcaatgagttctcatgcctcagcctcctgagtagctgggactaccggtgcacaccaccatgcctggataattttttttggtatttttagtagagacagagttttgccacattgcccaggctgatcttgaactcctggcctctagcaattcacccgccctagcctcctgatgtgctgggattacaggcctgagccaccatgcccggcctaaaaatttagataatttattggaatgttgtgtgccaatgaaaagcaaatcctaagctcctgcaacatcatctcatgtttaattgtcagggtttgtgggccctctgggtcaggggatgagcagtgaattggcagagaggggtgtagggagggtagagaaggagagcatttcaaaactaatgaggcttggaagggaaggaagaaaagaaacttaaaatgcagtttctgggcttggttgtaaaaatcttgaaagtgagggagataaaaatagttgcttgttaggacctggcaggcatgctctggaggctccctgtttgaattcagttgctaatcaggaggtgggaaacaacctctggttcctgctgttagcacctttcttgcagttggccttgtcaagaaggataatgggctggagctgagaaagaagcatcgtgctcactcgctaaactggagtggagaactattctctccttactgaatttcagggatttcagcctgccccaagtcaaatccttgttcccagaaataaagctcattacatctgtaatgtgaatgattccttccccggccacagctcaataagggctcttgtgaaactttggagtacaacttattatgggttgcctttagtcctgttgtctgggccctgattttttagatcctggagagaacgctccctcaggggtctgagttctaacccttggccctatcgttaactccctgtgccaccctaacaggtgacgccttcctattctaggcctcagtgtttctcatctgtgtgcaatggtttataatgcttacctcacagtgttactgtaaggattaaagaagatagtatatttgaactggggaggcggaggttgcagtgagctgagatcatgccactgcacgctagcctgggtgacagagtaagacttgtctcaaaaaaaaaaaaaaaagtatatttaaaaggcctgacatagcaggtgttccataaatcagagctgttgtaggatcttcttaggtctgctaggctcgcctgcacctctcattctcccacctagtctctcagctgcatcctggcttttttttcccaatgctcttggggaaggaaatttgggtgggggaaaagagcttacaggtaatggctaattgaagagttggggattttctcagaattttaattatctctgctacttaattagctccttgaggccatggatagctggaggtggctctgtagagggtgcgatttgactcatccaggtcagctccctttctctctgtttcttcatctttagtggggagagttattaaggctttgccaaggatactaagaagaggttgtttgaagcctaaagtcgccattttaaaaaatcttcatttgcctttttttaaaatcctttaactgttgcttatctacttttggattcagcctttgtcacagatgagcaagaatccagcttccctgtgtcactctgcttgcttctcagcagccccttgctccttccttccacctcttctctttcttttgggctccccacttcacccctccactgcctttctcttcccccaagccccaccgtcttccatcttgccttagggaattcagctgcttttaatattagcctaaaccaaacaaaatgaaggtattaggatatagtggaaacacatagaaggccgagattcaccttggttcatctacctgccgggggccttgtcagctactcaggctatcatctgatgggtggcacccatcccacctggttggaagaatttagaacgagtccacggggccttgaccacatcttcatctttgcccttacacgtgcacatgttcttgtcatttgttggattctgtctcccctgatggtgacaatccctgtgtcctttttactcttagctcagtgcagatactctgtgtttctagaataaataaatgactccctaaattgttttatccaaacaccttattttagaggggtagaaaatacttaatagttaaacttcaaaatgtgtgctcttgagggaaaaatcaggaggctttgaatagtgttattcctgggacagaaaatatcggagaagaacatactttctgagtttttcataaaacctccttgttcatttttgaggaaggaggggttacccatactcattgtcacagaagctgagcagaattggggttattagatctcagcctcctgtgggattcctagggaagcttatgagcctgggagcctactgggtggttgatgcttcctccagaatgtagcctggccagccagctgctggggaccctctcagcatcacctttcagttatcaaaggatcagaaagagaacgcaaggcccagaggtggcctcaggaagtagagaaggactgggcctgtgatttgaatgtttgagggctctgctaggagaatgtgagaggaagcccagttaatcctcccaggactccaggagcagggcattatcccaagttgggaaggggattcagaagaactaggcatctaggagtagaggtgacagggtgatttgaaaggaagactttttagatgcaaggaccagcacaagagaaggcgagactcttacacaggggcagttagagaggcaggccagccccaaccaggaagaagtggatgtggagacgtgttgtggtgtgaagttggagaggaaaggaagaaacagtggagggcatggaaaggcaggcagaggggctggggactgtgctctgaggcagagggcagccatggcaggctctgtgcaggggctgtcccgctggaggagtgctggtttctgtgtaggcggggggagggagaagatgctggagacaggaacagtgtgtgaagggcctggctattgtgggaagcaagtgtggggtgctgaggaagatcaagaaatgaattctctctggacttgtctgccatcatgtacctcttttctgtccccagagaagagctagacttgggtgtggcaggagcaggggcaagagggatgtcctagcctggcggctccagcagcatgctctggggttcagtgatctcatgtgcccaggtttccaggtggcttcttgtgaggccctccgggatctggctcccaggaccaatgtggtctagcagtgaaaagcccctcagaatttcccttctcctcctctccaaccccttccatctctgctgcctcctaggcagtgtttttccctggagcgggtgggagaagctggagctgacagccagggatggtggcaagctgtgttatgtaagtttgaaaaaaggaggcttgcttgccatgtgaatagagatcagatacaaggacagctagaggcagcacagccatgcctgagcagcagctgtagtctgaagagaggtgtctgagccagcagaggaagaagctgctggactgggtggaggagactgttcttgtggggaaggagaggtgtctggttctgtgaactgccgatcttggagggcagcctgtgaagcaatcattgtctattcctataacatggtgtgctgcttatatgccatgccttattacatcaatcctggtctgtaacttgtgatggtatgagagccgccattgtgactgtttcaatcatggcaaaccatggcccagaaaagtcaagtgacttgctcacggctgcatgtagagtaagtggcagggtcaggatttgacacagggcttctgtctcactagccagtgctgctcttttactctaaaacaggcttaacagatcatgcctaaacagcccatggggagagtgtgggccgggtgagggagcctggtgccgtgtggcctggcatggatgagaggcaatggcactgggtgggaggagtggaagagggcttgtgttggagccccttggtgtgccgccccagcaggcgctgtcacaccccttacccttctcagtctcgttccattttcagcatcattttccaaatcctgaacacctgacctccaggggccaggtacccaacaccggtcctctgaggggccatgggcatggtgggatgaggaggtacacctccaacaagcaactgctggactcatgcctcggctgaagtgtttgtgggctctgtcctaacactaggcccagggaaagaacagagctcgcccctctcctcccgaagttcagaatctccccatggttctctgagaggctgcatggctcgctccctctctctgttcacatcgttgctcaaatgtcctctcctcacagggccgttccttgccaccctgtcacaacagtacccccttactctctctgtcctcacagggttttattatatatatatataaaaatctgtgtatatatatttaacatatatatatatactatatatacctgtatatatatagtatatatatatgttatatatacacacatatatgttaaatatatatacacacatatatgttaaatatatatacacagatatgtgtgtgtatatatatatatacacacaggtatatatatatacacacaggtatatatatatacaggtatatatatatatatacaggtgtatatatagaggtatatatatatatattttttttttgagacaagagtgtcactctttgcccaggctggagtgcagtggcacgatctcggctcattgcaacttctacctcccgggttcaagcaattctcctgcctcagcctccctagtagctgggattacaggtgatgtgctaccatgcccagccaatttttgtatttttagtaaagacagggtttcaccatgctgacctcaaatgatctgcctacctcagcctcccaaagtgctggggttacagacgtgagccactgcgcctggctgggttttatatttttctttgtgccacttaagaccacctaatgttacatatttgttcattgatttgtctgtctcctcacaataaaatttaagcttcatgacagtgggggacttggtcagtttcttgactgcccacacagagcccacaggtaaggtagcaggtgttcagtggacagtaggtgatgaccgttagagcatggcagcagggtgggtagaagaggacaggtgtaagtgtcagagggcctgggatctgctttcagctttacccagtttttgctgtgtgactttgaacaagttgctggatctcttgggccttagccttctttttttttttttggagacagaggagtctcactctgtcacccaggctggggtgcagtggtgtgatcttggctcactgcaacctctgcttcccgggttcaaacgattctcctgcctcagccttctgagtagctggggattacaggcgtgtgccaccacacctggctaatttttgtatcttcactacagagaaggtttcaccatgttggccaggctggtcttgaactcctgacctctggtgatctgcccacctaggcctcccaaagtgctgggattacaggcgtgagccaccatatcctgctgggccttagactttttgttttcatcatgaaggggaggaactaggtgccctctaaggctgcttttggcacctctcttctgaaagtctatgtgtaggagacgagggtcgcagaggggtttgcaaagatttgtatcctgtgttcctttactgaagagcctgacttgggtctgcacactgtggggtaggggagtgacatgatgagggctgggtcttaggaggactacaccagtgatgcagtgtgtgcatgcatgtatccatggtgcatttagaaccattcattcaacaagggcttttggagcacctgccctctgtcagatacagtttgggctcagggcttagagtggtgaggcagacagccaacgtcctgccctcctgcagctgattggggcagagagaggctagagctggcctggaatggtgattacccccaggctgaagatgaagaggggccaagtggagttggggcactgggatattagagggtcatgatttttttttattatttttatttttatttatttttttgaggcagagtttcactcttgttgcccagactggagtgcaatggcgtggtctcagctcactgcaacctctgcctcccaggttcaagtgattctcctgcctcagcctcctgagtagctgggattacaagcatgcgccaccacgctaattttttatttttatttatttatttaataaatatattttttgagatggagtctggctctgtcacccaggctggagtgcaatggcatgatgtcggctcaccacaacctcctcctcccaggttcaagtgattcccctgcctcagcctcccaagtagatgggattacaggcgcccaccaccactcctggctaatttttgtatttttagtagagatgggagttacgccatgttggtcaggctggtctcaaactcctgacctcaggtgatcttcctgccttggcctcccaaagtgctgggattataggtgtgaggcatcgcccggcttttgtttttcaatttgtccttggaaagatacttaaatagacctgtttgaatctgtttaagaataaatagccagccatggtgactcacgcctatagtcccagctacttgggaggctgaagcaggtgtgttgcttcagcccaggagttcaactcagcctgggcaatgtagtgagactctgtgtctaaaaaaaaataataataaatgcattcatataacagtatcgaagagaaaaataatgaaacgttattagtggctctgctgggttgtattataggaggtttgggttttttctgtgattttctagatgtcctatatggtgtctatattatgactattaatatagacaccatataggtttgggatgtcatggtttagcatgtttcctagatatggtctgccctcaaagtgagtgtcattgtttgctgatgtctgctccacaaagccctgctccaggggccttcaccaagtcccagccttggtttgctcacctataaatgaggataattgaccctggtctatgcacattacaggacagttgtatgaatcagaggatacagcggaagaaaaaatgtttggaaatttaggtctctgcaaactaagggccaatgtactggtatttgtgacagtgaccggatgggtgggatggggtgataataagagtgcaaggaagggggatgggggcatcgttttgactctgaggagcagctttaaggcctctcacattccagctccaggtagcaaggggttccccttgactggcagggtagatgtacctgtgtaggctgttaggtgagtgactccagtggaatggaatggaatcatgactcagctcccaccctgccacacatatttgtaagaaaaagacccacatgctccatgcctggtgcagaagtctagaatgggaattcccgccaaaccctgtccccttctagcctgtgtagcctcagcaagcagataggtcttattacttgtttttttctgcctccttcatgatccagccatagatactatatcttaccagtaggggtggttgaagcaacagactttgaaatcctgactgttcatgataacggactccttcctgtggatcatctggccaagtctgcattcttagagagtggaaatcgactgtctttctgttctacttctacagcagctgctcatttcatctcctgacagttgcttcttgaactcagaacaaagggccttggtgtacagtgtttgcaagccaagggctgcctctgatggcggacgggggtgtggtcctgggactcgtggtcagggctggtctgtgtggaatgctgatccttctcttccccaatctacctgtgtcagttccctccttttctattttctcttccctgcagatgtcaagccctccaacatcctagtcaactcccgtggggagatcaagctctgtgactttggggtcagcgggcagctcatcgactccatggccaactccttcgtgggcacaaggtcctacatgtcggtatgaacagaagtttccattgcttgagcttcttgtacggtcagggagaggagcccagtgggtgcctttcctgtggagccagagtcttgtgctgggtaggggacaagaagtgagggaggaggcacagtgctctgccctgaggagatgaagttgaatgggaagatggtcttggtctttcttaggccttggagcataactgggatattggggccttgactcactgaaaggactgtccagctccagagtgtggctttctttctgaaggattgtgagctccagctcccctctgggcatctctacatgatagtcttcagatccacaaacccaggatgctcagatataatccaccccaaactacctcaccttctccttttctcttagcagtaaatagacagcatcatctccctggtttcccaaggtagaaacctgagcattggctcttaacctgccttctcagcagcccgtcctttcagtatcttgtagctcccaactcctgagagtctgttcagaattgtccagcctcttttctccctcctcactatgtctgtcagacatgtacccctccttctaactgcagcatacctggacccctcgccagagtctctgctccacttcagccaacaccctgtgttgagggtatttcctcctgctcctggctctgctggctcacactgtcaccagagcattgtgtggggccatcctcacactatggcagcaccagcgtgttttcttccctcctccataccaccggttccttggggacagggacaaggtgtctctcttgtccctagtgcctggcatggggcctggcatgtggtaggtgttcagggaatgcttggcaagtgggtagatgtttagttggctgagtgggagggtacatggataaaacatttctgagaatgatttggaaaggtggaaacgtgagtctgggccagtgctgaagtgcggcaaagtggaggagcgttggagtgagtaggcagtctttacagaagtggcggggagtgcaggcccgcgtggagagggggacaggcgcagaggctcagatcttaacttgtacaaagcattttatgtgttctctgtcaaagcacatgtcatgtccctggaaggtctcatttgatccatgtggttgtcccaggaaataaagattattgttcccattttagaggtgaggaagtctagattcagggaggttaagcaacctgcctacttaaccttgctgagccaggattgaaagctagctgcccccttgccaggcagacgccctttgcacagcacaccctcatttgcctcttggggaggatttggcacctgtgcccagatcccagtgtgaacacatcctcattccttcttgctggcacctaccccccactgtgactccagccactgtcaacatcactcacctggcactgacccacatccccacccctcccctccagtgacccacagtggaactctctttctctgtcatctcctcattgcttcttccctaaatgtctaataactgagcagctggcatcctgggccatttgactgccaactctcaagttcaaaatccattaacaggccctgggagttactaatcaagggtttaatggttggggtttttgtggttatatggtcagttacgaaatagtccagtgttggagttagtgaaaaatgctactggagaagttaatgtctacgtgaatatactatgggcagaataaagattttttcggtagggttcttgaaatacatgtgctatttcaaataatgctcattaaaaataatgcttttgtatagcactgtatactttttttctctttggcttttcccaccaatatcaaccaatatttgtattgcattttacaacatttgacatacattttctttttttttttttttttgagacggagtctcactgtgtcacccaggctggagtgcagtggtgcaatctcggcttactgcaagccctgcctcccaggttcactccattctcctgcctcatcctcccgagtagctggaactacaggcgtgtgccaccacgcccggctaatttttttgtatttttagtagagacggggtttcaccgtgttagccaggatggtctcgatctcctgaccttgtgatccacccacctcggcctcccaaagtgctggggttacaggcatgagccaccgcgcctggctgtacattttcatttgatttgatcttcttagtaatcctaagtagagttttcttatatcattgttactgtcattttcatcatcatcagccaccacccccccccacctttttttcttccgacatggagttttcgctcttcttgcccaggctggagtgcagtggtgcgatcttggctcactgcaacctctgcctcccgggttcaagtgattctcctgcctcagcctcccaagtagctgggattacaggcatgcaccaccatgtccagctaatttttgtatttttagtagagatggggtttcactatgttggccaggctggtctcgaactcctgatctcatgtgatccgcctgcctcagcctcccaaagtgctgggattacaggtgtgagccactgcgtcccggcccagcagcagccccattttatagatgaggctgatattcaggatcttttagcttgtaagtcccggaattgggatttaagtctcaggcccactgaccccagatcttttgttctatgtatccacggcaccacctcactcccaacccgcattccacaagcttcatgtttcagattcagtgacaagatgagcctctcatgctgggcttcggacaggctgccctgcgtgtgcaagactgtggccaagctgggtaaagctggaaccacaggctgtagtggcagccagggcacagctgattacatgtggtctgtcaatttaggccagattataggagaaatagagcagggatgaggggttaaagccacagaagccagctaggatttggtaaacacagtgttgggggtaggcaggaggccaaattcaagaggttagtggagctcttgaaacaggatatgaactattgagaagggacagaagagaaaatgcattagcagacccaggggtccaagttaggttaggtgattatcactgtctgtctctcctgcagccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctgtgagtagcctggtgtgtccccatcttggactgttggaggggagggtcccttactttcaggggtttctggagggctgattctctgtacattctgccaagactgattctctgtccctggatgccaggctagggccaggggaagcagcaagggtctccaggtgggtgttgttactaccaacaacttcctaccatttgttgagtacgtactatgttctaggtactgcacttaggactttatacattatctaaccttttgtatttattatttttattattaagggtcttgctatgtcgcccagtgcagtggctagtcacagtcttcaactcctgggctcaagcagtcttcctccctcagcctccagagtagctgggactacaggttataatttatttgcgggggttgggagggaaggggctcactctgtcacccaggctggagtgcaatggcatgatcacagctcactgcagcctcaacctcccaggcccaagtgatcttcctacctcagcgtcctgagtagctgggaccacagtcacatgccaccatgctcagctaggttgttgtttattttgtagagatatagtctccttatgttgctcaggttagtcttgaacttttgggctcaagcaatcctcccgcctcagcctcccaaaatgctgagattacaggcatgatccaccatgactggcttctaatttgtgggttttttttgttttgttttgtttttgatactgggtcttgctctgtcacccagggtggagtacagtggcgccatcatggcttactgcagccttgacctcttgggctcaagtgatcctcctgcctcagcctcctgagtagctgagaccacaggcatgcgccaccatgcctgactaatttttttaatttttttgtatagatgaggtctcactatgttgactaggctggtctggaactcctgggctcaagtgatcctcctgccttggcctcccaaagtggtgggattataggcatgagccactgcattctaattttttaatcatgacttttggtagatttattttttattgagatatagaattcacataagacaaaattcacattttaaagcatgtagttcagtggtttttagtgtattgttccatgttgtgcagccatcaccactgtcttattctggaacattttcattaccccagcaagaaaccccatcccccactcccccctgcctgatccactgacaaccactaatctactttctgtgtccacggatttgcctagcattatataattttaatagcatttcatttgtgatcacgactataatctgaattttaaagatgaggaaactgaggcacagtgcacttgtcaaggccacataggcttgcaagtagccaagtctgactcccaagatgataaacactgtgcagtaccacctgcctctctgaatgtgaatactgggaagtaaacctggtactcagggaatagcctgacctagccaactgttttttatgtagctcctgtctggccagggatacctgccctgtacctccatgaggtccacatgagagagagcttgtataaaggggaaagcagagggggctagaggtagctgatggcaggtcattggaggggctggtggctgtggcctctgaggctcgccagtgactctaggagacaaaaggaagaaacgcaacttcatggagaattaaaactaagtcctttagttatttagttgctatctcatttgtgcctctctcaatagaaggaagggggaaaggacagacataattattatgtctctgctttacaaaactcagaactttgtttggctcagcagtgaactgatttgccaaaggttacgaacttaagatgtggcagagcccagacttgtaccctggcctttgctggtcccctctgtgttcaagccttatctgtggctgtttaatgtttattgtccatgaccctgttctggtcccagggatccatgcccaaccccttgcctcatattaacaagtaatctgtttctgagaagtattttttctttttataaaatttgtagcatacggaatggacagccgacctcccatggcaatttttgagttgttggattacatagtcaacgaggtaagtactgcctggtttccttcaccttggaatttacttgctcatcttaagaaaacacccaggtggccgggtgcagtggttcacgcctgtaatcccagcagtttgggaggctgaggcgggtggatcacacgaggtgaggagttcgagaccagcctggccaacaaggcaaaaccccatctctactaaaaatacaaaaattagctgggcatggtggtgcacgtctgtagtcccagctactcgggaggctgaggcatgagaattgcttgaacctgggaggcggaggttgactctgggaaaaacaaaacaaaacaaaaaaacaaaaaaacacatcgctgtcacaggttcagtctactagggagtttaatttaacctctctttactgtatgcacagctttatactaagcaccatgggctgtagaaaagcagtttcaggattagttcgtcgctgcttaaggatttgagggaggcagagcatgttgcatttgtaggagtcagaaaaaaagccatccatcctctactgctggggacctaggctaggtggttctgggtggtagtcatattaagggaagggatatctgaggttagatacgccattgcgtctcctagtgtgcactgctttcttccaaattttcacattaatttcccatgcaattctcccaagcattgctgaggtaggccaaattggttcctcttcaaacaggtgaggaaattgagcctccgagatgaaaagtagcccaggtccttcccacccagtgctctttcttccttgccacctcccacctcccattcttacctcctaggaggcttggctgcatggcagttgttctactgcagcctctgctggcacacagcccctctgctgcctagctctttcctgttcagaaggaatggatgctgcctctggaggccaagctgctggtctcctctcttccttgaatggtcccttgattccctcagcagtggggacagtctgcagaatggggcttgctctgggtcactgttctaagagctgagttctagtcctcacctaagatcagactgacatggccctcaaaggaagagcactaggttgggctttgtggtggggatcagtgtctcatttttagtcccaaattaaaaacgagattttgggctgtacatcagagcagtgacatcatggacattatgtctgtgggtcagcatgggtacacacagctcccagcccaggtacataagtgggcccacatttcctggactgcatggaacgccatgagcccagtgctccagagccttgtactgtatagtgctgcatgatcaccatgggaaaatctgaaaacagcctcatttctggaatgtacaggtaacattcttccagatccagccctctgtcagttaatgttttattaacttttcactgcttctctagggctcagaaaagggatttttaaaaaccggtttgcttctgcaggtgctgtcagacctgggctatgcctggtggtttgcacgtgcccctagctgttgctgccagtaaattgctggttacgttcccatgccgcactccaagatttaccattgtagagtgtcagagcttgaaagggtccctgagatcattaggcccaacctcttcatgtcatagaagagtaaactgaggctcatagaggaatagtgattagttcaaaatcacccgacaagtgagtggacttgacttggtcccaattctaaatgtgctatttgagatcagtggttccaacatggttacccaacaggcagcactggccttctacctgtgcctttccttgactggatgagagtagtactgcctttggactgcagagaagactttaaaaaaaagtagcactggctggtgggaggggtgggatggggagaggagatggctggagcaaggagccaggcatttttcttatctcaacatgtgtttgcagcctcctccaaaactgcccagtggagtgttcagtctggaatttcaagattttgtgaataaatggtaagttggctccttgttctctggaagcgtatactctggatttgtcaggctccccaccccatttctggaagcaccagcattgcttctgcaggcagagttttgccctttaccctcccgtctgatgattcttggctgctgccataagcccttttttagagtgccaagacttatgtggcatgtctaactacatcatggatgtagtagctgctccttttggtacttgctctccagggattggcacgttgctttttgaccttagtttaactcagcaagaatgtattaacttactgtgggcatgatactgtgcttagaacaggaggatgaatcaagcccaggcaatcctcggcctctagtgtgcagagaagacaggcatgcaaacatgttatttgagctagaaccagtgccaggcaacagctcttaccttgtctttcttcctttaagcttaataaaaaaccccgcagagagagcagatttgaagcaactcatggtgagtctatttattccggattcttacagtacctgtttattcatttgttcttctctgtcagtcatctgtgcagtacttccagagcccattcattccctgcccactgtggtccagctgagcctggggctgcagaataccaaacaccagtctcctttgctctcccatcagtttaagggaaagctggggtgacccccgcagcctgagtaagcatatgccagaggaaatgcctgagggggccatgggaaagaaaaggccagcccacccccttcatggggatgcggcctttccctaatactgactgcctcatcttacattcagcctccttccagagtcactctccgcctgctgtctcgtttggtggcagtggaaatagctaagtaatactgtaaatatctggacagccatagacggtgtatatagtatataatatgcactaagtccatcattttctttgtcccttctaacaagcctgtgaggcatttaaggcagagttactgtctccatactgcacgagtaggctccaagaggtgacttgcccaaggcctcacagctgctgtgactggtggagcaggtctttgggcctgcagctggccccactgttgctcaggggcaggtgccaggtgctctttccaagtgcagcacaagctctagacctgaaactcttggattttccttcctggtgggttttgtttttttgtttctttttaacaccacgtcctctcgtttccttacatgcaggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtgccaggctgaattacagtgaaattttggtgaatgtgggtagtcattcttacaattgcactgctgttcctgctccatgactggctgtctgcctgtattttcgggattctttgacatttggtggtactttattcttgctgggcatactttctctctaggagggagccttgtgagatccttcacaggcagtgcatgtgaagcatgctttgctgctatgaaaatgagcatcagagagtgtacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgattaatgtttcttaaatggaattattttgaatgtcacaaattgatcaagatattaaaatgtcggatttatctttccccatatccaagtaccaatgctgttgtaaacaacgtgtatagtgcctaaaattgtatgaaaatccttttaaccattttaacctagatgtttaacaaatctaatctcttattctaataaatatactatgaaataaaaaaaaaaggatgaaagct

SEQ ID NO: 36221 - DNA, 43203 bp, Homo sapiens
cggaactcgcgggttcggagccgcccgctgaggtcagaaggaggcgtctgcgctgatcgggtccgccgcgcgccagagccagagtcgcagccgaggggagccggggccggagcccgagcccgagccgagccggagcccgagcgagcggcggagaccgtgcccccgcctcggccccgcgccgccgcggccaggcccggcatggaggaggagtgccgggtgctctccatacagagccacgtcatccgcggctacgtgggcaaccgggcggccacgttcccgctgcaggtacgcatccgcccgcagcccgggcttacgtaacccgagcccgtgaccttggcggggctgcccgagacgagcctcagttccccgagggaggctcgggagctgcgggcagagcctggcgcgggcgccctggaggcaggcgcgggatgagcctcccgctctgcttggcttgcgggggcggaagcggagggctgagcgctctgcgggcccctgcgggtgggacgggtccggcgtcggggtacgcgggtaggagggagccctgtgcaccagctatggcgcagccgctcgtcctcgccccttcccgccgaccgggccaactgccgcgggggcgggcgggcggtgcggctcccggaggcgaggaaatgtcgcagagccccgaggagtcccggagcagtcacgcgagccgggaccttgccccgctggaacgcagaagcggccgtggagctcgagacgctcgcgcgctcacctcctgggcccctgtgcgtggggaagtcaggaagaagacgccgagtgaggtcacggtgcccacgagggtggattcccctcggcctgaccacgccaggaggtggccgaagggaagagggtggggcaggggctgctctgcaccctctagcagagcggcatccctgcaggtgtttgctctgacgaggagaagccccagagagcagttcgggactgtgcggattggctttagggagccagcttttaaaacgcgttggcccacggcctcctggttgcagctaagtggcccgtggaggggtaggagaggcctgggtgcagtggcgtgggtgtcacgcagggccgaggcagaaccaggacgacgggcacttcctggccttgtcgagtcagcaggagggctgggggtgccctgccgggtcgtgctctcctgtgctgcccacctgcggcctggtcactggggacgggagcaggtatgcctggtccctgtgctgggccccacgggatgtaaagaagggccacctgggcacggcggggcctgcggtgcgggctggcctgggaggaggacaggaagaggggagcagagcttcagtggaatttgagggctgacctaggcgtgcccccaggaggaccaagctgagcagagttgagcgtggaaaggcagggggttcgagtccgaagtaagtggaggtcctgttgggaaggatgcggtgcttcacaggtggtcttacttgagaccctgttccatccagctgcaggcagaccctgcctgggacagtcagggtgcaccggttctgtggctccggctcttaagcactgctctggaccactcctagcttgagggggttgggggaggtcaccacaggctggcggattgcttgggcagagtcagaggtaggattgggcttgggaagaaaggtgcagggtgcctgaagcaggggcagccaggcagtgtggaaccagggggctctgaggacagcgtccactctcttggcagaagtgtgcaggtcctgctgtgtctgtcccgtccctcctcccatccacctcctacttcattgggcaaactgtttccttctttggctcactcgggatcccccagcaatgtcctttgttctcgaactcccagtgactcgaggggtgtcctctgattgctcacctcaggtggagcctcgaaaggatggcgctgctgttcctacctcgggtctccccagtgcacggcatccttacctgtgggctccacagggttccatgcaggcattttgctcccataccccgatgtccaagcccggctggacaaggagaagcaatgtgatgaccgaggggctgagatggctggagacccagcgagcctggaccagccttagtgggcacaggagggaatgggggacagagcctggaaatggccttggggccagtgtttgccgcttctagctgcagttccaaggggacgtgtccccaaagtctagagctgctcttgcaagagtttgttcttgattttgatcatcacatgtggcttaggactccaaagccttgttcacatagctgaatgtgaggaaagaaaacttagaaactggcagaacatagcctctggctgggccccagagatttgcctcaaggctacttggaatgagactggagaatgcctcaggggtgtggcatgtagcagggcggctggagaggcgccttatggggactgacccaggtgtctgggggtcccacctcaaagcaggtgtctccacatcttggaattccagctgagggacctggccctggtttctgagccttccggagtctcacctgcaaactaggcacaatacctgtttgcaagatagcaccagggctccttgtgcccttcatgccaggctcagggtacacctattgccagggagctcccactgattccttgtgagtgtagcacagatttgttgcgactggaccatctgcacgtctgggcttcagagctgttctccccagctgttttctgccaggtcctgtcagaggcagccaccctccctgggcagagcaaaaccttgagcctgtgtttggattttgtttctgggcctaagcctaaggtacatattagtggtggggaactaaaggagggaacatgttggcatgaccagtactggcaggaggtgcagtgtgtcaggcagcatgattggggtttgcagatagaacgcagagggcaagggcaggcttgaggtttgggggtgcatggaggagaggagctgggggggctgcccaagtcaagcacagacctgcccaagacaggccatgggatgcaccctggggtggggcacttccccgctgctctggcttggattctagacaggaaggagtggagggaactagtggctgcggccatctgcccttccacattgctaggactgtttcctcttgggtgtaggaaacctcaggttcttccagggctgggaggtttggctctttggagccccaggtgtgtatgtgtggaaagccttcctggctatcagttcagcagctcacatgtttctgtaggcctcactgcatgggggagatcctggggccctcagggcagcctcccaaccccttttgctctattgcttccgtaaccctaaggtacacagctgtagggttatgtatgagtttgctggattgaaaataccatatgcagccttagggtcatgtaggagtttgcccggactgccaaaacaaagtaccacaaaccaggttgctcattgtagcagaaattcacctctcatagtctgggggccagaagtctgagaccagggtgtgggcagggccatgctccctccatacaagggtccttcccggcctcttccagctctcggtggccccaggcttctggggctcacggccgaatcactccagtctctgtctctgtcctcacgtggcctccgcccagtgtgctctcttaaaagtccacttaacatgggattcaggcccacctggataatctggcatgatctcatcttggaatcttacatctgcaaagatactttttctttctttcttttttttgagacggagtcttgctgtgttgcccaggcagaagtgcagtggcgcgatctcggctcactgcaagctctgcctcccgggttcatgccattctcctgccttagcctcctgagtagctgggaccacaggcgcccgccaccacgcctggctaatttttttgtatttttagtagagacggggtttcaccgtgttagccaggatggtctcaatctcctgacctcgtgatccgcccacctcggcctcccaaagtactgggattacaggcatggggccaccacgcctggccttctttttctttttctttcttttttttttttttgagacgagggtctcactctgtcgctcaggctgaagtacaatggagcgatctaggctcactgcaacctcccccttccaggtacaagcaattctcctgcctcagcctcctgagtagctgggattacaagtatgcaccaccacacctgactaatttttctgtatttctgtttagtagagatggggtttcactatgttggccaggctggtcttgagctcctgacctcaggtgatctgcctgcctcggcctcccaaagtgctgggattacaggcgtgagccaccgtgcccggcccaaagatcctttttccaaatagagtccccttcacaggtttcagttaaacatatccttcgagggtccagcattcaatctggaaggagccttcagagaaatttgaaagtggcataaaccaaggggtgaattaaaggcccagaagttgatgacgtcaagacgtcctttttggaagtgaggggagcagcacagctgtgagtctccaaactgggctgtgcagagattgtcccaagcacgtctgaggccagtagctgccctgtggggagaggcaagcctgtcctgtcactgtgcatcccgtccagatggacaggtagtagattcccgctggctgggtgatatccgtgtccttcatctgtcagcctctggagccgccgaggctgggtgccaggcactgccgcctgggacacatgtgacctccgtgctgcaggaccacagtgcaggtgcgctttcacagggccgctcctagggaggaggttgtggacatcagacattccatgattggattccatggctttgagaatctcacttggggccttagctcgagacccatttaaataccacatcgcagagaccagaaggcaagaccatgggactccctgcagcccccaccagaagaccctgtgaggtggctggctccatctggggcctgcaggcagccgcattctttcattctcgtggtccgtcggtgcggagcagacctgagacacctgagggggcttggcggaggttgtatttctctgtctaggggcctcaatgccatgcccgttaggcaggtggactgtggctcaagcgccccacaggaagaggcagggggctccctgccctggaaccctggatgtcagcacctgactcctacctgctgtgacattggcaaaagtagctgtggcagaggccgagggtcccacctgcttactgggccccgcttctccggacaggagcagaagctgcagagctttgggacctcagcacttgagcagcatgtggacgcgagcagcgagtaaccccgggctcccagagacgcgtgacggggtccccagggggttgcttgagggccctcaagtcaggagctgatttctatcctcaaatatttaagcatccccaagcccaggtgcggtggctcacacctataatcccagtactttaggaggccgagatggggggatcacttgagcctgggagtttgagaccaccgtgggcaacatagcaagactccagctctacaagaaaaaaaaaaaaaagctggctatgtgactcacatctgtagtcccacctacttgggaaggtgaagtgggaggatcacctgatcccaggaggtggaggatgcagtgacctgtgatggtgccactgcactccagcctgggtgacagagtgagaccctgtctcaaaaaaaaaaaaaagtaaaaaataaacatgtatggaagtacaatgtatttttaaccagaaagttgacagagaataccgatgcactaggtagaccctgtttttaaaaaaaaaaaatcccctgctctgcaaagtggcctcttcttcagagatgtggcatcactggagggttctcttggggaaatggttaaaacacctggtgttggctgggtgcagtggctcacgcctgtaatcccagcactttgggaggctgaggcaggcggatcacaagatcaggagatcgagaccagtctggctaacacggtaaaaccccgtctctactaaaattacaaaaaattagccaggcgtggtggtgggcgactgtagtctcagctgcttgggaggctgaggcaggagaatggtgtgaacccaggaggcggagcttgcagtgagccgagatcgcgccactgcactccagcacgggcgacagagcaagactctcgtctcaaaacaaaacaaaacacctggtgttttgaaaaatctttacattttttcttagaattcctaggatagaaagagtcttctttgccttcagaactgcactataagatcctggaagaataccaccctgccttttaaaagacatcatttttgccttaacatttttcaaggtgacatgcatttgcaaacagtacaaaaaagccagcgctgggccaggcacggtggctcacgcctataatcccagcactttgggaggctgaggtgggtggatcacctgaggtcaggagttcgagaccagcctggccaacatggtgaagctccatctctactaaaaatacaaaaaattagccgggcgtggtggcacactactgtaatcccagctactcaggagggtgaggaaggagattgcttaaacccaggaagtggaggttgcagtgagccaagattgcaccactgcactccagcccctgcaacagagcaagactcaggctcaaaacaaaaaaaaaagaaaaggaaaggaaaaagagccagtggtgaaaagtgtgcctccttccttcctccggtggcccgcactaacttccttagaggtgatgctgatgctgtatgttggagacgcttctgagtgtcctcggaacgttcccacgtgctctccaggccatgctgggcagctggctttcctcccgtctagctgggattctctctctctctctctctctctctctggcctctgccagtccctgggtctgagccagaatgtgtcccaatccaggaaacaggtgttgtttctggtatttcttctttttctttcatctttctccaagaaggaagaaaattggctagttttttgcttttctgactcccttagtttgggactgaggtttctgttattcttgtttggctgtcatggagaaaaacaagaacttatcggtcccgttttccattttttctttttcttttttttttttttttttttgagacggagtctcactctgtcacccaggctggagtgcagtggcgtgatcttggctcactgcagcctcctcctcctcccaggttcacgccattctcctgcctcagcctcccaggtagctgggactacaggcgcccgccaccacaccaggcaaatttttctgtatttttagtagagacagggtttcaccatgttagccaggatggtctcgatatcctgacctcgggatctgcccgcctcggccttccaaagtgctgggattacggctgagccaccgcgcccggccaatttttgtattttggtagagacggggtttcaccatgttggccaggctggtcttgaactcctgacctcaggcaatccacccacctcagcctcccaaagtgttgggattacaggcatgagccactgcacccagcctattggtcccattttctgatctatttttccctcttgcctctggctctagcccacatcggtgcatgtgtgtgtgtgtatgtgggtgtgcatgtgtgtacgtggtgtgtttgtgtacactgtgtgtgtatgtgggtgtgcatgtgtgtacatggtgtgtgtgtatgtgggtgtgcttgtgtgtacatggcatgcatgtgtgcatgtgggatgcatgtgtatggggcatgtgtgcatggcgtgtgtgcacatgtctgggcatgcatgcgtgtgtcatgggcatgcatgtgtgtgtatgcggtgtgttgctctgcaggccccagtgttggccggcccccccgtctttcctgtaagtgacttccttcctaggaggcttggtgtgactggcattccctggaaagggaggggcggatccgcagaacgggcagcttcggggacacaggggctgctgattggcattgtggcttgttggccttggtgtctgcgggtgcacacccacacagagcttttgaaatggaatcctgcgtgcccagttcacagagtgagtgacgctgaggaataagaacagagggaacttctcaaggagaaaggaagaaaggagttgtcaaagatgggctgagcaaaaaaccgtgcaatcagccgaggaggggccggcagcgcctcccttcctgcccacagagcagccgccttgtgcccatctattccccggctctgcatggggcctctgttttaaagggttctgtggccaagacaagcctgccagcccctgtccctgtccttggccactcctccggcagctttccccattcctgaagcaggtggctagcctgcttagcctcttgtcccatctccttacctgtgacagtcaccaagcctctgggaatgtggtcaccctaggacagctaaacgaggaagctgtgcagtgcacacaggtttggctgaccccaagggccagttgctgtgcatgggagcgagttccaaggggtgggagggagccagcactaggtggagctctgccagccggggcacagggaggaacagcatccaggaggagggtgcagcgggtgtgaggccctgtggagcagactctggagctagaataaggtggcatttttgctgcacgctgtgggggtggacggggcccgaggtcacaccagggagcccatattgggtcaggaatgctgctttggcaatccctggactcagcccccagctgtctggccatctgggcacttctgagccagccatgacctctgccttcccttagcactttgcagtgagcccagcacctggcagcccctgcccagctggtgcacggtccctctgcggcactgtgagcctggaagtagggagctgggtgtccatgtgctctgagcagggctgggggcccaggcgatggaccctggagctgtgaaggctgaggcaggggtgggtcagggatgaggggagactgctctggggggctcggggccatttccaccagaagttccccctgggagtttgtaggacaaaggacatggttgatgtggatcatagggctgaccagtggcaggcggtgggagggacgcggggtgcttgtgccccaggttgatcagggtgaagcagtcacatgatctctcctgtcctctttcctcattctggtttcctaaagtggtcagaggtctctgcaaaataagctaaagggagggttctgctgggtgggtggcttcggcttctgtgcagcgctcaccctgctctcccctggaacgcctggaactagggtggtcaggctggggtggaggagctcccctggaatgttccagagcttcccccactcctgccgttctgagtcaccctgcctccccggaggaggaggaggatcagctgagccgccgcgctcacgtagtgtctggctgtctgcctgtctgcctcgctgtgagcagagtgggatgctgccgataaggcgcgcacgtgggccctgggaggagcccgaggcagccactcccgcacgtgggcaggaggagggctgctcacaccaccggccgagggaggaggactgcgggctgcgcctgggcaggggatgagcttgtgtcgcgggcggcagggggaagggagtcggagagctcctgcggtccagccggatgactgatgaggttgaaagcacttccgctgcggcccccgcaggaagttcccaggaggaagttgcgaccctttctaagccatcccactggcctggactctgctgggattattttgaccccccagggcagagtgtagccatctgactggctttctctctcggcaggagacggggcgcacgcctgcaggtgggggagccccaatacgtcacacggatgagcggggcaaagcccagccccccaccccgcacccgcccgcccgcaatcctgccccctggctgcggcctccgcggctcttcccaccccggctccgctgggtgcttggcgcttgtttacggagttacaccttgcggtagaggctgagcaggagcttgtccttcagacttcccagcggagacagccaggctgtcctgtggcagcagtgggtttgtcagaggccgggggctttggccagggccggcagagagccccagtcctgaagaaccctcgttcttcgcgtgctgtcgcgggggctccgtaggcacggttgcagcagggtcttggaggccgaaagaaggacggtctgagctgagagaggggagttggccaggcacaggggtttcagagctttacaggattcagaaggtgcccggggttctgcagcccagtgaggagttcacagagtggtgggcgacccagcagccaggggcatcagccgtgggagtgggacgctccgggagtctgagctgcatcctgtgggcgcagcagacgctcaagggctgggtttagaggggtacgtctggaggtgcgggtggggaatgcacatgaggggagctaggagcagaacagtagcacgggccgagcacgatggctcacgccttgttattgcaccactttgggaggctgaggtgggaggatcgcttgagccccggagttcaagaccagcctgggcaatataggcaatatttctccacaaaaaataaaacataaaaaattaaccaggcatggtgacacatgcctgtagtcccagctactcaggaggctaaggcaggagaatcaattgagcccaggagggagaggttgcagcgagctgagattgtgccgctggactccagcctgggcaacagcatgagatcctgtctcaaaaaaagaaaaccaaaacaaaacaaaaaaaacaaaaaacaaaaaatggtagcacggcggcctaataagaccatcccgagaagggggatgaggtgatagtccacaggcctcagtggaccgtcacagcaggtatggacatcagagagtcttgctcatatctgattgattgattgattgattgattgatttggtttgatttgaatttttttgaggcagagtctctctctgtcacccaggctagttgcagtcttggctcactgcaacctccgcctcccaggttcaagtgattctcctgccttagcctcctgagtagctgggactacaggcacgagccactacacccggccaatttttgtatttttagtagagacggggttttgccatgttgtccaggctggtctcgaactcctgacctcaggtgatcctcccacctcggcctcccaaagtgctgggattacaggcgtgagccactgtgcccagccctcatatctgatttagagtatgtactgccaagctccgtggtgtgaatacttccactatagctgaacgtaaactaccaacctgagcaggaaagagctgtgcagcagcctctgtcatgtagcgttcttccctccagacacaatagacacaaatagctgagtagacaacagatagtgtaaaatgctagtaaactaggaagtggtgaggctacaatatatattatgtttacttttaatatagtttatgtagtctgggtgcagtggctcatacctgtagtcccagcactttgggaggctaagggaggagaattgattgagcttaggagttcaggactagcctggacaacatagtgagactctgtctcaacaaaaaaatataaaaattagccaggtgtggcagcacgcacctgtagtcctagctactcaggaggctgaagagggtggatcccttgatcccaggagttcaaggctgtagtgagctatgattgtgccactgcactccagcctgggtgatagagtgagaccctgtctcaaaaaataataatataatttacataattgtaagttttatgactcaattttttttttaaatagagatggaatcttgctatgttgctcagtctggtcttgaactcctgggcttaagtgatcaatcctccagcctcagcctcccaaagtgctgcgatcacaggtgtgagccactgtgcctggccatatgactcagtttttaataatgactctacgtaaaactgacctgcactattgcatctggcaatcgcgtggcccaatccatcttcaaagccagcaacagtcgttgagtccttcttttaacttccaatctctgatttttccttctgcccttcagcctgagaaaactctgcttttgaagggctcatgtcattcaattaaactctcctggataagaagatcctcatgggagagagatctcatcacactgacaggtttcacccacactcagggggttgcccgagggtgagcggggtccctgaaggtcattcttagaattctgccacggaagagccccataggccattatagggacagggtttactgtaaaacaaggtgattcacatacacagaccagtaatgctgttcctaaaggggcccaagctgatcccatcagtcagcagggctgctcacagggcacctggcctgtctttgttgaaggcgattcctgtgaaggcagtggaggagctccgggtgggaggtgagtgttgtggagagcccagcagcccgctgggctgaaccttggaccaagaaccagtctgtccttggctcccttgtgggtggggaaagatgaggtgtatcaggcagggtccagtccagaaacagaaaccagagcaacaatcgtagaggccgttgttcagccaggtattgagaaaatagagaaggcaaaaagggaacactggtgtcgtggaggagacccctgccagcattggctccacacagctgaccctgggataagagaattgttggactctttagaacctggagctgggaaggcaggtgtctgccagctggcgggtgctgggagtctgtgggggcatgcgatgaggaattctgctggtggagggaaagccacaaagtggattccgctgctgctatgggaagggacggtcactaccgctgcccctgtggggagaagagccccgggggaagaagagcactgctgacagaagcccattctcttcgcaggcttcagtttcacattcttggtacctcctggtggtgcctgggagggagccactgctgtacagagatgccaattccagaggcatggtccggcacagagcgctggcttccagctgaaggacatgtgtaacagcaggagatacctttctctggggtcccaggctcccgtcctggaccttggcaccccgccccccgtgcattgtcgtcttctgagtctggctttgtctggcacatgaagttggatgggtagactctggaagcgtccagaccagcttgcgatgctgatgaataagctgattttgatggggtgtgtgaaacggagatgccagcccaggggctcagcttgctcgtgctctcatttaaaagcagaaaatagcgacttcattctcggatacgtttgccagccccaaaggattaattatctacacacccagaagcagtggagcagaatattttggcaggattttcaggatttgtgtcatcgttgcttaatatctgtttcttcacagtcggttagaattttaaaggatttgaaatactgcaagctatctgtgtatagaggctgtggattcgggctggtacatttgcaaagtgcccattttattttttatttttatttttatgttttttgagacatattctcactccgtcacccaggctagagtgcagtggtgccatcagggctcactgcagcctccacctcctgggctcagtgatcctcccacctcagcctcccgagtagctgggactacagacatgtgccaccacgcccggctaatttctgtattttttgtagagacagggtttttgccatgttgcccaggctggtcttgaactcctggcctcaaactgtactcctacctcggcctcctaaagtgctgggattacaggcatgagccactgcacctggccgcaaaaaaagttaaagtgctaactttaactttttagattagtaagactgctaacgtgtttcattagttcagtgataataccggcttcaaagaaaagccttggcaaatacaaatcgtaagcagatagctcaactcatcatcacaaagcaaagcccacccagtgaagaaacaaatgtgggaagccccggaagcccctccccatccccacccccccccccgccccccccgccctggaaacagccgctgtcctggtgttgacagcagaggtggcactgcctggctttgaacttgaaggtgggactcaggggtggttggctgttcagatgcagcagggagagagggtttggggcattgctggtgcacgggagagggtggggatggccccccaaactagcggaggccgggcttggccctgggagatacaggaaggaggcccccactccgtggattccgtccttcctctccatctgtctggaaccctcaccctctccctccctctctgtcctcacacacccactccctgactctcactcaggcttttgaggcatgtgtgctgcccgcggagcccttggcctgacttcttccaaggggtggggtagacgcccacattttcacagcagagacagcctcccagcctctgttcagtgtgtggacagatgggtattgccttcgttttattgtttgttagtcttattgagtgctttcgctgggtgcgatttctggaatgatgcgtgaagtgcttccccatggaggtcctgtgggctgggcgatgccctcccgggctggttgctccccagagagggaagcccagctccagacacacaaggccctgcctgtgcacatgtcatgtgtgactcggggagagcctcctgctctgatgcgtcagccctccagcctgcagctgggggccccgtgccagccgggactcatttactcccctcttctgagtcagcacctgctggggttcgtgggaccccagacctggctctcttacgcctacctgttccttctctgtcttgcaggttttgggatttgagattgacgcggtgaactctgtccagttttcaaaccacacaggtaaggcgttggctccagcagctggcatagagcagactgtgggtgtgagggacggggcggagtgtgggtgtgagggacggggcggagtgtgggtgtgagggacggggctttcgtgtggacggggacctggagtcctgggcgtcgctcgggcagagcctgcacagcatatcagggtgtaggcctgggtggcctcgcctctgagaggggttgtgttgactcagcttggctgctttgaggctgtgtgacccagtgcaggtggcagaacctctcggtgcttcagtttccttctctgtaagacaggagggcaatcctaacacctgccgtgaggttgccagagttgattacgtcacttgcataaaatgcttggaccaatgcctggctcagagcgcagccgtgtgactcctgctgtccacctgcctcctggagctgaggagggtcccccatggggtggtcgtgctgggggatgtgtaggtggttctgggttttctctgttaacagcagtgctgcagggccccgtgtgtgcctctgtctccctgccctgggactctgaggactttgctggctcaggggactgagggtggccggcctcagaagcccctcacaggccatgctttccatgcccccagccccatggcctgggggtggaggtgcgtggagtcccccctcctctctgtggtttctatactgcttcgtcggcaggagaacaaagctgttctgttctttgaaaccccacctcgcttcccctgaaatttctctgaacccaggcggaaccttgggagcacagaacgtcccagaaacagcctggcagagcatcagtgcgatatgttggagcagggaggaggggcctggcccctactcttgggagtgggaaggaatgctgtggtttcttttgaggtgggcatgacacgtgctaagtgagaggaaagagttgcttggccggtgcagacggacaggctccagctcttggcggtgcagatggacaagctccagctctcgctgaaaccctttcctgcctttgcttgcggggcacactgggtgctgtgagatttggagacgtccccgaagactcaggccctccaggagcctccctgaacccacatgtccttcctggctgctctcgccatcctcctttaggatttatttttcagtgagtgagctggccggcttggacactaaagcagggtgttgagtgtgtttctggggactgtgttgggctccgtcagtgctggttcaacatccacaccgacccggctgcccttgcatggattccaggttgcgggagggccccgggctttggcaatgccttccaggcttggtggaagcttctcagtgggtggtgggctggctgacccgagggcccagagatagaaaaggggtctctggtctgccctcaggggactgggatgaggacaggaccccaggcgcttgggagcctccacagttgcagagccaggcagacagcctgggggtgtcccttcccatggggtccagcctgtggttcctgggagcccccactccagcctcctccagatgccatggggggcctgctggtttaggaccccttagccagctcagtctatggctgtgggctggctcccagccccctgtacccacactctcggggtcagctgtctgtgcggcctgatcaggaggcccccgggtagcttccctaaggctgtctctgtggctcaggggcaactccctagggcagtgagggcaggtgtcactctcccctgcaccggggcccttctgcctgctccccttccctcgcccctgccacactgtgctgctggggagtgaggctggtgcatcgtgtacctgccctgggtgccacgggagctggtggtcaagacgggggactcggcctcctccgtgcagcccctcagcccctctgggctcccgtgccacccactgtgagtgcggtgcccacgatgacactgtctgttctgcagaccttgacagagctggaggcgctttttgttttttgagtttttttgttgttgtttttcctttttgttccccctaccctctgtctaagggctagaggtgcttatttttcaccaaactcacctccaggaagcattttactggtcctgattatgcacaaagaaagatgtctgcatgcacgacgggcctcccgcattgtaggggctgttctgctccgggcacccttgttccagggctgcgctccccgggctgtctcaggggccacgttgtcatgttcctcctgctgcgtggcccatcgtgcgtgcccaggaccagctcacgccctgtgtgaccggccacgtgagcccagccacaagcagccgtgcggacactcgggccgtttccactttttggctgttggggtcatgctgccatgaacgtttgtctcagttctccagtgagcacctaggagttgaaggtggggttgcacaggctgcgcctgatttggcagggagctgggatgatgctgccagggagctcattcgcgactctgcccagggttttccttttcctttttctgtttttttttttttttttttgtgagacaaggtctccctctgtcattcaggctggagtgcagtcctgcggtcatgactcactgcagccttgacttcctgagctcaagagatcctcccacctcaccctcttaagtggctgggtctacaggtgtgcaccaccacacctagctaattttgctatttttcatagagacggagtctcactatgttgcccaaggtggtcttgaactccttgggctcaagcgatcctgccccctcagcctcccaaagtgctgggattacaggtgtgagactccacgcccagtcttttcttttttcttttttagagacaaggtcggtctctgtcgcccaggctggcgtgaagtggcgcaaccagctcactgcagccttgacctcctgggctgaagcaatctttctgcctccacctcccgagtggctgggactatagttgtgcaccagcacgcccacctcctgcccagggttgttactggggtggtcacgtgggcagcttctgcctgggatgggccacaaagccagactcccggcagggacacgggtgttccacacaagctgcgttgttggttccctgacgcccttcaggctggggggtgggaaagccgatcccccaagtgcctgcagagcccacctggcgcaggcctcgccgcctcgaggctgctgctcgcacttctgccccttcccccggccaggcccccgttccttgaggccgtaccacaaggtgcgttcatttttccacaccgtgagctgggcttggcagagcctccaccttgtggccagtattcccagtggcccctttgagaggatttcctggagctccctgtctgagcttcccggactgagggcactgggaaggagcctgcggagctggaggtcagcgggtggacgggttgcgctgtcctggctttcggagtgtagagccagaggggatgggacaggtgccctgctgctgggcttggtggtccctgctgcagggaaggggcagctggtgtgaacacaaggagctgcggggctggagaaggccagggccaggagcctgccgacggacaccagcgaggggccaggccgggccaggagcctgccgacggacaccagcgaggggccaggccgggccagactccctggccggctgggatctgacaggagtgccaggctccttgggccgcccgaggaaccgcttgtttgcctgtgctttttcatctgtaaatggaatgagttggacacaagatccaagcgccctcccctgttggagaaggttcttgtgggctctgggcccatcccacatcccacagtgggcaggaggccaccaagaggtgcaagaccatgccctctgtttcgataggaagctgggcctcagaggggcctggggcctgtgtctgagacccggccaagtgctggacgtctccccttcctcatggctgttatggctgaattacgtccccccaaattctcatgttgcagccttaaccccagcacctcagtgtgggactgggtttggagatggagcccctacagaggtcagcaggttaaaagaggccatcagggctctgggtgggccctgatccaagctgcttggtgtccttgtaagaagaagagatgaggacacagacacacacagagggacagccccatgaggaaacagggaggcaatgccgtctgcaagcccagggcagaggcctcaggaaccagccctggtgacacctggaccttggacccccgtgcccaggacagtaggagaattggagccgcctggctgcagtccttcccgatggcaccctgtattagtccgttctcacactgctaattgttgggaaaagggcttgtggaatgcctgtataaactggccatgaaaatatgggacaataagttgtggaaagccacaagaggcctctgaggaggaaagcctcctaattgccatcatgttcgcatgctcagggcgagacctgctgtcttatctgtaaacaccgtgttcaaggagaaagacattccttcgaagcactggactgtggacagacacacgagctcctggttaagcccgctcccaccagctcctgtccgataagttaaagatacgctgtttgagcacaaaggagattcattgaaaccgctattgctgtagattacgcctgtgacgcactgcctccctttcactgtttcgccctgaatatctgcttctcagatctaagtgactgtactcaataaatagcgtggagaccagagctcagtgccttttgcagcctccattttgccactggccccctggctcctacctttatgaactcttttctttttctttttttttttttttggagacggagtctcactctgttgcccaggctggagtgcagtggcgcgatctccactcactgcaagctccaccccctgggttcatgccattctcctgccttagcctcccaagtagctgggactacaggcacccgcaaccacgcccggctaatttttttgtatttttagtagggacggggtttcacagtgttcaccaggttggtctcgatctcctgacctcacacaccacgcccagctaatttttgtattttttagtagagatgaggttttgccacgttggccaggctggtctcgaactcccgacctcaggtgatctgcctgcctgagcctcccaaactgctgggattacaggcgtgagccaccgcacccggccccacctttatgaactcttaacctgtctcttctcattcctttgtcactaccggacgttggatacaccatgggtggtgttgaggctggtccccaacactaataaagacatacctgagactgggtcatttgtaaaggaaaaaggtttaatggactcacagttcagcagagctggggaggcctcaggaaacttacagttatggcagaaggggaaacaaacacctccttcacattggcggcaggaaggagaagtgcagactgaggggcccagggttttaaaagccccttgaaaccatcagcttttgtgagaactcagtcactatcatgagaacaagatgggggaaccacccccatgattgaatgacctcctgccaggtccctcccacaacatgtagggattatgggaactgcaattcaagatgagatttgggtggggacacagccaggccatgtcacctccccaggaaaggagcacatgtgcagcagtggtgagtcccaccctgcctggaaagatatcaaaatccgagggcagaaaggaccaggagggaccattgctcacctccctcctcctaccccttaccccaaaccccgccccagcctggcagaagcctcctcaggacacaccctccaccggaggggcaggctgctgtgtgaggcactgacctcgcccgcagtggataccacctgcccctcctgaccccagtgactgttaacccagagtccatcaggggcttggtctctggcagacccacccctcagtgcgtacactctggtgtcccgggcagagtacagggcaggcgcccccaggtgcaccccccagatgccgcactgtgcctggagcgtggctcctgatggcagtctcaggacctttgcgccacacgtcctcccgtgcgacggctgctggggaaagccaaaggcgtcccttccagcgggagccagcgactggtacgcaggagggccctcaggggcaggagccatggagccctcctctggtgtgggaattcaggggatcttagccacagggcatggcgcgtgggcgcagagccggccgtgacccacaagtgcgtgatacttgtactttgctattctaggaacccatacatcagttttccttatttgctgaaaaaggcatgcattagaggggtgattcatgtgggaggaggccgggagcccctcgatgtgaggcgtttctcatgggcgaatgtggggtatccatggtggacccccaccctgtgtggatggctgccccctgagcagtgctttgagctggagctgtggtcaggttccgcagtgcaggaagggctcccaggaggctggtggtcccgcctgcaggaagccgacgcgtctgtcctcacacattgatatgcctgtctgcctgggacggacacttcaccctggctacccatcgggccaagggcaggttgtatacacctgggctgaggcctctttctcattcacatctatctcttgctcaggagttgatctaagacaggctctaattgcaccttaataagcttgttggggaggagttgggggtggggacataacaagccctacctgccagggtatccgggtgacagtggccggtggccgagcaccccggcctgaatagctggggactaatgcaggagacgctgggaaacaagagactgtgacgttgtgcggagggagtagccaggggccttccggacagcaatgggggagcaacgcagccgtgagctggtgtgtctctccccacgctcctcctgtacctgggacgcagctcccgcaggaactggcagtgggagtgtgggggccacggaggtcgtagtaaccatccctgacagtgcaggggcggggggctcgcgggggggctcgcggggggctcgcgggggggctcgcgggggggctcgcggggggctcgcggggggctcgcgggggggctcgcggggggctcgcggggggctcgcgggggggctcgcgggggggctcgcgggggggctcgcggggggctcgcgggggggctcgcggggggctcgcgggggggctcgcgggggggctcgcggggggctggcggggggctggcggggggctcgcgggggggctcgcgggggggctcgcgggggggctcgcggggggctcgcgggggggctcgcggggggctcgcggggggctcgaggcgtcccatgtgggcagccgttgggacctgccaagcactgcgcctagtgatctccttcgggtttgagccagtccatggggaggagccgtccaccaggcagcctcagggagagtgggcgggtgtcaagggaagcccacggccccagctggcccccttgtgtctgagcccccatggcttcctctgcctctaggctatgcccactggaagggccaagtgctgaattcagatgagctccaggagttgtacgaaggcctgaggctgaacaacatgaataaatatgactacgtgctcacaggtaggtgccggagcaagctgccgcaggggactacgcaccccactccagccagggtgggctcagggaggtccagagcacccccgccctgggcctgtctcgggtccctgccccttcaaggagggccttggcgtgcccaagccaccatcacacccccggtagcctggggggtcctggccacactatgcctgccgggacaatgactgcccaggctgtgccaagtcacccccactcctgtgaccacactggggttccagtgcccaggggagggtgcaggcagggtgttgggaacgctgaccggggcaggacaggtgggtgggacactcaattaggtgacgggctgctacctggtacactgccatcctttgtcaactttctggttaaaaaaaaattgtatttgtatacatgtttattattattattatttttgagacagggtctcactctgtggcccaggctgtagtgcaatggcacaatcatagctcactgcagcctcaacctcccaggctcaggtgatcctcctgcctcaacatcccaagtagctgggagtaaaggcgtgcaccaccatgcccagctaactttttgtgggtgtgtgtggagacagggttttgccatgttgcccaggctggtcttgaactcctaggctcaagccagccacccaccctagcctcccaaagtgctgggattacaggcgtgagccactgcagccagcctggtttctacacttttaaatggttaggggaaacacttagcctcccaaagtgttagaattacaggcgtgagccactgcgcccagcctctctacatgtctaaaggtcacatataaggccaggcacaggggctcgaacctgtaatcccagcactttgggaagactaggagggaggctcgcttgagaccaggagttcaaaaccagcctgagcggcatagtgagaccttgtctctacaaaaaaatttttaaaaattaattagctgggcacagtcccagctactcgggaagctcaggtgggaggatggcttgagcctgggagttcaaggctgcagtgagctatggttgaaccactgcactctggactaggggacagaatgagaccctgtctcaaaataaataagattaaagtgtcatatgcttattactgaaagtagaaatataaataaaggaaagatcactccttcacctctcgcccgtgggttcattcctgtgaagcacagcgtttctgttgagaaatgctgccgggtctgccctccgtgtctttcaactgtgaggacacctcgtttgcacccacctccctccccccagctcctgagcactgtggggacacctcacctgcacccacctccctccccccgctctgagcactatggggacacctcgcctgcacccacctccctccccccagctcctgagcactatggggacacctcgcctgcatccacctccctccccccgcccccagcactgtggggacacctcgcctgcacccacctccctccccccagctcccgagcactgtggggacacctcgcctgcacccacctccttccccccagctcccgagcactgtggggacacctcgcctgcacccacctccttccccccagctcccgagcactgtggggacaccccgcctgcacccacctccctctcccccgcccccagcactgtggggacacctcgcctgcacccacctccctccccccagcccccgagcactgtggggacacctcacttgcacccacctccctccccccagcccctgagcactgtggggacacctcgcctgcacccacctccctcccccctgcccctgagcactgtggggacacctcgcctgcacccacctccctccccagccacccctctgcagggtctgctggtgcttctctttctttgtgccacagttgatcgtggtgagtctcctgttttctgagggtgacctggattctccccctaaaggttatacgagggacaagtcgttcctggccatggtggtggacattgtgcaggagctgaagcagcagaaccccaggctggtgtacggtaggcaggggcccaccctcgggtctggctgtgtggccccacacgggtggggctggcctgggagcccgggaagggacgtcttagcctccttcctcctctgcacgcctccgtgccccgcctctccgggccagtgaattgtgtctgctgggcctctgaagatgttggcctgctgaagtccgctgggctagaagcgtttgcaggtgaccctggtgtcttgtgtggctggtgtgagacaggaaggggtgtcagtgtgctcgtatagtggggctgctgtgtgaatgcctggggcccaggcagcactgttgtgtgactacactcaccctaaaggcggaaggggcaaggggccacacccaggcagggccaggctagggagtgggggagggcagggtcatacccaggcagggccaggctagggagtggggggagggagggtcacacccaggctgggcccgctagggagtggccaagtctttggggcatctgccttgatcggtctttcgttagaggccaggcagtgctggatccatcttgacgcctggcagaaggggcagcgtcaccaaaccttgcagacaggctctctctggggcacaggtctcccgggtggcaggaggacaggcctggcctagcacatggtttgccacgctgtgtactgttgcccaaaaggagagtgcttgtcggtacagacgtgtgaggcccggattgtgtgtgctcgaggccaggaagaggaagggagctgctgcacctgcttgggtgacaaacagtgatgaatagcacctcacagcaattaggatgactgtcatcaaagacacagaaaatagcaagtgtgagcgaggatgcagaaaccctcatgcacagctgctgggagtatgaaagggtgcaaccactgtggaaaacacgttggtagttccccaacaagtggaacaccatcaccatgtgacccagcaattccgccctgcgcatgtatccgaaatagctgaacacagactcaagcggatgtgcgtattcccacgtctatagcagcgttgttcccagtgaccaaatgtggaaacaggctgtgtctgttgatgggtgatagacaaacaaagtgtccgtacatacaatggagtattactcagtctggaaaaggaaggaaattctgacacactctgcaatgtggatggcgcttgaggacatgatgcttagtgaaagtagccagacaccaaaaagggagactgttacacgatcccgctatctgaaatagctaggaaaggccagttcatcgaggtagaaagcagacgaaggctcgtcgcggctgggaaaggccagttcatcgcggtagaaagcagacggaggctcggtgtggtggctcacgcctggaatcccagcactttggatggctgaggtgggcggatcacctgaagtcaggtgttcgagatcagcctggccaacatggtgaaaccccatctctaataaaaatacaaaaattagccaggcctggtggcgcacacctctaatctcagctactttggaggctgaggcaggagaatcacttgaacccgggaggcggaggttgcagtgagccaagattgcgccactgcactccagcttgggtgacagggcgagactccatctcaaaaaaaaaaaaaaaaagaaagcagactagacgttaccagggcctaaggcagggggagtggggcgtgagtgtatagtgaggacagagtttcagtttgggaagatgagaagttttggaggtggatggtggtcgtggttatacacggtgagaatgtcctgaatgctcctgaattgtacgcttaaacatgcttacactggcaaagattatggtatatattttttactatattaaaaagttaaaaaagggaagatacctacttcaacttggcagcttaaaaaacaagaaaaaagaaaaaagccaaatgtggttgctcacacctgtgatctgagcactttgggaggccaaggtgagaggatcgcttaagcctaggagttcaaaaccagcctcggcaacatggtgagaacccatctgtacaaatcatttaaaagctagctgggtgtgctgctgcatgcctgtggtctcagccacttgggagggtgaggcaggaggatcgcccgagcctggaagatcgaggttgcagtgaaccatgattgcaccactgcactccagcctggacaacagagcaagaccctgtcttaaaaaaagaagaaagaaatgtggagggtttcttactcgtcagctgtagcctttgctgataagatgcccttgtgtctctgcagtgtgtgatccagtcttgggtgacaagtgggacggcgaaggctcgatggtgagtagtttcacgtgtgtgatttaaaagtgtggtgagtggagctattcctgtccagccagaagacaggcccacatctctaagtgtctaactcggtgggactcctctgtccaggggtaaaaagacaaaccttgttaggaaggagaaagggaaccgacatattttctgtaaagtgcctgacggtagataaatatcgacacctttgccggccgcacagccttgccacagctgttctcattagagcacagaagcagccacagataagaggtgtacaaacatgatgacttcttttcttttctttcttttcttattgagacagagtctcactcagtcacccaggctggagtgcagtgtcatgatctcagcttactgcaacctctgcctcctgggctcaggcaattcttaatgcctcagtctcccaagtagctggaattacaggtgcacaacaccactcccagctaatttgtatatttttactagatacgatttcactgtgtcgtccaggctggtctcgaactcctagcctcaagtgatccacctgccttggcctcccaaagtgctaggattacaggcatgagccaccacgcccagccatggatgactattttctaataaaatttcatttgtggacactgaaatttgaattttctataattttcatgtgtcacaaagtgtcattctttttttggcttttttcccctaaccatttaaaaatgtagaaaccagactgggtgcagtggctcacgcctgtaatcccagcactttcgggggccagagcgggtggctggcttgagcccaggagttcaagaccagcctgggcaacatggcaaaaccccgccatctctaatcaaaatacaagacaatgagctgggtgtggtggcacctacctatagtcccaactacttgggaggctgaggtgggaggatcacttgagcccaggaggtggaggctgcagtgagctgagatcgcaccgctacactcactccacagagcaagaccccatctcaaaaaacaaaagaaaaatctagaaaccacttaacccatgagctgtgtagtaacagcagcagctgcagcccacagacctggacgtcggatcaagtggatggagaacaaatccactgtgaccagtccagaagcctagaatttagaggcggaaggaacccaaaggtgatcctgcctgtgggtttttaactcagccattcagcgcccaggcgatttcagtatctgccttctttgtcgttgtgtctagggtgtctgtttgcttgctgtatattcactgagcacagcgggcttctccactggcacagggcacgcctgggcctgtgccctccctgccccgctgggtcagtggttgaagtcaggatatctgtcactgggcatctaactgggtggggcgggctggtgtgctcagcgtctgtctgtccactttctcccatgcttgttctctggaaggttccctgtcctgcgcccagcctgcaggaccccagcttgcagctccctgccttcccttcatggtgctccctggtgtgggctctgctgaccctcggcagacacttgcgtttggatcacgaagagttggggccactgtccagttcagtgcggctacgggatctggcccctcgattttgatcacatttgttttcctgaacaagagtggcctaaacacgagctcctgtctcagatgagcggtcaccccgtatctcccctttccgtgaggttaaaggggtgtgttggccctccctacccaaaatggggctctaaagagctttccttcgatttcctggtccagggatcggggacatccacgtgccacccacccatccttagtgcctcctaagccatgtctggagcagcggccggcgtgtgaccactttgtgtgctctgagcaccaggtgcagacatgcctcctgtggggcctctgatctccaagggaggtttccgggagcaaagtgaagtgaagggattggaaactcaggccactcagccagcaggggctgctgaaatgttccatgaagcccacagaattcttccagagcttcgcactgcctccggcttaaatttgatcgctaaagaaaaccatgtgttgcctggcacagtggctcacgcctgtaattccagcactttgggaggctgaggcgggtggaccacctgaggtcaggagttcgagaccagcctggccaacatggcgaaaccccgtctctactaaaaaaaattagccgggcgtgggggcaggcgcctgtaatcctagctgctcgggaggctggggcaggagaatcgcttgaacccaggaggtggaggtcgcagtgagccaagaccacgccattgcactccaacctgggcaacaggagcgaaactgtctcaaaaaacaaaacaaaacaaaaaagtgttgaattgtttgtcaggcaacttagacaaaaactagatgaagggtgcattgactcagccaggaagagctggcgggttgggctcccagtcgcagatggacatggccagcacccccaagccctcaccagatgaccagggctgctccatccacctgtggggtttccctttcctcgtctccctcctccctccctccctctctccttcacctccttctcctcccagacactctgtggggacccactgtgcgccctgagtcctccctcggcccctcggagcacttagggttccccactctagtgtgcctcggccacacgctgtccccgtggtgggaacaacttatcgctacagtcggggggcctggcccctgagcctggacttcagggggcttttgggggagcactccgtggtgggcttccctccgcgccccctggcgtgcttccctcacggtgactcagcctctcctcctgtctcctttgttggccagtacgtcccggaggacctccttcccgtctacaaagaaaaagtggtgccgcttgcagacattatcacgcccaaccagtttgaggccgagtaagtcattttattttattttactttatttatttatttttcaagatgggtctcgctcttgtcacccaggctggagtgcagtggcacgatcacagctcactgcaacctctgtctccggggttcaagcaattctcctgcctcagcctcccgagtagctgggatgacaggcgtgagccaccacgcccggctaatttttgtatttttagtagtgacggggtttcaccatgttggccaggctggtcttgaactcctgacctcaggtgatccacccatctcagtcttccaaagtgctgggattacaggcatgagtcatcgtgcccagcagagtaagttattttaaatggcaaatgctaccagtctttccccagggagagctgcagagaacatgccagaagggtctccactctgccttcgggctgcctgtttagcttacgaagtggttctcaggaaggtcctgccatggggcgagtgccccttgatactggagcaggatgtggtgggggcgcctgggttggagaagcccctgcccacctgggtcccaggctcacgtcttctctttggtggtggcagccatgggtgatggggatggttttgctgcccctgtgccttcctgagcggcagggcccctgggagaggaagaggaggggcgacctggggagctgtgggcttgtcggggccaccacagcagagggagggtgggggcagcacaggcggccaggtcacctgccgccctgtgaggggaagaggagtgtgttgggcttggctgtctgataccgagtttgaaaaggtctttctttgggtgcatggctccccccagctgaagaatcacacaccaggggaagccaccagcgccccagtgccatgaagagtggagctgcccgcggagggggctggtgcctgtcacagcttagctctacctggccctgagccaggtcttgagcccccccattcacgcaggggtgggggcgcctggactcttggaggcctgggatccctgacctgggcctgtccaaacttgggggtggcatctcactcgaggcccctgagccatgggtggcccatgcgtgcattaatcgctagcggctctttgactttgtatggatgtcagtcacccatgctgagaccctgcgctgtggcatgggccttaagtgggggccgtggctgctgtccatcaccacggttacgtataaacagcagccatgattgggccttacgtgactcctgtaatgtgagggtcccctttagaaccaaaccccacatgttgcaggggccccggcccagggtggccagtggacgaagagttagctgcctgtggggatggggatttccagagccgctgcggtttggggaatgtcaacacacaacccggagaggagaggctcacctgtccccacccgcctgtccccgcctgtcttccaggttactgagtggccggaagatccacagccaggaggaagccttgcgggtaaggaggccctctggggcctgtgcggggcacatgtgccgctcacggtggggacgggagacaggctgcctgagtggcaccactgtgtcatttctccccagcagtgactgaacagtctgtaccagtcggggcctccagagatcagcaggatatatgtgtgtgtgtacatgtgtggacatgtttgtgcatgtgtgtgtgtgtgtgcatgtgtgcgtgtgtgcgcgcgtattgtgtgtgggtgtgtgtgtggatgtgtgcgtgtgtgcgcgcacccatgtgtgcatgtgtgcacgtgtgtgtgtgcacatgtgcatgtgcgtctgtgtgcatgtgtgtccatgggcgtgtgggcatgggtgtgcacgcatgtgtgcatgtgtgtgcgtatgtgtgcacgtgtttgcacatgtgtgtgcatgtgtgtgtgtgtgtgtgcacatgtgtgtgaagagctattgtaaggcggtggcttgagctgtgtgggggctcctgggcatgtttgggatttgcagggccagctgttgggaagggcaggctggaggctggacacaggagcagatgcagcagcccaaggtgcagtttcttcaaagtcctttttctccgggacttggagaccgtgcgtgtcttgctagcattgaaccttggttgagtcatcttagtctgttggggctgctgtgacaaaatgcctgagactggatgatttataaaaaacagaacttttggccggatgcagtggctcacgcctgtaatcccagcactttgggagactgaggtggtcagatcacttgaggtcaggagttcgagaccagcctggccaacatggtaaaaccccatctctactaaaaatacaaaaattagctgggcatggtggtgcacgcctataatcccggctagttgggaggctgaggcaggagaatcgcttgaagccaggaggcggaggttgcagtgagctgagattgcaccactgcactccagcctgggcaacagagtgagcgagactccatctcaaaaaacaaaacaaaacaaaacaaaacagaactttgttccccacagttctggaggctgggaagtccaaggtcaaggcactggcaggctcagggtctggcgggggctactttgctacccggactgcaccttgttgctgcatcctcatgtgtggatggcagggggctcgaggggcccatgctgctccctccagccctcatcaggcacagagaaaggggagccctcatgacttaatcatgccccagaggaccccttctgaatattgccacatgggtgccatgtttcaacatgcattttagagcagacactgtcagactgcagcaggagtccatgtgctttgggctgcgttcccaagcagcctggcgctgccctgaattttgtcttcacaacccaggagcctggtcctgagaatgggccactgcagcagccactcctcccactcggaggcctttcgctgacctggtattgggtcctgggactgcagagtcagctgaccctggagcagggtccagattctgctatggacacgtgctgggtggcgatgcagcacatgtgtgtgtgtgtgtgtgtgtgtgtgcgcgcgcgtgctgcccgatctgaggcaaccgtgcggtggagacagtttctacgagagttacagaaaagccaacgtacagaggggccagctcctcctcgctgcaggacaggcacccatctgtccaccccccaagggggaggccctcgccagtcacctgtggggagccacacggtttgggctgacagtttgtggggggatggtggctgaccaggtggctgtcttccctccgggagtgccgccattgggaacgggctctgggggagtggggtgtgaccggccgtggctgatgctccccgtgccactgccaggtgatggatcggggagtggggtgtgaccagccgtggctgacatgtgaccggccgtggctgacgctccctgtgccactgctaggtgatggacatgctgcactctatgggccccgacaccgtggtcatcaccagctccgacctgccctccccgcagggcagcaactacctgattgtgctggggagtcagaggaggagtaagtgcccccatcgtgcaccgtggccgcctctgctcttcccagaggaaggtgttctttggggctgcaagaatgttttgggttcaatagcatgaaatttaagccttatccagcaccgggatgacacccccattttacagactctcagggatcaggtgggattcccaagacctcacaggtcacgatgaatggcctggctggaactggcttccacggacccagcatcataggcctccctcagagccaggcggggtccctgagttcactgggaggacgcgtccacccggctgtgctgattgtttacacagacaccacctggttgattttctctgaacagtgtgaaaatgacgcagaaggctggggccatgcactaagctagtggccgcgggttcatacccatgggcccaaaagaacagctgtgacctccttgccgctctatgtttggacatgggagccttgcaggcacacacataggcacaaatgcacatacacttgggcacaaatgcacatacgggcacacacgtggacatgggcacacataggcatacatgcacacatacacacgggcacacacaggcatacatgcacacggacacatgcatacacacggacacacatgcatacacgtgggcacacgcacacacatgcacacacactcggatgcgtccaggtacatcctagttcttcacgccgtcgttactctcgggagtttcacagcgacccccgaggcggcctgaccgtgtggccctctgagggtgcagtctttccctttcccttgctgcggtgatggggaccccatgcatgccctgagcccccacgtcctgagcaaggccaccttgtgctctgcccctgtgaccctccctgccgccgtgcccaggaggatcagggatgggaggctggccctggcagaggagcggcagatctcagtgaccttgcccatcttctccccctagggaatcccgctggctccgtggtgatggaacgcatccggatggacattcgcaaagtggacgccgtctttgtgggcactggggacctgtttgctgccatgctcctggcgtggacacacaagcaccccaataacctcaaggtcagccacacgcaccgctcccctcctcgcccactcccacggcacctcatggggagcaggatatgagagtcctggtggggggtccctgctgagctgacagggcatggccctgagtgctggccccagttgtgggggagggcagtggccaggccatgacaggagttgcgcctgtcactctcacatcgcctcccatctccccttatttgggacctagggatgatcagagtctgtgagggcttgggtgacagatgtttcagaacagacccatgggggtcccaccaggattcagatgccacccgcttggcgttggcgcagggctgtgggatgcatggagctgttgtgtccttggtgacttgggggctgctgcagaggagtggcaccctgcagcatttcccacagtgtgaccacggcagtgacctgagggacggaaaggccggagccgcccttcggggacagtaggtgggaggctgaggacaggggtccaggcaggtgtggagagccgtctttctgggcgttttgtctggatgtctgcctgcttttcaagtttgtagagatcgggtggctttgcttagacagtggggggagtgggactgttgggcaactgacatggcaggttgggatgtggggtctcgtgagcctttctcgtgtgtcccatgggtaagcacacagctcagcggggacagaggagttttgttgcaactgtggcgctcagatccgtgacctcccgtgctgcatgcagcagagttgcttgtggcctcggcaggtggttttgtcagctgagtccgaggacgcctggagtgtgtcttcttacaacaccgtccagagccgtgctgtgctctgaggtggtccccagcccctgggctcagcccccaaaactcccctgggtacttcccactgcgtccgcagtgggttcaggtgggagggaggggcctgccatccctttggaatgtggggcagggcaggggtgccatgggagtgacaggaggaagacaggacacctctgtcactattgggtgcgctggggaaggaagagttcagaggtcaggacctgcaggtggctctccctgtgctgtctttgccgggccgcttaaggggccacgtgtcccccggggtacacctcctccccaacaagtcagtttcagctgagtgtcctggtgtgtaaaatggaagaggtggactgaggccctttgcctcccatgggactagccctctgcacaccctgagctggaatgcacagccccctcattccatcccttctggcccctcaagggcaattaaacagggccattaagtaagcctgccgtgtttaattggtggtgcagggcagtggaaaagtgccagctggcaccccgaggaggcctcactgccaggccgcccaaggtcacattctgggtttggccagcccagggttgtggagtcggggagcgagttccccgtgcttccccagcacctttgactctgaggcatcactgagtgatgattggctgactctgaggcatcactgagtgatgattggctgactctgaggcatcactgagtgatgattggctgactctgaggcatcactgagtgatgattggctgactctgaggcatcactgagtgatgattggctgggctttcggcaggagcacttccccttgtagactcgttataaggagttaattctgggaactcctaccaagctcctgctgcctgccaagttctatgcaggtcacgaggctgtcccttctgtgagccatctcttgtccagagcaggtagctgggaccgggcatctgctcagccctccgggctctccgtggtgggcagtccgcagcctgtcctccagggttcagcacgtgcattggcggagccggctccccggtggctcggagagcaggacggcccttgtgttccctggaaatcccctcctggcagcagtgggcacgtcgggtgttgtgagtgggccaggggcacagcaagtctgtcctccctgcaggtggcctgtgagaagaccgtgtctaccttgcaccacgttctgcagaggaccatccagtgtgcaaaaggtacggcggccgggctgcatgggctgcgtgggctcctggctcccgaagtgggtgggagagaagagctggcacgtgctggttttgaaggtgtgatcggtgtctcctgctgacctcacctctgggagtgggggcaacagcgggagcccctctgagatgggaactcagtgctctctgcctgccccgcagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaatttgtgatctgaaaacccggctcccttccccacaaggctcctgggcctccgggaagacgggcccctgtttgccatctcgggggtgttccctgtgggagggtgagtgggtgaggccgagcctgctgcgtgtggagcctcgagtgggccctggctgccactaccgtacagaggccgtgtcgcgctgggctgggcctgggtggcctctgtctttgcatctctgagaaggagtcgggtggtaacggttggggtcaggaagaattctgccaagtatctttactgtcattctgaccatagcctctttgttcccgcattcgaacttttggttcttactttgctgctcgtttagtccctggggatttcagatcttaggctgttgtttcaccgtatgggagggttgatgtgagcttgcttggagacacacggtgcagcatcagggaccttcccaggccccagcaaattcaagtcggtctgcagacctctcagctacccgcgggacctcttgtaacccatcggcatcttccaggaatccgccgagtgacttgaggaagatgctaacgcagtaaggtctgtgctgggccaagagcagctttgaagctccagagaaccaccccgtcaggttccttgtggaagctcccctcatccgtggtgcagcaggctgagcactgcgcgtttgccacgtgctgcccgtgacagcacattgagccacagcatttgtagacaggacagaggggtgcctgccccctgcccctgctggcacatttaacccttgtcccctgacctcagttctgtgccccaccaaatgcccaggggcaagaggccaccctggaagctgccaatcttccaaggtgggtgtggggcacggtgggggcgggcagctcccaggcccttgggcaggctggggtgacggcagaggccacagcaccagctctgacaagtcctatcatcctctgctcagcagtgacctccctggccccactttgcccagagtttggggtccccccaggtatagctataggcggcagtgcctgtccctggcctgccttgatttcagccacacccctgcagccctgcatcccagctctggggtgtgcagaggtttgtgtctccagggaacccacggctggagagaaatagggagatgcaggaagtgggggcccatggggcccccaagaagcggactctccaaggggtacccccaccccgctaccttccccacggacgggcccctcctggagcccataccctcctgtgaggccattccagtgtcttctagaaagactcgcttgccaggagtgcgttctttgttgaaaaatgccctgaagcgaaaagatgcaggtttatatggaacccccaccccctcccccactctcccactctgttcgttctgaatgtcttcacgagcgtgcatcagggcgcctggctcccccacctcagccagtgagtcagacacgggtttcgcagccatgtttcctggctccgaggacacgggtggcaggcccgttgcagcccagagccactggtccctacagggcgccgccacaccagcaggaaggaggatggctgtgtccggagcctggcggggaggcggcctccccagtatgtgagtgcagggatctgccagaaccacctggccctctgtagggcgtttaactggaaataccctcactgccaagtggagactggggcgtgtgccacattgccagccaccaggaaagcttttctttttcttttttttttttttttaaacaccaagagcacgtatagcatgggggaaagaacctaaatgtctctctgtcctgtgagctggtgaaaaacccagcatgagaacgcagtgtcaggtgtgggactccttctgcccctgcagtgggtgttacgggcggtgtgccctggcgagcaagctttgattcttggttctttgagctcgtttcagaggctgagtccccacatcagctttagttcttggacttccctgtattaagcaagaattaggagaatggctgtccctgcaggcgcctcccgtaaatcctgagctctctggcgcaatctgaaacttctcttctgttttctttggctgtatcagccgaaccaggagaggcctgggctgcgactaaggagaaagaaatcgggggtttctgagagcagatggtgcctttgtgggtgcagggcttttgtggaaattgtcagcctctacgggcagagtccggcatcccctccccagactgcctgctgtcaaaccacggagcagctggagcctgccctgtccacggcccgtttccacccgggcatgttcgtctctcctgacttcggcagaggcccctggtggccttcagtttcagtttctcatccaggaaggtaaccttgggcattggcagtgggtttccctatggcttggatccagattagaattgatctttgttttcactttccatagttaataacatgcaaaataatgagaagaatttattttaaggtgacagctatactggtccaacatcgcctgcttattgtcagggtacagaagtttaatactttcttaatccagtttttcaaacttctccctgtagaccgtaaggatgaattccacaataggatcctttttaaaatcgattttaaattgttgcctagtcctgccaaggttattatgtgcatctgttatttttccaatacatgtaaacagttgcagcatgatgctttgtttaatgtcctgttcttaagctcgttagagccagttttgaaacgtttggtcttaccgtgaacggaggctggcttggcttagccacgctgatgagtaagtgagggatgtctccatcttgagatcaccaggcaagagagttgcctgcaccaggtaagaggccaaagcccctggggtaacagtccccaccgctacccgaggtaaaacaataaaagctatgtggttgagctcaggcctctcgtgcctggtgtcagagaaggcagagcccacagtaggtgcacggtgcaaggccctgggagggcactggccagggaaggtggtatagatggccctcagattgcggggccccgagcagctccccactctgcccgtccaccttccctggctccagcctcattctctctttagtttaactatgcaaagagaggaggttgagagtgttctggcagctggagctcttttccttgtccttcctgccctccgatggggccacctgtgtcggggcagcagtgtccatgtttatggagatcagaggtgtccccactgtgtggctggactgtactctgctgcccgggtagccaggagtctctccctctctcccctgccgcctgcctggtctcatgggcctccttcacacacccctccctgtggatcgcctgcctgggcccagagcaggggaactggagtttgtgagtgagcagagcaggttatgtgcagacagggaaacgagaactttggacctggctttctgagtccaggtgagagctgtgtggccccccgatgccactctgcccgccggagggatgtgcctgctgagccttttccttccacgccgcctctcactgccaggccagcggcttccgctgagactcgctggagaggcggctcccgtgtccgtccaccgagcactcagatggatgctgatcaccagggccgagggggctcccagaaggaccccaggccctggggagggtggctgtgggaggccaagtccactgcccggaagtcttgtcagccctaagccagggaagcctggagcgtggcctggcgggtctgggtggacaccgtccccactccggactcccagcacaggggaggatacctgagcctgtatggccctgtagccctgggcagagctgggcctgtcgtgtgttcctgcctggcaggtgcaggtgctggccatctgcaggtggaaggaggtgggaatcttggattttttgtttttttttgtttttttttttttgaggtgaagtctcgctctgacacccaggctggcgtgcagtggtgtgatctcggctcactgcaaactccgcttcctgggttcaagtggttctcctgccccagcctcccaagtagctgggattacaggcatgcgccaccacgctcagctgatttttgtatttttagtagagatggggtttcaccatgttggccaagctggtctcaaactcctgacctcaagtgatctgcccgcctcggcctcccagagtgctgggattacaggcatgagccagtgcacccggcggaatcttggaatttttatagacagcacctcagtttctgactccagccgcacacctcctgcctctgccagcaggggttgccgccagaccagagccagggccaggtccctgcgtccatcccccccggtaggatggacgtgagccatccttctaggggacttttttcagtgtgcgactcgtctctgttaggtggtaggagccagtttgtgtggcctgtgccacgctccacagtgcgtggctgggctctgtgtgtggcctgtgtcccctgtccctgcaggacccagcaggcatcgtggcgtgacagctgtgtccaagccactgcccgggcatcccatcacccaccagggtgcacggtctctcctgctgggggctttctgtcgcatgtgtgtctcctgtcgactctgcagtttgttctcagagcagaatgtttcctgttctcagtgcacaaagacactggttttcaatcggcgtctaaaaccacgttcctgcctttcattgcaacacggtgtgttcatttgtttaaaacagtttaatgagtaagtttagatgactggtcaatatcttaaaaatgtatattagtaagaagttcttcctggaatttttctttcgattctggcagaataaacaggtgtttttagttttcccactgtctgagccaagcaggaccctgtcccagagcaagagatgtccccttccatctctgacccttgcctgggacaagctttgatggggggccccagcttcaaggctgtggtgggaacagcacccccaaatgccagcctctcctttcttcccatccaccagtatactgcggggccatttctggtctttgtccaacaggaaacccatttctggtgggatatgccttccagtgccacagggccactcaccccatgcatctctgtcctgcccgtcagtgctgggacggacagcaagggcaagcccagtgtctggcggataggtgggtgggaacagagaggggagaatgccgtcctaagcttctgcttggggatcccccacacgacctgggtactgcctgggaaacctgtcctaagtaaaactatggacctcgcctcgcccaccggcctgcgaagccagcatctccgtgaaggtggatggaagcgcctttgtcctcattttgagctgcaagctgggtcagcggctctgaagccctcgagtgactttctaacccaagacccagcccctggcaggaggagggtgggtgcagggctggtgggacaaaaagaggcctcagcaggcctggaagacccttccagtacatcccacagcgtgtcgagcagctgggagaacctgtgtcaagctcgagccgtcataggtccccatgaggtgtctgaagccccttcttggtgatgggaggcagaggtgctgacgttctggagcatggacgtgagtcctcagctggctccgcgtgggcccttggagggtgccaggtgtgtggtgaccttctggatgcctttaacttcatggctgcgtcattcctgatttagaactttaaccggagcttcatctagtgattgcaaaactggaccaatgggaggacggcggcgcagcccgctccctccgtggaatggagctcagctcttcggaggcatcaaagcacctgtcgcctccgtggtccccctgctgagggagtgcggcctctgcaaggttcgggggtggcttcgtttgcctggagtggccggccctgcttgtgccatgtggatgtttgtgagcctcggtcctacagcactgtgtaggctgcatctgtttcgtgctggtcctgttgacttgtatgatatccacaaataaatattttcatggcggt

SEQ ID NO: 36222 - DNA, 4272 bp, Homo sapiens
gggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatgtaggggtggcgcctgcggggagggctgcgggagggcagcgggagctggtgttagcggcagcggccacggtctcctggcgtccctgggccggggtgggtgttggggcccccgacttcgccgactccgcgccatcgcaaagcggtgcactcgggctccacgcgcgccctgcgaggtgggcgctgcgttttcatttcacgggtgaggagacttagagagacgaagccacttgtccaaggtcacgccgctggtgagtgggagcgcccagcatggaacccagcaccgtccagccgcggagcccgcgttccaccctctgtgccgccgccgcctcctgtgggagagggaggtggtcgggagagtgcacgccggtgccgcctgggctccagactgggcgcgaccactaacccggttaatgacctcgggcttaacttaaccccttcgctgctctgggcctgcgtttctccaccggtgaaatgaggtaatgccagccctgcctactcttcatgggcgtgtaaggagcatcagagatggtgcatgtggaattgctttgcaagtagtgctgcgctgagcgcactgaggattatgattgctgtttcaaaggcgtggaaggaggcagaggggcggggtggggaagaggcccagagcagtcacaaaggcttgctctgaccacaggccccctaaatgaggagtgaggtaagcagtaggtagcaggtctttctcccctttggagaaaacctcacccccttttttgggctgcccctcagggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggtgaggaggggcttgaggtgggcgcctggggggctaggtgttaatgaagaatagggagaacagtagaggaccacggacagagacccagcctctcaggcgtttgcccaggaacgcttgctcctgctcccgtcctatgtctgcggcagacatcatgagtcgaacgcactccttccggcctcgctagggtgccaccccagattcctgctaatagagtgccctaggaagccaccataatttgtcacaattggtatgagatgaaagcctatttgccatctttgtatgtactccctacaaaccgtttcgatacctcatagccacatgatactttacatgtctctagtgtttgcacttaaactctagcacaccttcccgctcaggaaacgggagaggagaaaggtggagaattcaccaagtaaccccatgataagaacagcagcacagctctgttaccaggctgccttttacctctccccctcaggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcaggtgctggagggggttaaaatcagatgggggtggggagggctgacaggaggaggaaggtgggctcagttggctgggctgaggtggaattgagccagccggaggtccggctgaggcccagcgtgacaggctgctcttcacagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtgggcttgccacccaccctccagtgcatctctgtcattctcagggaccttgtcaggcccagcgcctcgtgcagctcggctatccttttcctgaagcagacacaccctctctgtcccctgggacctgcatcttttctacaccctttctgtggcttgcccacctcctgtcagcagcatgcattcctggaaatctgcagtttcccaaagcactcttagcagcatcctagctccacccatccctctcgaagtcttcagggccagaccccacagcgatgtcccctctgcctgtctggtgattagtcacgtgcagctcgtgactgctttgctgttgaactgtgaggccggagggactgtcctgtctttacagcagtgttgtaaacctgagggctaagcctctctaaggcttagcttgtaaaagatgactgcagaaatacttgacactgggtaatgaactgctcttcctccacaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggtacgcagccaggatggctggctgggcccctgagggctggagaggcaggggagcagggtggcctgcagcccagagccccagtccccgcctccccacaggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacaggtggatggggcagcctggggcaaggggaggggccagcctgggaccagcagagtggaaaagccagagggaccatgaagcgccaaagctaaggagctctcggccaccataaaactgggccctgaagcagcagagggctttgcccagggtggtggcactagactgggacagattaggatgaggtgccgggcccttcctgctactggtgtcctttctcctcagtcacaaggacatagtagctgaggggttgcgccagctgctgggggaggagaaataccgccaggacctgactgtgcctccaggctactgcacaggtgagcaaggggcaggcggcaggcccggggagacggagccctggctaaggccgccggccctgctcccctccagacttcctgctgtgcgccagcagctctggtgctgtgcttcccgtgaggacccaggaccccttcctgccatacccaccaaggtcctgcccacagggccaggctgcctctagcgccactactcgagaccctgcccagaggtaaaggaggcagggtgggggagccctggccaccttgcccgccatgccctgagccacgtccctccccctgcagggtggtgctggtgttgcgggaacgctggcatttctgccgggacggccgggtgctgctgggctcgagggccctgagggagcggcacctaggcctgatgggctaccagctcctgccggtgagtggccctggcctggcccgtggcgcatcctcactcccagcctgcgggtaacctgccgccctctcctctccccacagctacccttcgaggaactggagtcccagagaggcctgccccagctcaagagctacctgaggcagaagctccaggccctgggcctgcgctgggggcctgaagggggctgaggggttgatgtggggttcaggatggcccccccatggggggtggatgatttgcactttggttccctgtgttttgatttctcattaaagttcctttccttccccgttgtgaatctcagttttgggacggggagc

SEQ ID NO: 36223 - DNA, 42848 bp, Homo sapiens
gagtggagttctggaggaatgtttaccagacacagagcccagagggacagcgcccagagcccggatagagagacacggcctcactggctcaggacagggggcacagccaccagggtccccttccccctcctcagctccctccctggcccctttaagaaagagctgatcctctcctctcttgagttaacccctgattgtccaggtggcccctgggctctggccctggtgggcggaggcaaagggggagccaggggcggagaaagggttgcccaagtctgggagtgagggaaggaggcaggggtgctgagaaggcggctgctgggcagagccggtggcaagggcctcccctgccgctgtgccaggcaggcagtgccaaatccggggagcctggagctggggggagggccggggacagcccggccctgccccctcccccgctgggagcccaacaacttctgaggaaagtttggcacccatggcgtggcggtgccccaggatgggcagggtcccgctggcctggtgcttggcgctgtgcggctgggcgtgcatggcccccaggggtgagtgatgggggctccttggggcagggatcccctcggaggggctggggcaggggtaggaggtgggggatgatggcaggtgtggggggcctgggctggcttagggagtttccttgggaccacagaaaagggacttcaagggagggagacacagactcagagacaccaagtgcggcagagggagagaaagactgagagaggaactgaagggcaggggggacagaagagaggacccggagagacagacagacaaggagaagctgagggcaggggtgggggctggacctgagaagggggccatggggagaggggctgagctgagggtcgccaggaaggaagaaatctttccgaaggggcaccgagtcaggcagtgggatgaggagggctctggagccctgggggaaaacgcttctccctgccaacaccacccccctgacccgccacttgtccctaccccaccagtccactccatctctggggaggaggctctcactttgtctctctgtctctgcctccagctctgctatctctgtgggtctctgtttctctctctttcacagtctctgcctttatctctccctgctctctgagtctctctctctcttctcagcctccctctgtgactgtatcccccctccgcccccaccttttcttctctcttgagggctgtttcttcattttttctgtcttgccttgtatctgtgctcctctctgtctcatctcccctgcctttctctggcttctccctccgccaccacccttatctccccccaccaccacccttatctctctcccccaacccctgattcttcccctccatccaccagcaccagcgcgacctgttaagtctctagagacctaagagaggacggagggggcaggggctggccctgccaggcagtgcagggcgtgggaggctgccagatcccgagcctccttcccgacgggatggacgctagatcccagtcccttgggagggctcccgtcctcctctcagagcctccgccctccaccccactctgaggtcactctgcaactatgtcggcctaagggcctggcggggtcctggccgccggtgggcaggcaaggacagggtggaactgagggccggaaggagctggggggttcctaagctaactcttcccatctcccctccaggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcaggtgtgtggccacatccccgaatcccactcccacctccgtcacacagagggcagaaagcccacctgggtgggaaccccagtttgaccacttgtcagccgtgcggctttgagcatgtgatggaacctctaggtttcgttttcctcttctgcaaaatgagttaataataggacatacttcgtggttgtcatgagcttccagactggacaccctctttccgttctgacagaccccctcccagtgtccagctctgaccctgaacctctctgtctctcctcttgccctgtcagaatcacctccctgcagctttccgacacgggacagtaccagtgtttggtgtttctgggacatcagaccttcgtgtcccagcctggctatgttgggctggagggtgagctctggggtcaggggtcctgaggggtcagaggacatgtggcgctcataggttgtgggaagtcaggaatcctgaggggtcaaggtcaaagggtgctggaggattcaggatgaacctagcgtcatacagcctaagaatgtcagagttttgggtggtcaagaagctgggagtccatataagttatggtgccaaggctgggggattatatgttctgggtgaaaagacttcttgggggtagttggatgtcctaggcatcagacaccatcaggtcacaggaggccattctggtcttcagataaggcgtcagaggcacgcaacgtacccctgtccccacgaccccagcggtctcttttttctcatccatagaatgagatgaggatgagctgtcagacattctggaagagagacatgaggagctcagctatcgtggggggtctgacatgggaggaatcagatattggggtcacgtgtgtgttgggtatggctcaggtgccctcggggatcagataaggcaagtcaatgaccctgcagggtgggtttgctgcccaaagcctacagcatcctagtggtgagtcaggcatcttggggcctcagagggaccccagcctctaccactgcccaccccgctaggcttgccttacttcctggaggagcccgaagacaggactgtggccgccaacacccccttcaacctgagctgccaagctcagggacccccagagcccgtggacctactctggctccaggatgctgtccccctggccacggctccaggtcacggcccccagcgcagcctgcatgttccaggtgagtccggggatgtgggtcagctccgaatagggggccgggcagggctgaagtcaggagcaagggaacattgctacctctgcgtgagtgtctgactgtccttctgtccctcactgtctgtctctctcgtttctccctctgagtctgtctctgcctctctgtctctacctatcttatttctctccgtatgcctttttctgtctctttctgtctcttggtgtgtgtgtctttctgtctctctttgtatgtgtctctctctctgtctctctgcttctctctccctccattcaccccggcctctctctgaatagaattctttgtcctgggtttcctctgagctgttccatggctcgagtgcgtgtgggcctggtgcccctttgtcagcccttgacccaagcagggcaccggaatcaaccgtgccctcctctcctccgcctccctccacaaccggcccacctcctgccctaacaagcctgctggcctcagtcaaagggaggatgtccagcccggtccccactggggagatggaacccaaagaagagagagcaggaagaaagtaggagacagaggctgggcgtggtggctcacgcctgtaatcccagcactttgggaggctgaggcgggcggatcacgaggtcaggagatcaagaccatcctggctaacacggtgaaaccccatctctactaaaaatacaaaaaattagccgggcgtggtggcgggcgcctgtagtcccagctactcgggaggctgaggcaggagaatggcaggaacccgagaggcggagcttgcagtgagccgagattgcgccactgcactccagcctgggcgacagggcgagactccatctcaaaagaaaaaaaaaaaaaaagaaagtgggagacagagagagatagaatgacatacactggaagggacaggccacagtgacccaagatgaacatagacaggacagagaggccgggcatggtggctcacgcctgtaatcccagcactttgggaggctgaggcaggtggatcacttgaggctgggagttcgagaccagcctggccaacatgacaaaactccatctttaccaaaaatacaaaaattagccaggcgtggtgacgggcatctgtagtcccagctacttgggaggctgaggcaggagaatcgcttgaacccgggagatggaggttgcagtgagccgagatcacaccactgcactccagcctgggtgacagagcaagactctgtctcaaaacgaaaaacaaaacaaaatgaaagacaggacagggaagttggagtgacagaaaccctctccttcttggggaccattcccttctgcaccatgcagacgaggaaggaccgagctcagggttatgcagtggtcaggggcatcactgggggaccctggattcagggggttctccctactgaaggaggaaagacagaggagcagatggcagaggctctgtaaaggaaggaggctgcagcctggagggcatcagcttcccgcactcccaacctgctgcctctctctgctggaatgaggaggggccttctgactgggggtctccagggtggagggaggagctcacattctcagcattcctgggaccctgagttgcaaggaagacctggtgagcatgctgaccccagaggagtgactcaggcccatggctcgagtggctgagtagggaccagggttggggatcgggcatgagtcagcctggcaggtcccatgagaaggggaggggagggagagaaatgggggctgcacaggtgtgaggatctgtgcatgtctgtgtggtggtggtggggtgtctggatatctgtgtgttctggatctgagtgttagtgtatccgtcagcacaacctctgtgtgagggtgtgccttggcgagggtggacttctgtggatgtcccatgtgtggtgtgtgtgtgtgtgtgtgtgactaaatatatttccttcagcttggattctgtcccaatatgtgtttggatctttatagcatgtctctctctctacgtttcttaggggttgcccgtgtgtgggtgtctgtgtgtgtgcgcatgatggagtgtaccagtgtcagcctgtgtctgtccctcttttttgtgtttgtgtgttcacagctgggactcactgtatgaaagtaaagtgtgcctggagggtagtgggtttggggctatggtgcacacctctctgtatggaggtggtagtgtcagcccacaggtgtgcagctatgggtgtgagagtgtcctagtgagagcttgtgttcccttgcagaatcagaacgtgtccatggataacttgtgtttcttaccaccttttttcccccttattttttttcaagataagctcccgctgtgtaacccaggctggagtgcagtactgtgatcatggctcactgtagcctccacctcctgggctcaagcaatcctcctacctcagcaccctcccacccctcaagcagctgggactataggcatgtgccaccatacccagatagtttttgaattttttggtagagacagagtctcgccatgttgcccaggctgctcttgaactcctggcctcaagtgatcctcccgcctcggcctcccaaagtgttgggatttacaggcgtgagccactgctctcaaccctcagcctcttaccagctttctgtgtgtgtccatagatgtctctgtggcgtgtgtgtatatgtcacagggtaagcatgttggtgtatgactgtagtcacagacctgtgtgtgtgtgtgtgtgtgtaacagcaccctctgcttctctctggtctccctgtgtgtgcactggcccctgctgcctctgagtacatgacctaaggatgcttaccagtcagcgtatagatgtgtctctgtgtcaatctatgtgtccatggcagtgtctccatccttgtgtgtctgcatcaggcctgcgcatctacgaaactgtgtttttttgttttttggggtttttgttttgagacggagtctcactctgtcacccaagctggagtgcagtggcacgatcttggcttactgtaacttccgcctccggggttcaagggattctcctgcctcagcctcctgaggagctgcgattacaggcacgcctggcttatttttgtatttttagtaaagacagggtttcatgacaggtttgtcatgttggccaggctggtctcaaactcctgacctcaagtgatccaccggcctcggcctcccaaagtactgggattacaggcgtgagccaccgcacccagcgcaaatgtgtttttgtatcagtctgtgtctgggtgaacatgaaacctgggcgcatccagctccatcttatggcgtagatggaggcttggctgtgaggtgtacgcgtcggtgtgtctgtgtctgagcaggtcaaaatgacccttcattgtgtcctggtgtgtatctatctgtccacctcaactccatgtacgctgttacgtggtgtgtgtctctgaatatacagggacatttaagtttctgtgtgtgttggcatcagcctagatgtacattgcgtcgctaggtgtttgtaatcaatgtgtacatgtgtgactgtgtgtttatgtgtttgtcccacgttggcttgtatgcatacatgtctctttatgaatgtacatcagtgtcagcccgcgtgtatatgtgtgagtcacggtgtttttgtgtcactgtgtttgtgacatcagcccttgcatatctgtgtgccgttaacttaccaagcgctgcgtcttctgtgctaataacagcccctgtgtgtttaagtgtgattcattgtgagtgtgtgtgtgggggggtttgctgtgtgaaggaatttcgtccgtttgtgtgcgtctgtccctctatctgactcagggcgtgcccctcctccttccatccctctcattctctggaaaagctggggcggagagcaggggttgtggggggatggtcaggacatctggaaagcacatctggaatcggcctgctcctgtcgtcttgcggtaaagcaagaaccttctggaggggaaggggtcccagttcctcctgtccccttcactcaaggtgcggccgttggggcctgggaagggggatcccggctctggctccgcgcccccgaagccggccggaagcgctggggtggggaggtgcccccggtgactcacgcgggggcaggaatgctgcggtcggaacgggacccggctccagaacccacctccagccccagggcttctccggccggcggcgccagctcccgcgcgctgaccctggcggggccccacgtgccaggtggctggacccgacccaggctccccgcccccactcgggccgcccgcccgggactgtactgtttctcctccgggcggcgcgggggctgcgggcgcggggccttcagggcgcggaggctgcgggagcgggcacctgaccttgtctgggaacggccacctaggaagccgcgactgaggagctcccctaccctcccctttccggcctctgcagactttgcaccattccactccctccgctgacggagaaaaggaaactttgtgtctgcggatggagagcctcccttgccaacgcggtgggaacagaggcgtacacgcacggagcaaacacgagagacacgtacacagatactcaacacatgcacgtacacaccatccacagatacacgcagggtcacaaacataccagctcagaaacacaaacacagatgcacaagcacacgcgtaaacaacacgcagaactgcagtcgcacttacaagacttggtcccagggccgggcaccgagtggctctgcctgcgatccagcactttgggaggccgaggcgggaggatcgcttggggccagaagtttgagagcagcctgggcaacgtggtgagactctcctcttctctacaaaaaaaaattgaaaagttagccaagtgtggtggccgcctgtagtcccagctgcttgggaggatgagacaggaggatcgcttgagccctggaggtcaaggcagcagtgagccgtgattgtgccactgtactgcagcctgggagatagagcaagaacctgtctcaaaaaacaaaacgaaaaacttggtccttcttacatcctagcgcagacattgtgtgtgtgtgctgggggaggggggtgtctatgtttctacgtgtatctgtgttgggggattccccttattcaccaggatacgttctctaagagcccccacaaaagcctgaaacaatgaataatactaaaccctgtatatactacacataactttctttttccttcacaatttcgcagatagattgttttcttactatagatcttagcaacctcagtacatatatatatgattatctttttctaagtggagaattttcaccttttcacttaaaaggaagcactttaaggcttctctttggcctatccgaattgcagccatcactattttgcaccctggggccttttttttttttttttagacagagtctctctctgtcgcccaggctggagtgcagtgtggcgaccttggctcactgcaacctccgcagcccgggttctagcagttatcgtgcctcagcctcccgagtagctgggattacaggcacgcgccaccatgcccggctgatttttttgtatttttagtagagacgggggtttcactgtgttgcccaggcttgtcttaaactcctaatctcaagtgatccacccgcctcggcctcccaaagtgctgggattacagatgtgagccatagcacccggccaggcgattatttagataaataagagtttcttgaactctgcacttgagcactgcagtaccaggacagttgatctgatagctaagtgacttacagacaggtatcagatacagcactgagatgctggacaaaggggggattcacgttctaggccaaccagagtgggatggcatgaggtttcatcacagtactcagaacggcatgcaatttaaaacttaggagttatatctggaattttccattgaaatatttttagaccaagtgtaactgaaacctcaaaaagtgaaacctcggataaagggggactgatgtacgttgtatagcggtttgtgttgggtatctctgtgtgcttgcaggtctgtgtctctcgtgtttgtctctgtaattgtacgtgcttctgtgtgtgcacgctggtcataccaacaccaacaccaccacgttagggagggaaggcaatccaccttcactcgaaaacagttactcaaggccgggcacggtggctcacacctgtgatcccagcactttgggaggctgagatgggcagatcacttgaggtcaggagttcgagaccagcctggccaacatggtgaaaccctatctctactaaaaattacaaaaattagccgggcatggtggcgcgctcctgtaatcccagctactcagaaggctgaggcaggagaatggcttgaacccaggaggcagaggttgcagtgagccaagatcatgccactgcactttagcctgggcaacagagcaagactctcaaaaaacaaaagaaaaaaacagtcaagacacaatacgtgaactcccctatggaattacacatgctcatatttctacacctatgcccaggaatgctcataagtacatagctgaacacaatttcactcactcattcaacaagcatttatggcacacctattgtgtgccaggccatcctgacacagcaggggacgaaacagacacaacccctgccctcctagagctgacattctagtgggagaaactgacaatgggcaaggtacttgggtaacaggtaaagtatgttgggtgatgagaagaaccaaagaggaaaagtaaagcgggaaggggatagatttggagaggaagctccaattagctccaattttattgtattttttctttctttctttgtcttttcttttctttcttttttttttgagacagagtttcactcttgttgcccaggctggagtgcaatggcgtgatctcagctcactgcagcctctgcctcccgggttcaagctattctcctgcctcagcctcctgagtagctgggattaaaggggcctgccactatgcccagctaattttttgtatttttagtagagacgaggtttcactatgttggccaggctggtctcgaacttcggacctcaggtgatccacccacctcggcctcctaaggctgggattacgggcatgaaccaccgtgcccagcctttatttttcattttattatttttagtttttttgagacagggtctcactctgtcacccaggttggagtgcagtggtgtgatcacagctcactgcagcctccacctccccgggcacaggtagtcctcccacctcagcctcccaagtagctgggactacaggtgtgcaccaccacacccagctaatttttctcttttttgtagagatggggtctcaccacgttgcccaggctggtctctaactcctggcctcaagcgatcctcctgactcagcctcccaaagtgctgggattacagtcatgagtcactatgcctggccaagctccaatattaacagggtggccaggcctagcggactgagaggtgttgttgaggaacaaaaatgaaagaagagggtgcgagtcatgtagacatttgtggaagactgttttgagcacagggaacagtgcacagttcttggagtggaaacatgcttcatgtatgtgttccagagacactggaggccagtgtggccggagaagagcgtgtgacagggagagtgggagaggggttggtaggaggcgagcttagagatgaacagacatgtctccattgatgtacagccatgggccagtttccctaagtgtgtctagcaggtgtgtgtgctcatacttgtgtccttgtgagttagtgagggtgcctgtgtttgtgcatgtgagtgtgtgcatgtttgtgtgtctccttgtgtgtgtgtgtctgtgtatgcttttgtgtgtctatgtgtgagtatgtatatatgtgtctatgtccatatatatgagcacgtgtatttctgtgtgtgtctatatatgtgtatatgagtatgtgagtatctaggtgtacgaatctgtgtgtgtgagacacagtgtgtgtgtgtggctgtgtctgtttctgtgtctgtgtctgtgtctgtgtgtgagcatatgtgtttatatgtgtgtgtatgagtatgtgtctctggggtgtaagaatgtgtgtgtgtgcctgtgtgtgactgtgtgtgagtctgtgtgagcatgtgtgtgtatgagtatgtatctctctctggggtgtaagaatgtgtgtgtgtgtgtgtatgcgcctgtgcctgtgtgtgtgtctgagcatatgtgtctatgtgtgtgtatgagtgtgtgtctctatctggggtgtaagagtgagtgtgcctgtgactgtgtgtggttgtgtgtcttcatgtgtgtttgtgtatgtgtgtttttgtgtgtgtatgcctgtgcctgtgtgtggctgtgtgtctttgtgtgtgtctgtgtctgtgtgtctgtgtgtatgagtgtgtgtgcctgtgcctgtgtgtggctgtgtgtgtctttgtgtgtttctgtgtgagtatgtgtgtctatgtgtgtgtatgagtgtgtctgtctctggggtgtaagaatgtgtgtgtgagacagtgtgtgtgcctgtgcctgtgcctgtgtgtgtctgtgtgtgtctgtactatgtgtgtctgtgtggcgggaggttagggctgaaaccaagccatccttgtgtttggggatggaggctgtgttcctaactcattgccctcaactctgctaaccctcccttcaggcaagtgcctgtgtgggctgcactgcccctggtcaggcaggccatggtaggagtggcccggcatggccccggagcccttcctgcccctctctgatattggacccttccctcatatgactccctagggctgaacaagacatcctctttctcctgcgaagcccataacgccaagggggtcaccacatcccgcacagccaccatcacaggtgacagagttgggaggtggggagctgggcgtcagagggtggggtttgggtccggggtcagagtgggggcagagagcagggtagggagctttgagcaaaggctccccagggtcaatctctcccgtttgtccacagtgctcccccagcagccccgtaacctccacctggtctcccgccaacccacggagctggaggtggcttggactccaggcctgagcggcatctaccccctgacccactgcaccctgcaggtgagactcccaaacttggttcatttcagtctcaggcctccttccacccacatccacaacccccatcctctccctgggaacccaccacttctcggccactgttgagaagcagtagagcctggggggttaagccagatgtcctgggttcgaatcctagctccaccaccttctggctgtgtgaccttgggtaggtggcttaatctgtccggggctcagctctcttgtctacaaaatggacataatggtagtgcctacctggtatgcttagtgtgaaaattcaatgagtgaatgcaaattaccaacttaaaatggtatatagaacataggaaacaaatttaacaaaattggccaggcgcggtggctcacacctgtaatcccagcactttgggaggccgaggtgggcggatcacttgaggtcaggagttcgagaccagcctggccaacatagtgaaaccacatttctactaaaaatacaaaaattaactgggcctggtgggacgcacttgtagtcccagctactggggaggctgaggcaggagaattgcttgaacctgggaggcggaggttgcagtgagccaagatcgtgccactgctctccagcctgggtgacagagcgagactctgtctcaaaaaaaaaaaagaaacaacaacaaaaaaaatttaacaaaatgaaaatgatcagctgttttaattattttcagtattagtgatgttaactctagccagagtgggagccctgagacagcagagtctggagccatttctgtcaccactggatacccagaaccctccacttctcccatcccagccctggccactctgtgtggtcactgtctggggatgggtctgtcccctactggaatgtgagctctgacagggcagggctggagctgtcccagtcaccactggctcctcattcttgcccagcacaggaccagacatagagtagggaatattcgctagaaggatatattacaacccagatgagctagacccagcctctgccctcaagttgctcctagaataagaaaaccaaaaccaggccaggtgtggtggcttacacctgtaaccccagcactttgggaggccaaggctggtggatcacctgaggtcaggagttcgagaccagcctggctaacatggtgaaaccccatttctactaaaaatacaaaaaattagccgggtgtggtggcacacacctgtaatcccagctactcaggaggctgaggcaggagaatcccttgaaccctggaggcagaggttgcagtgagccgagatcgtgccattgcactccagcttgggtaacacgagcgaacttccgtctcaagaaaaaaaaaaaaagaaagaaagaaagaagaaaaccaaaaccaaaacaaaactcacagatctgtaaatataaggcctaattctggtctgaagttctctgagattagaaagttggagatggggggtggacagtgcctatgatggtagatgacagtaatgaagaatgaccaatttctactgagtgtccgctgtgcaccgggtcttgcattaacgcacacctgctcgtgtgtttgtgaaggagggtctatggatacacccattttccagatgaagaaactaaggctcagagtggttaaccagattgtccaaggtcacatcaaacccatgtcatgctcctaacctccttagaaactgttttttgttttttcttttcttttttttttgagacagagtctcgctctgttacccagactggagtgctgtggcgtgatcacggcttattgcaacctccgcctcctaggttcaagcaattctcttgcctcagcctcctgagtagctggtattacaggcgcccaccaccacgcccagctaatttttgtatttttagtagagacagggtttcaccatgttggtcaggctggtctcgaactcttgacctcaagtgacccgcccacctcggcctcccaaagtgctgggattacaggcgtgaggcaccgcgctgggccctgagaaaatgtttagagtcagtgcttgattaaacaggaattgtcttatacttacatgctctgagcacaaccccatctgcttgtcgttttaaacctagaaaatagtggctattggctgggcatgatagctcacgcctgtaatcccagcacttcggggggctgaggcaggtctgtacaaaaaattcaaaaaaattagctcagtgtggtggcacacacctgtagtcccagatactcgggaggctgaagtgggacaatcacctgagcctggcagtcaaggctacagtgaggcaggattgaacctctgctctccagcttgggtgacagagtaagactctgtctgagaaaaaaaaaaacaaaaaacagtggctattaatcttcccgttttcaaggtgaggaactgaggcccagagaggggccccctctctgggcctcagttcctcccatcctcctcccctccccggggctagaaagccgaagctgagattcaatcccagaggccagctggatttgggagacctcaaatgccaggtcaggcataagttgcactctacccacatcaccaagtgtccccaggaaagcagaagtgtgtcctcttccctttccaggtctcacttcctgctgcacatgggctagggctgaagagttccagtgggagggtcacagccgtcccagggaaaagagaagtgggagcaggcatggggagaccaactgtctgtacccatctcctctctgtcctggtagaggttcctcttcctgtctgtcactgcaggtcagagagcaggcatggtgacagcctcaccccctcctcgtacccaccatctgcccccactcctccccaggtctcatggtggtgtcatctccctccatgggggctgtgtgactttgggcaagttgctgaacctctctgggccttggcttccctgtctgtaaaatggggatgagaaaagaaattgaccccatagggtggtagtgcgaagtcaatgagttcatccagtaatgtgcttgacagagagcttggtacatatttggcactcaagaaatatttgctaggccgggtgccatggctcacacctgtaatactagacctttgggaggccgaggcaggtggatcgcttgagcccaggagtttgagacctgcctggccaacatggtgaaacgccatctctccaaataattaaaaaattaggtggggctgtcattacaccactgcactccagcttgtgtgacagagtgagaccctgcctaaaaaaaagaaaaaagaaaaagaaagaaagaaagaaaacaaacgttagctgttgataattataatgtgcaaagcagtttatatgcatcatgtcattaaaccttataccctgacaagtaagaactgtgatgcccattttccagagacagaaactgagactcagagaagttaagacactcactctaggtcacacagcaaacaacatccaacacaggacttagatccaaggaatctggctttagagcccacaccctgtggcagtaaactccttcctgacatactgtgtggctgtatggctggagtctccagggtgaaggggaagcccttggctgcaccattcctgaggcgtggctgtgaattgtgtggttatgggggttttgtggttccatgtggcagggctatacagatgtgtacaccagtggtggccccctccactctgagtgtgccattcctcgggtggaataggtatgggaacctgtgccgctatgcagagcttgacacttgttgccaggaaacacacataaaataataagtgacaggccgggcacggtggctcgtgcctgtgatcccagcactttgggaggctgagcgggcagatcacctgaggtagggagtttgagaccagcctgaccaacatggagtaaccctgtctctactaaaaatacagaattagccgggtgtggtggtgcatgcctgtaatcctagctactcaggaggttgaggcaagagaatcacttgaacctgggaggcggaggttgcagtgagccgagatcatgccattgtactccagcctgggcaacaagagcgaaactccatctcaaataaataaataaataaatagatagatagatagatagatagatagatagatagatagataataaatgacagtatgcacaagcagtcttctaaatgcttacatgccccaattcagtcaaccctgtgaagtggggagccactgtcatcccattttacaggtgagaagactgaggcacacagctagggaatgatagagcctggatttgagccccagatccagcatccgtgctcctcagcactaggctaaactgcctctgtgcacagacaagaggtattgttaccattactgatattcttaccgccagtagagcaaagactctggggacaggatggggtttaggtcccagcttcatcagtgacaaactgatgaccttgaacaagtgattccgtctctctgggcctcagtgttgtcatctgtacagtgggaataagcataatgcttaccacaggacaacaggattgatgtgagggccaaatgaattcagatttgtcaagggctaagaaaggcactcagtacatgttggacgtgttttatctttttttattaagataatatataacatagtcaggtgaggtggctcacgcctgtaatcccagcactttgggaggccgaggcaggtggattacctgaggtcaggagtttgagaccagcctgggcaacatggtgaaaccctttctctacacagaataaaaaaaaagccgggtgtggtagctcacacctgtaatcccagcactttgggaggccgaggggggcggatcacttgagatcaggagttcaagaccagcctgaccaacatgatgaaacctcgtctctactaaaaatacaaaaaagttagccaggcatggtggcacatgactgtagccccagctactcgagaggctgaagcagaagaattacttgagcccaggaggcggaggttgcagtgagccgagattgtaccactgcactccaacctgagtgacagagcaagactctgtctaaaaaaaaaaaaaaaaaaaaattagtcaagcatggttgctcacgcctgtaatcccatctacttgggaggccgaggcatgagaattgcctgaacctgggaggcggagattgcagtgagccgaaatcacgccactgcactccagctcaggtgatgaaatgagactcataggccgggcacggtggctcacacctgtaatcccagcactttgagaggctgaggcgggcggattgcctgaggtcaagagtttgagaccagcctgactaacatggtgaaacgctgtctctactgaaaatacggcaattagtcgggcgtggtggtacgcgtagtcccagctacttgggaggctgaggcagaagaattgcttgaacctaggagacggaggttgcagtgagccaagatctcaccactgcactatagcctgggcgacagagcaagactccctctccaaaaaaaggaaaaaaaaaaaaaaagaaaaagaaatgagatgtataacatgcataatcttcagtgtacctctagatcaagctcgtctaacacatgtggcccaggatggctttgaatgcggcccaacataagttcgtaaactttcttaaaacattatgagatttgtttgtgatttttttttttaacgcatcagctatcgttagtgttagcgtattttatgtgtggcccaagacaattcttcttccactgtggtccaagaaagtcaaaagattggacacctttgagattgtttaacacacatattcaccatgtaaccaccatccaaatcaagacacagacccttccagtccccaagaagtctccctcaggccccagagatggccacccttctgcttctagaacattgcttttgcctgtagtataatgtcatataaatggggcctcacagtatcgtgctattattatgatgatcattactattatttgagacagagtcttgctctgttacccaggctggagtgcagtggtgtgatcttagctcactgtaacctctgcctcccaggttcaagtggttctcctatcgcagcctcccgagtagctgggattacaggcgagcgccaccacatccagctaattttttacatttttggaagagatggggtttcaccacgttggccaggctggtcttgaactcctaacctcaagtgatcgcccaccttggcctcccaaagtgctgggattacaggcgggagccaccgtgcccagtctatttgcgttattattgtcatcacactattattatcggtgctgaccacccgccatgcactgtggcatcctttgggcataactacacttaatctttaaacaatcctgtaaggcacttgatcctctaaggccccgtgtgcccaaggaaaaaactgaggctcagagagggaagagtcttgccagaggtggcttttggaagtggtgacagaaccacattgtatacagccaaatgatctccttgctttgcaaatccaggtgcccgtgttatcctagcatggcactgcaacacacacgcacccttgaaaagttgtgtagtcacaccagaccaccaccactgggagctgtgtgaccatctcgtgtgattgcttggctgtcccgtcctcacacccttgcctctcctcaggctgtgctgtcaaacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggaggtaagaagggttggggagggacacgtcaccactgccccaccggaccttgcttatatcagtgccacccccattgtcccctttcactcctttacccctcatggcctcaatctccttcccatccaatctctgacccctcagcagcactgcccgctggcctctctcccagcccttctctcccctgtgcttcctctcatgggaggcctgcacgagttgcccacgtgtgtgcccttggcaccctgcacccacttcctgggaacaggggagggggtcaggaagaggtgggggtgccagcttcccctcttccctgtcctccagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgggtgctgctggtgggattggagtggagtggcttggggaggagggaggagaacatatcagggcagacatagatggttgtgaaggttgggtagtacacaattgctctatgcctagggggcacattcagggaaggttcacattcacattctggggagaataagggggtctaagggagggcatggggaatggctgtttttgaaccactgcaaaagcatttcagcagactcatatttactatataacgattttacagcagatagttatatagcaccttggggaaggggtaccttttcctgattttcacaaaggcactcctatcagggctagcaataccctgacatagggagggaggatggaaagggaagctagaaggggatggagggatacaggttaaaggatgaggatgagagatgaaggggaggacgaggaaggatgaggagttggaggatggggagagcgttttgagaaagagatggggcattgagcccgagagtgaaggcttaacagctggggggtaaggttctaccctgatgccacttctggacctcctaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccaggtaagtccaaagccatgcccaacctgcttcaaccctgtctctccctgacagccctgacttactccttgtacctttcagtgttaccgcaacttaggccctgttcctaccctgagccttactgagagctgccctcactcccttacccatgccaacccctcactcccttacctgtgccacggcctcactcctttacccgtgccacaccctcactcccttacccgtgccacaccctcactcccttacccgtgccaaaccttcactcccttactcgtgccacaccctcactcccttacccgtgccacacccttactcccttacccgtgccacgccagtcttgtcctctctgagcacatctcctctctgtcctttcttctcacagggcaagcacagccagtccaccagctgggtaagggcttccacaccccatctcctccttccctaccctcaacacctagtgggggcactgtcaccatgcatactcattgcacatccctttcatgtttctctaactcatcactctaacctacttcttgagtttgtgtggtccttgatggaggtgcctataatggcctagcatagcacattgtaggtattcaggcaatgacagatgagtgggtggatggatgaacaaatagatggatggatggatggatagatatatggagggtggatgggtgggtgggtcaatggatgaatagaggatggataggcgggtgaacagataaatgactggatgtcgagtggataaatggatgggtagatggatgggtggatggatggatgggtggatatatggagaatggatgggtgtgtgggccaatggatgaatagagggtggataggtgggtgaacagataaatgactggatggtgagtggataaatggatgggtagatggatgggtggatggatgggtgggtggatatatggagggtggatggatggatggttggatatatggagggtggatgggtgggtgggtcaatggattaatagatgggtggataggtggatgaacaaaagatgactgggtggtgagtggatatatggatgggtagatgggtggatggatggatggatggatggatgaatggatggttggataaatggatggatggacagatggatggatttgtgagtggatgaatggatgggtagaaaggtggatggatggatgaatgaggtatcctcctcacatccatccctctcaaatatttctctaacaattctcaaacattcctcctacacccattgtcccctctgggcactattatggttcactcttgtaactcaacccactagccttcaatactcctcacatcccttcctacatttcttcacatacgctttccacgcttattccaccctcctttcacatatatcccattataatccgttcctcccacatgaccccaaaggcccattgcacaacacacttctcattcacaaactctgcacaccttgtatgcacttaccataccttccacattgcaaacactgaaaaacattgtccacaactttcccacacctgattctccttgcatgcttactgcacactccatagacatcattccctcacccttcactaatcccaacccatctcactctgcacactcaccctgaaccccttgcatactcagcacataatgatctttatttcttacacactccattccacccctgccctttttacaccccctttctgtgcaccccatacttctcatctgcccttctaacatcttttgcatgctcactgcacacttctctcacactgcaattacatccttaaaattccttgctcactccttgtatctaagacttcacgaatactcttcccacttcacacacccccaacttttccagcagccatccaaccctgtatatgcttaccatgcccctttggatatttatttcaccctcattcctggctttatggaaaccattgtggccgggtgcaatggctcacgcctgtaatcccagtactttgggaggcctgagacaggtggatcacctgaggtcaggagttcaagaccagcctggccaacattggcgaaaacccatctctactaaaaatacaaaaattagctgggcctggtggtgcgagcctgtaatcccagctgctcgggaggctgaggcacaagaattgcttgaacctgggaggcggaggttacagtgagccaagatcatgccactatactccagcctgggcaacacagcaagactctgtctcaaaaaaaaaaaaaaaagaaagaaagaaagaaaaaaagaaagaaaagaaaaagaaaagaaaaaaaaattagccaggtggcacagacctgcagtcccagctactcaggagacatggtgaaaccctgtctctaccaaaaaaagaatacaaaaattagctgggcatggtggtgcacacctgtaatcccagctacttagaagctgaggcaggagatttgcttgaaactgggaggcagaggttgcaatgagctgagaccgggccactgcactccagcctgggtgaaagagtgagaccctgtctcaaaaaacaaacaaacaaaaaaagagacaaagaaaacccttttgtagtcattgcattctcttcaaaagatgttccttagtccgccctccttgcacacgcttcatgcaccatcctacactgcaaggatcttcttccccactcacctgcttatctacactctagtccacccttcttgcacaatcatcacatttctcacactaacctatgctgcttgagatttctccacacccatctcatgttcatctagccctcttggcacactcataacgcgttccacacatctctccctcccattccacactcactgcacactcctcaaatatccattccactcttctgtttttttggatcttggtggcataatatttggtagcttaaagtaaggaaaactgcaaacgcccaaacagagacttgaaccctgaaccctcaggttaaaagtctgatgctctaccacctgaactatcctggcactctcttttttttttttttttttttttttttgagatggagtcttgctctgtcacccaggatggagtgcagtggcccagtctcggctcactgaaacctccacctcccaggttcaagcaattctcctgcctcagctcccgagtagctgggattgcaggtgtgcaccaccaccccagctaatttttgtatatattttgtttaagtagagacagggtttcatcatgtcggccgggctggtcttgaactccttgcctcaagtaacccacccgccttggcctcccaaagtgctgggataacaggcatgagccaccacacctggcctccatcccactcttaactcacccatcctacaactttcacacacttctgctttaacctgcacttgtatcacatccattgcatgccctgtccagcccagcccattcagatatgtgaatgcatccatcacacacctcatcaagtatgtgcacatctttgccgaggccttctgcctccctcccacatcacccctttgggtcccagagagctggatccaaggcttcatccatgacctgttcctcataccccctgatagtgaaggaaccttcaactcctgccttctcgtggccctggtggtatgtactgctaggagcagtcgtggccgctgcctgtgtcctcatcttggctctcttccttgtccaccggcgaaagaaggagacccgttatgggtgagttggaaccacatggggaggctgtgtggcctgggatggagaggctggaggcagggaggccagtgaggaggctggtgcaggaggagtgatgactaagaatcagaatgagggcaagggaagccaggcgtggtggctcacgcctgtaatcccagcactttgggaggctgaagcaggtggatcacttgaggtcaggagtttgagaccagcctggccaacatggcgaaaccctgtctctactgaaaaatgcaaaaattagcgggaagtgtaggcacacgcctgtggtcccagctacttgggaggctgaggcacgataatcacttgaacccgggagatggaggctacagtgagctgagatcgcatcactgcactccagcctgggtgacagagtgagatcctgttttcaaaaaaaagaatgagggcaagggggtgtgtggaatgaatggaaggcagaaggtagctgcccaaggcatgctcagcaaatgttagcacagagggcaggcagggcttgaggctgagatggtgcttgctcaactgctggttgagtagggggttccacatggtttttccctgccctcacctactccccctcccccccagagaagtgtttgaaccaacagtggaaagaggtgaactggtagtcaggtaccgcgtgcgcaagtcctacagtcgtcggaccactgaagctacctgtaagtgaaccctatgccccactgccctggcctggatctaaaggctgtagagaatctggcctgctgggcttctgtacatgtgtgagccaaaagtttctaaaggccttgggatactagaatgtcagaaccacagaccctagaaataacagatttgtggaaccacaaagaactttcaaggaatagaatcttagacacagtaaatcttagaaacaccaaggctgggtgtggtggctcatgcctgtaatcctagcgcttcggggggccgaggtgggaggatcacttgagcccaggagttcgagaacagcctgggcagcatggtgaaaccctgtctctacaaaaaaaaaaaattagccaggtatggtggtgtgcccctgtactccctgctactcgggaggctgaggtaggaggatcacctgagcccagggaggtcaaggctgcagtaagccgtgatcacaccactgcactccagcctgggtgacagagcaagaccctgtctcaaaaaagaaaaaaaaataaaagaaagaaaagaaacaccaaacctcagagccattggatcttagaagatgtaatgatgatgataatgatgaagataatgacaagaagaaaatgatgatgatgatgaaataatgttgagattagatggtgatgatgtgataaaaatcacaggcaaccctagcactacctatgtggcaggctctgttctaagcattctacatgtatctcctcgtttaaccctcagagcaacccaaggacacgggtttcttttttctttttttttctttttttttttgagacagagtctcgctctgttgcccaggctggagcacagtggcacaatctcagctcactgcaaccttcacctcccaggttcaagtgattcttatgcctcggcctcccgaatagctgggattacaagtgcatggcaccacatctggctaatttttgcatttttagtaaagatggggttttactaaccctgtctttgttagccaggctggtcttggaactcctggcctcaagtgatcaacctgccttggcctcccaaagtgctgggataacaggcgtgagccaccacgcccagccagaggtgggtttcttatcaccttcacttcacagatgaggaagctgtggcatagagtggttaagtcacttgcccaaggccacacagcttgtaaattggatagctgggatttgaacccaggtacttttgctctgaagtctatactattttttttttttttttgatagaatcttgctctgtcacccaggatggagtgcagtggcttgatcttggctcactgcaacctccgcctcctggattcaagcgactctcctgcttcagcctctcaagtagctgggactacaggcacatgccacaacgcctggctaatttttgtagttttaatagagacaaggtttcaccatattggccaggctggtctcgacctcctgaacccgtgcctcccaaagtgctgggattacaggtgtgagccaccacgcctggcctgaagtctatactctgaactgccacactctactacctcttggaattataaattggtagagagatagaatcgatcttggcctgaaaaattatatgcatgtactctacacccttatacttttgaaatcataaaatcttagaactatagactctccattagaaggctggaaagccatgcaaggtctcagccgaggaggggatctcagaggcccagtcaaatctgttctttcggctgggtgcagtggctcacgcctgtaatctcaacactttgggaggcccaggcgggcagacacttgaggtcaggagttcgagaccagcctggccaacatggcgagaccctgtctctactaaaaatacaaaaattagccagatgtaatctgtaatcccagctacttgggaggctgaggcaggagaatctcttgaacctgggaggcggaggttgcagtgagccgagatcgtgccactgcacttcagcctgggtgatagagcaagacaccgtctcaaaaaaaaaaaaaaaaaaaaggaatctcatctttccagttagggaaactgaaatccagaaagaaaatggaagagctaggtctcttcctagcatacagcgagaaagccgccagggccccagggggatgtttggaaagggctgggaaagacatttatttaagaagagaaggaagaagcaacgatgtcccagtgatttaactgagtaacatacagcatccattctcagggtgtgagcctggtcccctgtggtccctgagacctttgcagggggcccataaggtcaaatctattttcatactattaccaagacattatttgcccttttgctttctcattctctcattagcattcagcgcagttttccagaggctccctgacgtgggatgatgtcatccaacactctgacagctgatggaccttgtgcttgtatattcttgttttaaaaatttatcaggctgggcatagtggcacatgcctgtaatcccaccactttgggaggccaaggtgggcaaattgcttgaggtcaggagtttgagaccagcctgaccaacatggtgaaaccccatttctactaaaatacaaaaattagctgggtgtggtggtgcatgcctgtaatcctagctacttgggaggctgaggaaagagaatcgcttgaacccgggaggcggatgttgcagcaagctgaggttgtaccactggacttcagcctgggcaacagagtgagactgtctcaaaaaaaaaaaaaattaaataaacctgataggttttcttttgaggccaggagtttgaaaccagtgtgggcaacatggcaaaaccccatctctatttaaaaaaaaaaaaagaaacacaaaaatttgccaggtgtggtggtgtacacctataattccagctgctcaggagggtgaggcaggggaatcacttgaacctgggaggcggaagttgcagtgagctgagattatgctactgcactctagcctaggcaacagagcgagactcggtttcaaaaaaaatttttttatttttttagagatggggtctggctatgttgcccaggctgatctccaactccaggcctcaactggtcctccttccttggcctcccaagttgctgggtgaaccactgtgaaccactgtgcccagctagttttatttttgaatacagaaatattgatatatatgtaacataaacaaaagctctttctagtcctcaataattctaacaatgtaaaggtgtcctgatgtcaatttgtttgagaatgattatataacaaagaaaatggataaattacaattacactcaacaactaaattaaaactatttcatagacatcatgttgagtgaaagaagccagacacaaaagagaatatactatgtgattccatttttataatatttcaaaactaatcgattgtaacagaaatcaagaaagtggctaccccaggagggcaggtcatgttctgttcttggcctgagtgctagttacacatttgtgtttgatttgtgaaaatccactgagttggccaggcgtggtggctcacgcttgtaatcccaacactttgggaggccaaggtgggcagatcacctgaggtcgggagttccagaccagcctgaccaacatggagaaaccccgtctctactaaaaatacaaaattagctgggcgtagtggcacatgcctgtacttgggaggctgaggcaggagaatcgcttgaacctgagaggcggaggttgcggtgagccgagattgcgccatcgcactccagcctgggcaacaggaacgaaactccatctcaaaaaaaaaaagaaaagaaaatccactgagttgcttacttatgatttgtgcagattatacttcaataaaaagaaatatttttgtgtgtgtgttttgtttgagatggggtcttgctctgtcacccaggctggggtgcagtggcatgagctcagcttactgcagcctccacccctgggctcaagtgatcctccaacctcagcctcctgagtagctgggactataggcgcgtaccaccacacatggctagcttttgtatttttttgtagagacggggattcgccatgttgcccaggctggttttgaattcctggactcaagtgatccaccggcctctgcctcccaaagtgctgcgattacaggcatgagccactgcatccagcaaaaagaaatatttttattttattttattttattttattttattttattttatttttgagacggagtcttgccctgtcacccaggctggagtgaagtggtgcgatctcagctcattgcaacctctgtctcttgggttcaagtgattttcctgcctcagcctccccagtagctgggactacaggcatgtgccaccacacacggctaatttttgtatttttttgtagagacagagattcgccatgttgcccaggctggtcttgaactcctggactcaagtgatccacctgcctctgcctcccagagtgctgggattacaggcgtaagccactgtgcccagcaaaagaaatatttttaacaactggtacagcagggcactgacccatcagggtgcccactggagcaagagcgtggccaggctttaccccttgagttccctttgagggaaggttcagggggtccagaggaggagctggggtggaagtagaggggtgctcagggcagttgctaattttaaatcagtgcagaagtatgtcagtgtttcaacaatggatctatccctactggtgggtgaatgtcacctgaatgtcagccctgctccatgactctgtccaccccaaccttgcatgcagtgaacagcctgggcatcagtgaagagctgaaggagaagctgcgggatgtgatggtggaccggcacaaggtggccctggggaagactctgggagagggtgagtcccccggcagcatacacacatccttctgaacttctgagatcctgcacttccacactcccacccaactataggaaatacagtccccacgggccctctgaggtcagtgtctccctctggccccccacaggagagtttggagctgtgatggaaggccagctcaaccaggacgactccatcctcaaggtggctgtgaagacgatgaagagtgagttacgtgcacatgtgtaggacccccagctccttccctatgcccctgagacagaagagagcaagcaagttagccatagcttagaacttctggtgtttccagataggcaatggagcccctgccaggtacctcaatagaaggaattgaatatggggagattagtacaaaggtgggagacgggttgaaggaacaactgggggcagggagggaaaccagagatgagcagcagcaggaagtcacttcccccgctaggcctgaagggtagagggagcaagtggtgttaccagaatccacagctagggacaccaggcaggagctggtatcacagagttagaggctgctctgtgggagctaaaaacccagaatagcactttgggaggccgaggcagcagatcgcttgagtccaggagtttgagaccagcctaggcaatatggtgaaaccacatgtctatgaaaaaaaaaataataatagtaacaaaaaattagctgggcatggtggcacacgcctgtagtcccagctacttgggacactgaggtgggagaatcacttgagtctgtgcggcagaggttgcagtcagctatgatcatgccactgcactccaatctgggtgacagagtgagactttgtcttaaaaaaataaaacacacatggctgggcgtggtggctcacgtctgtaatcccagcactttgggaggccaaggcgggtggatcacatgaggtcaggagttcgagactggcctgatctgcatagcgaaaccccacctctactaaaaatacaaaaattagccaggcgtggtggcaggcacctgtaatcccagctactcgggaggctgaggcaggagaatcgcttgaacctcacaggcggagattgcagtgagccgagatcgtgccactgccctccagcctgggcgacagagcaagactccgtctgaaaaaaaaaaaaaattaaaacacacacacgcacacatgggcgacacaaccaccaccaagggaataccagaagcagagagagggtgaaataccctggcttctccctttctccccgctacctgccagtctcccataagggcctacctcccattggcaaatcccaagaggaaaccactaggaaagggagcctgggaaatgtagttttcaggggccggcccactgtgatacatagtggagcaggagaagctctagaatgaggcatacctggctgaatcatttaccagctatgcgatctcaggcaaatgactttccctctctgagcctcccacctgtcatctggaaaaaaggaccctaatgtccccaccttccaaagctgttttgaggcaaagcacttcatgctgagggtggcaagtaggacatgcttgttaatgtggagtaggactatattatttccattatcagagagggcaggagccatttcagggttacacagcacaggaagtccagggctaagttcttcacacacagggaaggagaagcatagggcattcagattggggctggtggtgaatagagaatgatcctttctgaattacagggcttaaaagcttgggctatgaagtcattacccactcattcgttcattatggagcacctcctgtgtaccaggttattttgtttgttttgctctgttttgttttgttttgaggaggagtctcactctgctgtccaggctggagtgcagtggcatgacctcagctaactactacctctgcctcccaggttcaagcgattcttctgcctcagcctcctgagtaactgggactacaggtgtgcgccaccacgcccagctaatttttgtgtttttagtagagacggggtttcaccatgttggccaggatggtctctatctcttgacctcatgatccacctgcctcggcatcccaaagtgctgggattacaggtgtgagccaccacacccagcctacgttttttgttttttgagacagagtcttgctcgttgcccatgctggagagcagtggcaggatcacagctcactgtagtctcaacctctgaggctcaagcgatcctccccactcagcctcccactggttatagtcttggcctgggtctgaatctcagccgtgcaaccttgggcaagtcattttgcctctgtgagccacagtgtcctgaactgttaaatgggatgatacttgtttgggtccccagggcaggtagggaagtgctgggaagcagcctgggcagttgtgagcaggtggaccctggagccagactgcccgggtttgagatctgcctcttccacctccaagctgtgtgttcccttaggcagactcctaacctttttgtgccttgctttcttcatctttaaaatagagataggccagggacagtggctcatgcctgtaatcccagtgctttgggaggccgaggtgggaggatcacttgaggctgggagtttgagaccagcctggacaacatagcaagactccctctcaaaaaattggctgggcatggtggctcacacttgaaatcctagcactttgggaggccaaggcaggcagatcacttgaggtggggagtttgagaccagcctggccaacatggtgaaaccccgtttctactaaaaatacaaaaattagctgggcatggtggtgcatgcctgtaatcccagctactcgggaggctgaggtacgagaatctcttgaactggggaggcagaggttgcagtgagccaagattgcgccattgcactcaagcctgggggacaagggcgaaactccatctcaaaaaaaaaaaaaaaattatccgggatggtggtgcgtgcctgtggtcccagctactcaggaaggcaagcctaggagttcgagcctaacctccagtgagctatgtttgctgtgattgcatccatcctgggtgacagcgcaagaccctgtctcaaaaaataaaaataaaaaacaaaaacaaaaacaaaacaaaacaaaacaaaaaaccaataaaatgggaatgataatagtagcacctgagaagattaaatgagttaatatatataaagttggccaagcgcagtggctgacgcctgtaatcctagcactttgggaggccgaggcgggcagatcgtgaggtcaggagatcgaaaccatcctggctaacaaggtgaaaccccgtctctactaaaaatacaaaaaattagccgggtgtggtggcacacgcctgtagtcccagctactcaggaggctgaggcaggagaattgcttgaacccgagaggcggaggttgcagtgacccgagatcaaaccactgcactccagcctggacaacagagtgagactccatctaaaaaaaaaaaaaaaaagaaaatatatattttatatatatatatatattatatacacacacacagacacacacacatacacatatcacatataaagtgctgagtatggtgcctggtacttactaatcatgtttgatgaagatgagtgatgatgatgatgatgatgatgatggagtggaggtggagggagagtcctccctctcctcccctcctcctcacgacctttctctctccctcaagttgccatctgcacgaggtcagagctggaggatttcctgagtgaagcggtctgcatgaaggaatttgaccatcccaacgtcatgaggctcatcggtgagagaggggcagattcaaggggtctacaagccccatgggggccatagcagagggaagagccctgcttctggccctgggaagatcaaacttccaggcttcctgctccccgctccttcagggtcagcaggcttccccctcctagtctccctcagcttggaatgtgacctctgatcattcccagaaatagctgaggtccccaggagggctccggaaacgtccctgggaactctgctggaaacagcttctctgcagcttggtccttgccactgccactacccccaaacaatatggtggccagattggatgggtagtgagaaggagaggctggaggctggctggtggggggcttggcttccccttctgcccagcaggagtgacagggctacctggggggctcaggtgtctgtttccagggttctgaacgagagagcttcccagcacctgtggtcatcttacctttcatgaaacatggagacctacacagcttcctcctctattcccggctcggggaccagccagtggtaaggggcgtttaatcattcagtctacaaatattaactgagcatctatcaggtacccagtgctgctcagaccctgggaagaccacggtgaccaggagcttgctctcctggagcatttcttccagcaggggaggggcggatgataaacaagctaataaatacctaagcgagatgatttaaatgtttaagtgctaggaaggaaatacagtaggatggaagataaggaggccaggcagtgaatttgggtggacgtggaagatcttgccgaggaggtgaccgtgaaggagttggggctggggagatgtctggagatctgggcaggaagcgaccccaacagagcgcacagcataggcaaaggctcggaggtgggaatgatcatcgtttgtctgaagaccagacaggagtctggtgggagtgtcagtcaagggcaagaacataggcaatcaagtccaagaggaaggctggagcaagtttataggaccttgcaggccatggagaggggttgggttgaattgtcagggccatgggaaaccactgcgggcagagctaggcttgcacagagggatggagggaggagggatcgcatcaaggactctgttgacctctcctcccacctgccttggctccccagtacctgcccactcagatgctagtgaagttcatggcagacatcgccagtggcatggagtatctgagtaccaagagattcatacaccgggacctggcggccaggaactgcatgtgagtgcctttcagggaccccccccccccaactgctcctgcactccctgagggagttccctccctccttcttaggatggaagcagggctagacacccgctgagggcaggtcagaactcaggaccaggaaagtcagtaagggggtctgggaaggcttcctggaggaggtgagtcctgaactgagatctggaaggagcatttggatgcggagagggaagagaccagaaggtgggctcagtgcacagcatgaggtgagcaaaggggctgaggtgaccgatgggggtggggacacgtgagctgcatctctgtcccactccatgctgggtgtcttgcctggggctgccctttggaagcggccacactggataagaaaatcaaactccccaccaatggacaagcagaaaatatgccagatggggtgcagtggctcacgcctgtaatcccagcactttgggagtccgaggcgggtggatcacttgaggccaggagttcgagaccagccttggtgaaaccccctgtctactaaaagtacaaaattcagcctggtgcggtggtgtgcgcctgtaatcccaacacgagaattgcttgaacccaggaggcggaggttgcaatgagccgagatcgcatcactgcactccagcctgggcgacagagcaagactctgtctcaaaaaaaaaaaaaaaaagaaagaaagaaagaaagaaagaaaaaagaaaatagtaacctgtagtcccagccattcccaaggcttaggtgagaggattgcttgagcctcgagaccagcctgggtaacaacaacgagacaccatctcaaaaaaaaagaaaaaaagaaaagaaagaacaaaaaatcccccaaaagccagaatagagggtaaggggagggtagaaggtggagggaatggaaccacagagttagaatattagtcttggccaggcgcagtggctcacatctataatcccagccctttgggaggctgaggcaggaggatcacttgtacccaggagttcaagaccagcctgggcaacatagtgaatcctgtctttacaaaaaataaattagctgggcatggtggtgtatacctgtggttccagctacttgggaggctgaggtggaaggattgctagagcccaggaggttgaggctgaagtcagccatgatggtatcacttcactactgcctgggcaacagggcaagatcccatctaaaaaaaaattgatgtatattttacatacactaaaatatacacatgcagctcagctcgatgaatttttatgggtatagacccatgtaaccactagatgaaggtaaagaatatttcttagccccagcaggctccttcatgcctcttcgtcttcccaatcactaccgccaagtggtacccactatcctgacttctcagtgctagtttagcctgttctgaaaagtcatacaaatgggatcatgcagtttgtactgctttgtgtctggcttctatggctcagcatgatgtttttgagatggatctgtgtaggggtagtttgctctttttctttgctgtgtggtatggtattccatcatatgaatgtcctgtggattttcttttctttttttctctttctttctttttctttcttttctttctttttctctctgtcctttcttctttcttttctttctctttctctctctttatctccttccttccttccttccctccctccctctctctttccctttctttccctttttttctttcttttcttttttgttttgacagagtcttactctgtcctttagggtggggtgcagtggcatgatcatagctcactgtagcctccaactcctggctcaagctatccttctgcctcagcctcctaagtagctggaactacagacatgtgccaccatgtccagctaatttttaaatttttttgtagagacagggtcttgctttgttttccaggctggtcttgaactcctagcctcaagtgatcctcccaccttggcctcccaaggtgctgaaattacaggcttgagccactgtgcctgtttttttttttgtttgtttttgagacggagtctcactcactctgttgcccaggctggagtgcagtggcgtgatctcagctcactgcaacctccgcctactgggttcaactgattctcttgcttcagcctcccaggtagctgggatttcagatgtgcaccaacacacctggctaatttttgtacttttagtagagacagagtttcaccacattggccaggctggtctcaaactcctgacctcaagtgatccacctgccttggcctcccagagtgctgggattacaggcgccagccaccatgcccagccatgttctgtttcttaatctgggtgctggttacatgggtgtgtgtgtgtgtgtgtgtgaaaattcagtgagctgcttacttatgacttgtgcacatttccatatgtacagtatacttcaagaaaaaaaaatttcatcaaggaatcaaacccaaggaaggaccttagaatctagcaaagagccaaaattgggaagtcctgaggaagccctttgtcccatcctcacttgacagagtgaacaagaagtaaagcagttcccttctggactgggatgaaggtttaggagacagatccccacccgcagccaggacagtgaggggaggaggtgcagatgtgtctgagagccagggcaggcttcctggtggaggtgactgatgccctgaccctgttcctttccccaatccaaacaggctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtggtaggtgcactcccgccaagagtggggaaccatgggagggcatggcctgaccatcacacactatgcctgggtggctgtggatgcaagggtcacagggacatgtgggcttccctttgcaggggcttgtccacatgggctgggcatgtcttggggtatggtgggcatctctgaatagtggtgtgtacatgcccaggataaatacaggcccacgtgtgcatggtagcaatgtagacagtttaggttagaagaagctgcagtgattatgcgtgcatgtgcgcacactcatagaatgtggacagccagggtgtgcagagtggcacatgagctcatgtgtccatgaagtgtgtatatgtgtgtgatggtgagcatgtgtatgcatccacaaaagttacttattcatgtgtatacccgtgtcaagtattttttatatatatatatttttctttttttgagatggagtctcgcactgtcacccaggctgcagtgcaatggcatgatctcagctcactgcagactctgcctcccgggttcaagcaattctcctgcctcagtctcccgagtagctgggattacaggcgcccaccaccatgcctagctaatttttgtatttttagtagagacggggtttcactatattggccaggctggtctcaaactcctgacctcaggcagtccgcccacctcagcctcccaaagtgctgggattacaggcatcagccaccgcacccggctaaagtattatgtttctatgaatacttgtgatgctcccagaggatggttgtgaacatgtgtacataagtgtgggtgtacccatgaacctgggtattggtgcgggtgattctgtgcaggagagactgtctaattccctctgcccctcacagtggtccttcggggtgacaatgtgggagattgccacaagaggccaaaccccatatccgggcgtggagaacagcgagatttatgactatctgcgccagggaaatcgcctgaagcagcctgcggactgtctggatggactgtgaggacccttaggtctcccccaacccagaattcattccaaacccctgactacccccagatggccctcacaggtccaggactctctataacccagacagaatccctgagaatgctgagtgacccacttgcccctcaccaatgctctgagtagggccatcactaaccagtggggtgcaaatcagctaaaggcaccctttcctcctttgtctgtgtgggctgaatcagccccctggctccccacccccaagccaggtatccttgggtagtgaataacagcacagtcttacctggcggccctgcctttgggacatgcactcccagagacttctcattccagactcctgagcacaccatgcttccccgacatgctcctcaacacctgagactctctgcaaaacccttcagtttgttttattggccttctccagactcaggtctcctctgagatatttgcaggatccttcagggaatgcttaccaaactttgcaatattggagtatgcggagaaggccgtgacatttagctagcactttgagggtaaagagaggatgactttgggtcaggaggagacagcctggggcgtcagactcctcagtccaccttgggtactccaagagctgagacgagtaaaaataacagctaacattttcatataactgactagaaggcactgttttaggtgcctggcatgtgtcaaatcatttggtccttaccacagccatgtgatgtagataggtatcattatgattcccattctgcagataagaaaacccagtcctacagggagggtaatttatttttatttattgacttgagtctcgctctgtcgcccaggctggagcacaatggctccatctcggctcactgcaacctcccaggttctagcgattctcttgcctcagcctcccaagtagctgggactacaggcgtgtgccaccatgcccagctaattttttttgtatttttagtagagatggggtttcaccaccttagccaggatggtcttgatatcgtgacctcatgatccacccgtcccagcctcccaaagtgctgggattataggcatgagcctccacgcccagtctgggagggtgatttatttgccaaagattgcacagctggtgtgtttgttatctatatccccaaatcaagtagtttaaaacaacaaacgtttattatctcacacaatttctgaaagttggatactgggaacagcttagcagggtgattttggttcaggatctctaatgaagttacaaagatatcactgggggctgcagtcatctgaaggttgggactggaggattgctttcaaggtggcttactcacatggctgtagcaggaggcttcagttcgttgccatgtggacccctttgtggcactgcttgagcttactcacaacatggcaacccaggagaaagtgcgaggaagccacatgccttttatgacctagtctcagaagtcacacacaccatcacttctgccaaatcagaagcaagtcactaagtcctgcccatgctcaagaggagaggatttattctccgtcttttgcagggaggagggtcaaagaatttatggacctattttaaaccagcacagcttgtaagtggcatagccaggctttgatgcaagtctgttctggggagctggaaggtctgttctagcaaaccctcatcagaatactactccatatacagacaggtttcccgagacccttcccagctcctgagtctcccaggacccaactcagaaattcttgggaattcccaaatccccatagatggcctcaaactgctgaggctccctataaccctctaaaatgcccccagtcccctgagtgtcctaaaatgtccccaggcttccagaatgcaccccttctgagtccctgctcaatctcccacccctcattttgctgccctaggtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccactttcccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggcctactttttttttttttttttttttttttttttttgcgatagagtctcactgtgtcacccaggctggagtgcagtggtgcaatctcgcctcactgcaaccttcacctaccgagttcaagtgattttcctgccttggcctcccaagtagctgggattacaggtgtgtgccaccacacccggctaatttttatatttttagtagagacagggtttcaccatgttggccaggctggtctaaaactcctgacctcaagtgatctgcccacctcagcctcccaaagtgctgagattacaggcatgagccactgcactcaaccttaagacctactgttctaaagctctgacattatgtggttttagattttctggttctaacatttttgataaagcctcaaggttttaggttctaaagttctaagattctgattttaggagctaaggctctatgagtctagatgtttattcttctagagttcagagtccttaaaatgtaagattatagattctaaagattctatagttctagacatggaggttctaaggcctaggattctaaaatgtgatgttctaaggctctgagagtctagattctctggctgtaaggctctagatcataaggcttcaaaatgttatcttctcaagttctaagattctaatgatgatcaattatagtttctgaggctttatgataatagattctcttgtataagatcctagatcctaagggtcgaaagctctagaatctgcaattcaaaagttccaagagtctaaagatggagtttctaaggtccggtgttctaagatgtgatattctaagacttactctaagatcttagattctctgtgtctaagattctagatcagatgctccaagattctagatgattaaataagattctaacggtctgttctgtttcaaggcactctagattccattggtccaagattccggatcctaagcatctaagttataagactctcacactcagttgtgactaactagacaccaaagttctaataatttctaatgttggacacctttaggttctttgctgcattctgcctctctaggaccatggttaagagtccaagaatccacatttctaaaatcttatagttctaggcactgtagttctaagactcaaatgttctaagtttctaagattctaaaggtccacaggtctagactattaggtgcaatttcaaggttctaaccctatactgtagtattctttggggtgcccctctccttcttagctatcattgcttcctcctccccaactgtgggggtgtgcccccttcaagcctgtgcaatgcattagggatgcctcctttcccgcaggggatggacgatctcccacctttcgggccatgttgcccccgtgagccaatccctcaccttctgagtacagagtgtggactctggtgcctccagaggggctcaggtcacataaaactttgtatatcaacg

SEQ ID NO: 36224 - DNA, 42848 bp, Homo sapiens; identical to SEQ ID NO: 36223

SEQ ID NO: 36225 - DNA, 17805 bp, Homo sapiens
tttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcaggtcagtgcagtgcagtgcactcagtcttcgaggcgcttagcaaatgtctggttacctgcttctttgcatgtcagcttgcccctctctgaagactttcctgcttcctttctctgtgggtacactctaactgctaaatcacataacaactgaggtctttgcaaaactgtaagttcaagaaattgtgtaaactaagtgcagttacacaactggcttcactagttactagcagatgtgggcaacaaaactcctgagggattttttgtttttaaaagtatgtgtattttataatatcagccattgcaactcttcatgaaagctttctgctaaatgctttgtagttcttttgttttccttttccaaacttttatttgtgcacattcaattgaaaaagataatttttacaggttctttggtgcccattttcagcatacaaaaatgtaaaagactattcacagataaaacacattagctcaaaatggaaaaaaataacaatgacaacaataaaacaacctaaggtagtgcacactgtgacagctctgcttatggggacatgagaattcctgcgaaaataaatagaatgtccttttgtaaaagcagcaatgacatgtcttgtaaacttccttttttatattataacaaggtttggaataaaatccaaagggactggagcttacactgtagccatgaataaataaaagagtctatttcctcaattaccgttggttcagttttccttttgagtccaatgtgcagcaggttttaaaaggtgcacagtaagagattctaaccaattaagtggtgaatgataaaatttctttcctgctttcaaacacaaatgggtaaatctgttccacagcagtagcaacagcctttaaatagggccttgttactgtgatacttcctgtcgaaaaaatctgtaatgtagctcttagagtctttatccaatagcacacagcaggatgaagttcagattcataactcacatgaggtctattgctctttgtgaattctggcaaacagatttctttatttttaaatttttttattttactttaagttctgggatacgtgtacagaacgtgcaggtttgttacataggtatacatgtgccatggtggtttgctgcacccatcaacccatcatctaggttgtaagccccacaggcattaggatttgttctaatgctctccctcccctagcctcccacccccgacaggccccagtgtgtgtgttgccctccctgtgtccatgtgctctcactgttcaactcccacttatgagtgagaacatgcagtgtttggttttctgttcctgtgttagtttgctgagaatgatggcttccagcttcatccatgtctctgcaaaggacatgaattcattctttttaatggctgcatagtattccatggtgtatatgtgccacattttctttatccagtctatcactgatgagcatttgggttggttccaagtctttgctattgtaaatggtgctggaataaacatatgtgtgcatgtgtctttatagtagaatgatttataatcctttgggtatatacccagtaatgggattgctgagtcaaatggtatttctggttccttgaggaattgccacactgtcttccacactggttgaactaatttatactcccaccaacagtgtaaaagcattcctatttctccacatccttccagcatctgttgtttcctgactttttaatgaccaccattctaactggagtgagatggtatctcattatggttttgatttgcatttctctaatgaccagtgatgatgagctttttttcatgtttgttggccacataaatgtcttcttttgagaagtatctgttcatatcttttgcccactttttgatgtggtttttttcttgtcaatttgttttacaagaaacaaattccttgtagattctgcatattagacctttgtcagatgggtagattgcaaaaattttctcccattctgtaggttccctgttcactctgatgatagtttcttctgctgtgcagaagctctttagtttaattagatcccatttgtcaattttgacttttgttgcaattgcttttggtgttttagtcatgaagtctttgcccatgccatcttgaatggtatgcctaggttttcttctggggtttttatgcttttaggttttacgtttaagtctttaatccatcttgagttaatttttgtagaagctgtaaggaaggggcccagtttctgttttctgcatatggctagccagttttcccagcaccatttattaaatagggaatcctttccccattgcttgtttttgtcaggtttgtcaaagatcaggtggttgtagatgtgtagtgttatttctgaggcctctgttctgttccattggtctatgtatctgtttccataccagtaacatgctgttttggtaactgtagccatcttccctgctttgttgttgcaggttggagttacagttcttgactcatgaattcttgagggtgagggtagctgtatcagagctgtgtctgcttctgctcattagtatacctctgggtctagcatgtggttcccaagtagccactaatactaatacttgtggttcactacatacttattgagtgaatgaacagccttcacagatgtggtaggcaccacgaatatgcaggcgacaagggtagagtcaggctcaacccaaagccaggccctaagtcactgaacactcccgttttgtattccagatgtagctagtcctggtgaactttcacatctttgaaatgttttgcttttagttatgtggcattcctgtgttgacaataagtgagaatacaaaggactggcattctgcctattcctggggcacgggcatgtcatgggtaaaatctgtaataaagaagttatcagatagacacagctgttcatgataaaacaattgaaaagcaaactgccaatctctgcctgtggatggtccatgtacaaattgaggtatctttgacagacaaaacaaacaaacagtgctattttaatttatgattttctcgatgaaaacccctggaactatgactgcaaaattgctgaaaataaaccaactcagtttttgacttctaatatatattttaattcattgtatattaaatagtagagaattatgagctgcaaggaacgtcagatcctccccccaccaccacaaccactttttacagacgaggagacaagaaataatgtactcaagttcagacaaggctttggaggctggccgtggggcggctagcacccaggtctgtaggctcttccctccacagtgggatgtccacagggttaacctatctacaccttgtgatgtacactgtgcatgcacagcgcatcctgcagcaccaactctgccagctgactaggaaatgaaaggctaaggatctcagaaaagtataaattgtgcaaaagacatagagtagtaactatttgctagggaaatgtagtttgcatatcctgtggaatgtaagtttggttatcccaatcagtcggaaatttttcttttggaaatggatgaggcagactcttgttttatttgcaactaattatgaaaattatggctactattagatgaccagtaaagtcaggtttattgtaggacacatttagaaaagattttcttttgtaagaaaaaaatattaatgaaactgtaatcatacctttagctttaagtctacacgagagactggaatactgctatgttcaccaatttggagccagaatttcctaacctttcttaactttgcagcataaacagagtaaagctgttactccacacacaagtagctccatcaatttgcttacattacaagttggactaattttaagattgaatcaaccagttctttactcaactgactcatgcaattgtctgtatatataatcaaatttctttttcaattctactataaaaatggaaatttcatataaggcttaagatcttcccacttgcatacatttttcctaattgcatattgacatatgaacacatgtacattaggcatgcagaagaattcattgagagtgctagaaagctaggagaattacagatattgagcaattactgtgtaccagcaactttgaaaagtattgcctggtttcaattctcataacaattctattatgtaagtataattaccccatattacagatgaacaaactaaagctcaggcgaagttaagagatttgttcaagattacaaaactagtaaaaggtaaaacctgattttgaacccaggcatgaaggaggtactcaataaattgaagcacctacttttttttacaatacattttttcaatacaatacaatgctatttttatagtagcgttctaattactgctgaaaagtctcctgaaggtgtcactttcttcatcagaaattttccaaagggaaaataagtttgaatcttctgtgtagactttggaaaagtatattcaacataagtattaatttcttaaaattgaatacaggctccactttgtctggtgaacatttgcagaagatacactctgcaaggattatagggtgtaagggttaaggaaggcttcataacattggattggaccttcacaaatagcctgtagaccagcaaacatgaacaacaaatatgggcttagcccctgaaatctgtgtccctctgagaaagttttatgataaaggaatggcctgtcactgtgacatcatagatggggaggaaaaaggagaagggcttcctctccacggatctccataaatgatcctttatgctatttgcagtttgcagaaaatgattgccagagactaatgtctgggcagcagacagggtcattgctgccatcttgaagtctaccttgctgagtctaccctgctgacctcaagccccatcaaggactggttgaccctggcctagacaaccaccgtgtttgtaacagcaccaagagcagtcaccatggaaatccacttttcagaaccaagggcttctggagctgaagaacaggcacccagtgcaagagctttcttttcagaggcacgcaaatgaaaataatccccacacgctaccttctgcccccaatgcccaagtgtggttagttagagaatatagcctcagcctatgatatgctgcaggaaactcatattttgaagtggaaaggatgggaggaggcgggggagacgtatcgtattaattatcattcttggaataaccacagcacctcacgtcaacccgccatgtgtctagtcaccagcattggccaagttctataggagaaactaccaaaattcatgatgcaagaaacatgtgagggtggagagagtgactggggcttcctctctggatttctattgttcagaaatcaatatttatgcataaaaaggtctagaaagagaaacaccaaaatgacaatgtgatctctagatggtatgattatgggtactttttttcctttttatttttctatattttacaaattttctacagggaatgttataaaaatatccatgctatccatgtataattttcatacagatttaaagaacacagcatttttatatagtcttatgagaaaacaaccatactcaaaattatgcacacacacagtctgatctcacccctgtaaacaagagatatcatccaaaggttaagtaggaggtgagaatatagctgctattagtggttgttttgttttgtttttgtgatttacttatttagtttttggagggttttttttttcttttagaaaagtgttctttacttttccatgcttccctgcttgcctgtgtatcctgaatgtatccaggctttataaactcctgggtaataatgtagctacattaacttgttaacctcccatccacttatacccaggaccttactcaattttccaggttccttccacctcctcctgaaagtatttctggaaaatactcagaagggatcacaggctctagccagcaattggtgctaacctgggctagtccctgtggcacaagctccaccacgaccatccttgtcaaactccacctcagttgataagttgttgcctgctgccattactgcctgatcacaggcagctttcaactctgcaccttgcctctcacagctgaagcctcccatattcagccatttcctgctgagatagcttacagctgatgtgaagtgaaaaggcataccgctccctcctttctgtgttatgcacaccttcttgccccaacaagttacagagacttgtgagcctgcttgttcagtgtaatcaaaccgaagcttggccagagccaactcatactgagtgaactgggacagtgtccagggaaagtttgctcttcctggaaccaccctcgggccttgtggctgatcccagtttctcgtctcttccttcttgatcctttcccacagtttgctagacatgctctcatatttctgaatcatatgtgactgagtgccttccttggaaaggttttgcatctcccaagtcaattcgaggtgcaactggatgtttacaggtggggcaggcaggggcaaggaaatgtacctaagtccatggccagtcatatctcaactcaggaggccccagcttcacctccaactacatatactacgggaatgtttttctcttgtaatttaaaagaggaagaaacaaaataaacatttgtttaaaagtaaatgaatgatctatgtcagggtgtgtggaagaaatttattaactcaagtttgcacctttgcatttgagggaccttggccaaatgtccaagggttacatggctgagtacagaactgtgtgattctagctgggacctctcataaacagttaagatattttgatttaaaatgatattgtctttctataggaaggagtgaatcatcgttcaatttgatcctcccttcaacctttgcagtaccttagttcaaataacagattaaaattgtcattttctcatttatttccctaggtagtcaattcagcagattttttttttttttttgagatggagtctcgctctgttgcccaggctagagtgcaatggcacgatctcagctcactgcaagctccgcctcccgggttcacaccattatcctgcctcagcctcccaaatagctgggactacaggcgcccgccaccacgcccagctaattttttgtatttttttagtagagatggggtttcactgggttagccaggatggtctcgatctcctgactttgtgattcacccgcctcggcctcccagagtgctgggattataggcatgagccaccgcgcctggccaattcagcagattttttcagggaaataacgtctcttccatcccacttgttaaaacaaaacaaaacggaagagaagaaatgagcaaagcaaacaaacaaacaaacaaaacccttctggctttgtttggaccttctgtttcctgtttttctcaattaaacaattatcagcctaaagagttctgggtggtttgggatggggtgtgtgtgggtgtgtgtgtgtgtttataacatcaagcaaggatttgttgatgagggtgaggagctcgttgataatgatctgactattgccattgtttactttcaatcagaacagggagaaaaccttcaaagagtgtttaaggtctctaccaataaatccctagttagtgtaaacatttaatgagacagcattcagatttctagtggcaacatggtccagattttgccagccagaggagtagaaatcagatcagtaactagaatctatttagctagccacagctagaaacagaacatgaccccctcccaaatgacttggctgttttttatttaggatcctaaaatgtaaactgactccactaccgaccttgtatctaggtaggtttccagcttcaaaatgggatacataccatggcagaactggaagagacctcagaatcaccatagtgaaccggctcaaaactataaacagacacaggagaatggaagcaacttgtcaagaaaagcacagctgtttagtaagggaggcagggaaggacactgtgactccagatgcctgaagcacacctgcatcctttccaccatatccagctgcttacttttattctttttttttttttttaaggacaaaggagagcatgcttacttttatttcaaacaggaacttactcaatatgccaaaacttctttaagtctgctatcagtttctgttgtcttaacttccaaatgaacaaaaataaaaagcacttatgcaaaatattgtgttatattccatctcaacccagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaaggtaggtaacctcaccaggtgacctcaccagcaggcggagaaggccagaagaattccttaaagcaaaggaatctttaagataatcaagtctagactcttcattttacaaataagaaaacttaggcccagagtatttaagtaattttccccaaattcatagaactaggaaaatggggcatagcagcaaagggcaggacctggccgactcctggtctagagttcattcctctgccccggacagcctccacatctagtctaaccttttgatctcacattatggaaactgaggcacacacagggtaatgaagagaaggtcacaaagtcataaagaatgtgtggcattgtttttcattcaaaagataaagaagatcaaataatgatattttatattcttcccacattgctgatgtctggaattaaatatttgtttttgtatgcatatagagataaagaaagaggaaaataagaggaaagaaagaggaaaggaagggaagggaagaaagagatactttgagaaattgaaggtggttttttcttaatttacagccaataaataacaaattacaaaaagtatctgtttatggaagttgcttaaacaggacctccagcagagacatgttagttaacagtttattttactaaatgtggcagagtgacagatctaatcaagtttcttctcttaggctcttccttctttataagatggcattaaataatatttgcagccgggtgtagtggctcacgcctgtaatcccagcactttgggaggctgaggcaggcggatcacctgaggtcaggagttgaagaccagcctggccaacatggtgaaaccctgtgtctactaaaaatacaaaaattagcaaagtgtggtggtgtgtgcctgtactcccagctacttgggaggctgagacaggagaactgcttgaacctaagaggcagaagttgcagtgagctgagatcatgccactgcactctagcctgggcaacagagcaagactctatctcaaaaaccaaaaaaaaaaaaaaattgcttctgcctatgtgaaaatatcagatgagaacacagctataaaaatactctgtaaactatgaagtaccacatacaccaccattgtttaaagacgttaactgggggaattcccagggtaggaggagaatgtgttttacacatgtttataagtccattgtttggtgttctgcatctgtttctccatataaatactgttatgttggtggttagggatcaagctgataatcctgagctgttttcacagtagagccctgacacatgtgagatgctatttctatgggaaatgaaactagacttccttctaggagtcctagaaacatacctgttctgtggctgccctggcggcattgctccagacaggggggcccactccacacaagctgtacggaagcagctatgattccaccactgcaaatgacagcaagtgttcagggggcaaggaccaggagactaggaaaagcctgggctggagaaaggtcctgaggaagctgagaaatgaaactcccaagttcccgggataggggcttggggagggtggaggtgcgattgtccagcagggcagagagactgagaactagggtggaaatctggagactgaggagagggctgggtgctgtggacagggagtggggagataagagaaatagtgaggacatttctctttcctgctattcctgccattctccctcccattctcacatcctgctaccaactagaatagcgggaagctgggagagaacacagagggaataggtgagaatgtgggaaaaataattctctttttcttttcaggcacattagttgaacagatttattccagtaaatatcctatgcccatttcatacattatctcatttaatcctcacgacagctctgaataataaatcgttattatcctcttaaatatattttaaaaatagattaataaattgaagtttagatcagttaaataacttgaacagtctcacagagccagtaactgaaacatttgaatgcagggcatctggccatgcttctagtcactctttttattttgcctcccacattgtaggaaagacccttttctttttcctgttgcttccccttctttccttcctttctgttgcagaataagagaaagagagtaagagtgggaaagagagacacacagagagaaatgagaggcagagataagagagaatgctgtggtttcctctcacttccccttcccgtaagtcagtgcccagggaactgattacagtcagtccaccgccaccactccctgcccccattatccggcatcagggcttgcggtggagggagaagcagagagcttctgctttgggctggaagtacagagaaggcaagtttctgacagttgcaacattaactacagtgactgagaaagagggcagtgatgggagaaggtggcaggagggacagagctgaattcagaagccatggatgagccaagtcagggtcttcccatttaatagagaggtttggttttcactctttcttactggttttccccactggttagtacaaaggctgggggaggttactagatatttagcaaagatatgggaagatggtaaaatatctttatgttgagaatggctcagccacattctcagaagtgaaagaatgacacggtgttgtcaggttatacctcgataggctatgtatgtctgtgggcatcctgagagagaggaagtgtgccctgcatcttgaggcttgggtctgtccaataattttaagcccctgggctctgctacccagtgcacttatacacacacacacatgaatgtgcacatacatacaccccacacacagaaagtgacatgacatggctgccacacccatcagccacatttggctgacatcacatggcggatggcttcttcctcctgcactgctccaggtgtggcctttccaagacttcatccagcaacagaacttcccaggcaggggaccatcccttgattgctgtgctgggacagctatctcaatatttatcccagctcccaccccaccccttacagaccctatgcttgaccaacttaaaacttcccagattgataatgcatgtagaaatttcctgttagacatcagcaagatgagccataggcattctatagtcagtttaaatttttagggaaattaacaagctttattcaataatatttgcagatgattttgagaacctctgaggaaaccatttctacagttcaaggtagtatcttttttgttgttattttaattttttactgtcatcttcatgacaggttgtgaatagttctccattctccttctctgtgttctcatccactcatccatcctctgatctgctgctccgtatctcaagccacttgttgattctacttccctctttacattggcagctaggaagctcagaaccaaatctgtggcccatctatggtcagaactttatttcaacttaattttattcttccccatgaattttcctttcaccttaatttcttcacttattagtttctaccttctaatgtgttacaaagaagccatcttaaatcgtttctgggaaattgagagaaataaatgaagtcccttaaagttacccttctttgtttcaggccaccactgggctccaggtctttctttacaaaagcctcctcctccatcatccttttcccaacaatctttctacccacccacgatcctcatcctgcggtctccacctgtggccacaccaccctcttgttcatggtcagcagccttctctcgacccacctctctgtgcactactgttgcccaggctggcttctttagctttccatctggcactccatcgtactttacagctcacgtaattgtcacctcttcagagagggcttccctggacacctttctaagtaaattccctgcactctgttatttttatcacatgtaccttgttcatttcctttcagttatttttttaaatctgttattcttttccaatgcaataaacttcttcatcacttggcacccccattttcctttattaaatatgttttcttaaatataaaggacaggacctgttcctggggtctaagccttctttcttatcatttctccaaaggtgaaagcagtagtgagaatgttgaacactccacctattcagatgaggcataccagattaatggtctacagcagatagatgcatgtactgttttcagtgttggaagaataaaattctttgttattcatcccagtaaggtgaaacacaactctgtataccaagatatatccatggtacctcgatatacatatttgcaggtttcttttttgggaggtgtttgctataaccagttggaaatttcctcttttaaaaatttgctttcaaatctaggctttcctatccatatccttgaaatgaccttaacaaatctgttgcccaggctggagtgcagtggtacgatcatggctcactgcagcctcaacttcctggcctcaaacaatcctcccacctcagcttcccgaatagtaggactacgggcacaggccaacacgcctggctgatttttctattttttatagagacaaggtttcactatgttgcccaggctaatctcaaactctcaggctaagtgatccacccatcttggcctccaaattgtcactttctaattcatattttctgtagaaggctgtaagtcccttgaggacatggtcagtgaaatcagtgattaatatttgtagccctctggggtgtagtgccttaccctagcactgtctgtttgatgaaagaatataatttacttacaaccaatgtaagcacacttgggaagtttgaactgattcttttagagaaagtcatttgttacatttcttttttttttttttttttttgacggagtcttgctctgttgcccaggctggagtgcaatggtgagatctctgctcactgcaagctccgcctcctggattcacaccattctcctgcctcagcctcctgagtagttgggactataggtgcctgccaccatgcccagctaatttttttgtatttttagtagagatggggtttcaccgtgttagccaggatagtctcaatctcctgaccatctgtttgttggtaccactctgtttatttctgtatgtaattcaaggtggaaatttgccaatacgtagttatttgcacaatttaactcagcaggattattacacagctacagctatttctttatttatatttttggaaaagggatagaatcttcactttgttgtatcttcactttgtttctctttggaccctacccgtgagacactaataaattataatccatgttactgcttattctttccgtgtaaagtacttttcaagttgatcataagctgaggtaggttgatcataatatcaaaatgttatttttatgaaaactcatagaatcaactttggaagcccagtatgcttacgatggctgattgacaacacctatgaagagcaaggtattggagaactagtttggcaagtgttgatgaccctttatcatttctcttttagaaaagcaacaaaatatttctcccctagtgagagaaagaggtcctcagagagtagcagctcacataactgggaccagaggaagaagcaacacattgtcttctccaagtaagagaaacaacaaataagtgacttaagggaaaataatggaaggattgtgccaagtaacttattttttaaagaattttatctgaaatgtttatatggctatctacaaaatgctcagtattaatcagatctcagattgactgttttcagatgcaagattacagacaaacagctcaattattgccacgacataactggcctcaggaaaattacaaagtgggagaattttgtctttgcagttttcaggatcccattttttttccttctttagagtaatttctcgctctttctttctttctttttctttctttctttcctttttttttttagacagagtttcacgtttgttgcccaggctggagtgcaatggcaccatctcggctcactgcaacctccgcctccagtgttcaagcaattctcctgcctcagcctcccaagtagctgggattacaggcacgcagctccacgcctggctaattttgtatttttagtagagatgggatttctccatgttggtcaggctggtctcgaactcccgacctcaggtgatccgcccacctcggcctcccaaagtgctgggattacaggtgtgagccactgcacccagcctttctctcttatgattacttcttccatccctctgcacttctcttctttgctcgccatcaaatctcccttctctttaaaggttctaaatcatttactatccctatgaatcactaggtgctcctagtggcatttacattaaattaaaccacaggagattgccaatatttgaccatattttacttacacaaatgtcagtttcatatagtttaaccatatatgttacatctaatttatatataggcagaacatgtgtcgatatgttgctatgtaatactgtgcatgggtatttttttgttttttttttgtttttttgagacggagtttcacttttgtcgcccaggctggagtgcaatggtgccatctcggctcactgcaacctttgcctcccaggttcaagcgattctcctgcctcagcttcccgagtagctgggattacaagcatgcaccactacacgaggctggtctcaaactcttgacctcagctgatccacacccccccggcctcccaaagtgctggaattacaggcgtgagccaccacaccaggcctctgtgcatgggtcttatagtgtaaatatctaggttggaatcacagctcctcttcacctagatgcatgttttgagctaattacttaacctagtcaagcttcagtttcttcatatgcaaagatgagacaaatcttaacccacaaaatgatgcaaaatgtctggtctattgtatgtcctcaagaaatactcacctttatttttgtcagaggctttatcccgtaaatttgtctaaaaatatttcagacatcagttaatagataaaaagtttgtttgggggtttggggttggttggttggtttagtttcttctgggtagttgccttcttgacattcttggactcatgttttataaatgattgtcatgttctgcctacaagtgaggggattattatgatgttactgcttgctactcatcaataaatataactggtttacgctctggaaaagcccaattttgcaccaatcgtggagataggctaaaagtgtaaatgaatatcattttggaaggttcatttttcattcaaaacctttgagtgtgaaagattcaaggatctgaggatctttaaatctaggctcctttgccaactttgtgcctctattatttttggctagagacgccatctgcttggatgtgcctttgactctggagagctgagaaagatcaaggggggacccaaagagtccaaaaggaatggcaagaacttctgagatttaggcctaaagaaatagatacgtttatttcggtttccttctggattgtccacttaagttcaccagcacaagacgggaggaacagattcagggcagaagttctgcccaggagaaaccattgctatctgagtgggccatcccttgtgctaccattctaagtgtgacacatgtggcataagcagctgacaaggtataaaaagacaagggactcccaacagttcccaatgtcacaatgatgcaggaacctcccaatttctatgtgactagaatttataatccacattaagattgaaggaggaagaagtttgatattagattgaaatccctggcaagcccaacaaaaatataggctggccacagctgcaaaaaagctccttgctttgctacaaattcccttctgttaacgctctttctctctaaatttcctacagactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagtttttttggggcctttttagttggctaactgacctggaaagaaaaagcaataacctcaaagtgactattcagttttcaggatgatacactatgaagatgtttcaaaaaatctgaccaaaacaaacaaacagaaaacagaaaacaaaaaaacctctatgcaatctgagtagagcagccacaaccaaaaaattctacaacacacactgttctgaaagtgactcacttatcccaagagaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagagcaacaatccatctctcaagtagtgtatcacagtagtagcctccaggtttccttaagggacaacatccttaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtacaaaaattagctgggtgtgttggcacatgcctgtagtcccagctacttgagaggctgaggcaagagaattgtttgaacccgggaggcagaggttgcagtgtggtgagatcatgccactacactccagcctggcgacagagcgagacttggtttcaaaaaaaaaaaaaaaaaaaacttcagtaagtacgtgttatttttttcaataaaattctattacagtatgtc

SEQ ID NO: 36226 - DNA, 22213 bp, Homo sapiens
tcacttccggcgtgcctacgcctcctcttgcgctgtcctgttaatggcgggcagtagccgctgaggggattgcagataaccgcttcccgcacggggaaagtctaccctgcctgccactttctgctcgccgtcagcgccggagctcgccagcatgtctgtggtaccgcccaatcgctcgcagaccggctggccccggggggtcactcagttcggcaacaagtacatccagcagacgaagcccctcaccctggagcgcaccatcaacctgtaagtgcggcgcggccttggcgggcatttctctcgtgaaagctcctatagactctccgacgcgcccccggcttttcggcgcgcttcacgcctctgcacctccccgcctccaactcccgctggcggatgcgcgccttcctccctctctcaggcccctttctcatcctccagcctccagggttagagtccttttctgaaaggaaggcttgttcccatcctatgtattcggtcataatggggaaaaacggagtttgcttttaactcatcctttccccacctctccagaggtaaccgacttcaaaatgtgtgtttttttaatccttccagtgaattgtttatgctttcgcatcacgtacatggtattgctttgtgagtgttgatgtgatacgaatggtataacctagtatcatttttgcagatttcactctgacagtaaggtttcgagatctagctgtaatgcctaggtctagttttcttccttttaggtgccacttaatacttcagtttttgaatacaacacattttattcatgtgctcagggctgtctgccctgccccatgccttatgccttcgcgtcgtctgatgtctcaatgccggcatcccaggcaccacaagtaggcccctccttgggagtaaggatgctgctatggttgggctttcagactggagggaaccagaatgtttgtaccagaaaacccattgtgggctgtgttttattttcaacacctttctgtttcaacacttcaaaccattgcatttcaaggtcattctcagaagcagactcgctgtagcaggtaattggcgtttggggtgtcttaatcaagaaattgtcagtaatgctttttaaaatcgtttctgaggatttgttttcgaggcaacgcggtgcctccattttatgccaggatggaggaaagtggccagtttatgccagtcagggtacaagtgcaaggatttggtggtattgatgttttcgtaaggcagtttaggtgtttctctgtttcatattaaaataaacggacattgtctccccgtcccccaaccaaaagtgatttgaagttgaaaagatggttaacattgttttattttgcaaaacgtgttggcttggaaatttagataatggaaatgctgggtttataaaatctggaattagttgatagttgtgtgtataaaagttctcaggagtggcggctcacgactgtactcccagcaccttgggaggctgaggtgggaggatcacttgaggccaggagttggagatcagtctgggcaacataggctgtctctacaaaaatttttttaaaaattaagaaaaaatccatcaaatggtaaaggcaaatgttatcctttttaaaagtgtgaaagcacagcttctggattactttcggtggttattagaactaaaacccacagtcttttcttgttttgtcttgattactgaattaatttgcatccaaccattttgtagaattggcaaaatagttagctttcagtaagatattttaatcttcgctctattaaaattatgggttgatttacagtacatttcctctcctgtgtaaatacaaatattcagaaataataattgtgttgtgaacttaagttcacctgagttaacattaagttgaaaacaaatgccctctcccccagtatattttattttaggaaatattgcatgaatgcctactttgtaccaggcactgtgcacaatactggatatacagtggtgaggaagtaaggtgtagcccctgctttatgaagctcacagtatgatgagaacaatatgtatgtctgggctggcactctgatttcacaggtgaaaattctgacatttcatcttcacatctccttactgatatattggagctggctcttgcaacagagatgtgtaatggctatccttaattctttctaactcaggttgtcagaattaaatgttaatatatgtaaagcgttttaaaaaattgcttggcacgtcgttctatgtagcatatctgctgctgctatggatgatggttttagatttagcattggatctaccggggatgttctttaaatttttaaagcatcctggaatggtatattttaattattttagagctttttcatatgcctagaacttggcttctggaattaaagtaatttttaaagttttggcaaccttgattttttcccctttcaagaatggctgagtggggtagatacaataatgttgactattaatgtcaagggcttttggtagaatagataccttggatgggcaaatgtggcctaaattcgtactcaaaggcttcttgctgtaaggctttaattaagggcttacaacatataagtatggattttttaactatctttaaagaaaaatttgatccttattaggcaagatgaaaactgtctttaacagtttgagccatattttaaattattggtaaaggaagagagttttcgattagatatggtgggtagaagattcagatgaggagaaggaaacaataaggagactgaatagaataaatgccaaaggctagtaaataggtttagaggacaaaaagagaaagtagaagagttgctgtgaaaaggaaaggctgtggtgcaagaaaaatctgaggatagttgactgagagaaatagaaaataactggagggatgttgatgaaaaacggtggcttagttttaggaaaaagaaattagccattagcacccataattaaaactttctgattagattagtagtcagtggaatgcagggggacattaattattagccaaattggtaatgttgaaatagcagccatggtataaaaccagaggattactaatgttcagataaccatttctctaagcatttaaggatagtgttatctacacttgaaagttaaagtatggaggagcagcttgatctaatggaagctctggctttaagagtccagagagcaagattccagtctctgctgtttcattaactttagttaactgtacaaatcctgtgtctgagtacaatatatgcactttttttgtaccatggtttctttatgctaatgtctgtcatggtaaattacattcttcagttctcatgttagatgtttgtcttcggatcacaggtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactgtaagtagtgttggaaattaacagcaagacagtttttagtaggattgctgtttatgcagctctggaatacaattttagccctcggtcattcatttcaacaaacactgctgttaatgatgtctttagaaagagaaaatcatgagtaatttttctccattgcagtgctcatttattttcctaactagtaatctgtatgtttctgtatgttgttgatgttaatgattgagcttggtagaaaccccatggaatagttgagtccaagatcaatgtctagatgtcattgtagcattaccaagaacaattgatatttctttcttggtatgattagcatttcctgttcttaagatgacttaggtttttgtggataacagtttagtgttttatcatttaagctcctacatctctcaaacatttgatccgtaactatttgactagattataccaaaaagaaaagtctccaatacttagatgacgttcttgaaaaagtttcccattctttaggcctaaagaatgtgatccattcctctctgagcatttctagactccattatcatcagatagctcccagagaggagattgggatggactggtggttagcaattttgtttatgtttgtgctatgttatatattctgtttgtttaaaactagggtttatgtgatgggtacatatggacataaagttggaaaaaataaacactgtatactccaaaggtggggagggtgagggggaggcgagggttgaaatacttcctattggatgttatgttcactgtttcagtgatgggttcactagaagcctaaaccttagcattacacaatatacctatgtaacaaacttgtacatgtacccgttgaatctacaataaaataaaaataaatatatacgaagaggaaaaaaacctagggtttgtatactgttagtctggggaattgacatgaattcaagcatattctcccccttcactttgatacttgttttgattgccttattatgctgaaatatgttcttagtgacttggtagaaataacaattattgtgttatttgttatctccaaattgtattaagttgaaagctgaaattcttaacttttatacagacctggtggtgaacttaacccaggagaagatgaagttgaaggactaaaacgcttaatgacagaggtatttttctgtttaaccactttgaataccatcaacttactagttatttggcttttaatgtcttgtaaaaaggatgcttattttggaatatttagttttcaataaatacaacttaaactccagaaggttagtacaatgttgatttttttttacaagttgaagttacacttatttcaatttttaaaatgttaaactgtgtcacagcaatggtaaattaaaactgacatttaagtattactgtgctagacactgttctgagtgctttacatgcgctaattcctttaatcaccaccacaactgtaggaagtagatattattaagtttaaattacttcttgttatatagctagtgtgttgtagagccagaggtttgaatgcaggtagttttgttcaagagtaggcctctatagaattttgaaaagagaaagatgcctgtgttttcacttttttcacatattttttagactttgcccaaattattctactttttaaaaatcattgtaatgcctgcatgtaaagacttggggccaaatgcatagatactgaggattttgagattgtaaattgttttcaatgttagttttcttctttaacattcaattgccgcctgcccctgttacaaagctcatatattctctgtgcaaaaagcttggcaaacacagaaaagcaaaggagaaacaaaactaaagtcacccgtaattctcccacttttgacctattggtttgtctttctagtatttctaaaaatgtattataactcttaaacattttcctgtgcttggacttccatttatataatgtatggtacaaagatataagtccattaaggttgagggagtgcaaaatgagagaatcacaaaagcaaaatttttggaaactggaaaacagatgggcaaattataactaacttagcagaaaccttagtccagcagacaggcaggcagaatctagcattgcagagtaccagaatgactgaggaactgaaggtgctaggtacttatgaaagtgggggcatgcatgggctgaaaactggactggttcaaagtatatatggagtatatttatacaggttgtgtattccttatctgagagcttgggaccagaagtgtttagctgctatttgatagcacaacagggtgactatagtcaataatcacttaattgtaaatttaaaaataactaaaagagtataattggattgtttgtagcacaaaggataaatgcttgagggggtggatatcccattctccatgatgtgaatattacgcattgcatgcctgtatcaaaacatcttgtgtactcaaaaaaattaaaaattaaaaaagtggttaggatttgggatttttttcaggttttggaatatttgcattatacttaccagttaagcatcccatatacaaaacttgaaatgctccaatgagcatttcctttttttttttcttgagacgaagtctctctcttgtcacccaggctggagtgcaatggtgcaatcttgtctcactgtcacctccgcctcccgggtttaagcgattctccggcctcagcctcccgagtagatgggattaaaggtgcctgcctccacgcccagctaatttttgtatttttagtagagacagggtttcaccatgttgaccaggctggtctagaactcctaacctcaggtgatctgcctgtcttggccttccaaagtgctgggattacaggcatgagccaccacgcccggcctgagcatgtcctgtgagcatcatgtcagtgctcaaaaagtttgagattttggagtttcagattgggatgttcaacctgtgtatctagattgtcttccccactctgtaattaggcaaagactggctgatgattctctgtagtaattgaatcagagaacaactagcaatgaaaaaagtttaggggatggggagaataagagttcctattctgaatagtcagactcttggacctctattaggctgacagaatgttaacaattaggcttgtttttttttttttttgtttttgtttttttttttttgaggcggagtttcactcttgtcgcccaggctggagtgcagtggcgtgatctccaatgtgagcaatggttgctcactgcaacctctgcctcctgggttcaagcgattctcctgcctcagcctccagagtagctgggattacaggtgcccactaccatgcccagctaatttttatatttttagtagagatggggtttcaccgtgtcggccaggttggtctcgaactcctgacctcaggtgatctgcctgctttggcctcccaaagtgttgggattacaggtgtgagccactgtcagtctaggcttacttattttttttagagacagggtctcactctgttcctcaggctggaggatggtggtgtgatcatagctcactgtaaccacaaactcctgggctcaagcaatcttcctgcctcagcttcctgagtagctaggactgcaggtatgtgcccatgatgcctggctaattaaagaaaagttttttatagagatgagatcgtgctatgttgcccaggctggtctcaaactcctggcctgaagcagtcctcccaaagcattgggattacatgcatgagccaccaggcccagccaacaattagatttatatatcccaggctgagggttggaattcttgtttctggaaaaagtgaccagtccaagaaaaacttcagatactgccatttgggagctgtcttcgtctgtttaatgttgctataacagaatacctgaggctgggtaatttataaagaaaaagatttatttggctcaccagttctggtggcaagattgggcagctggtgagggcttcatggtgcttccactcatggcagaaagcaaaatgggagtgggcatgtgcaaagagacatggcaagggaggaagcaagagtgaatccaggaagccacactctttaacaaccctctctccagggaactaatccattcctgatggaggaagggtattaaactattcatgaaggatccacctgcatgactcaaacaccttccactaggccctgcctgccaacactgtcacattggggatcaaatttcaacatgagtttgggggcagggagacaaaccatatccaaaccaaagcaagaattttctatagaaataatgtagtcctgggccaggcgcggtggctcacacctgtaatcccagcacttggggaggccaaggcgggtggatcatgaggtctggagtttgagaccagcctgaccagcatggtgaaaccccgtctctacaaacataaacaaattagctgggcgtggtggcgggtgcctgtaatcccagctactcgggaggctgaggcaggagaatcagttgaacccaggaggtggaggttgcagtgagccaagatcatgccactgcacgccagcctgggcaacagagcaagacttcgtctcaaaaaaaaaaaagaaaaaaaaatattgtagtcctatcactcatgcacacagaggtgacaattaagcatcttgttgcttctcccttgtgagtacacaaccaactatcaccaggcttttggagaaaacttcttaacaagaaaaagatcaaaagaagcaaaaggacctcaacagaagcagaaaattcaaccattgacaaaactatgattaatattcttggtgagatgagaggagattttgcacctgtgaaacagtgctattaaaaagacattttagccaagaaaaacctcatggatattaaaaaaatgttggaagaaatgaaaaattcagtaaagagttaagaggttcattctaccagaaaatagaatgaaaagataaaaagatagaatgtaggtaagaatagataaaattagtgggtcattctagaaggaccaatataaactatagataaatagaacagagtaaaaggaagaattagcaaagcataattagagaaaatttctcaaacctcaaagggcatgagttttgagattgagaagacctactggccttgcctctatagtgaatgtttaaagatccacgcaaaggcatatcatcatgacgttttagatcctacaaacgaaaataaaaacaaaaagatgtaaaagcttccaaagtgggaggtggaggattggtaagcagagaggttaaatgcaaaacatcaaaatcagaaattgcattaaactacccagaaataattctggaagctaagggatggtggagtgttgtctttgtaattttgagagaatataatctctgtcctagaattttctaatcaaactataaatcaagtgtgtgggtaaaagttacttctagacatgcagagtttcaaaaagttacatctcttgtaccttttctcaggaagctactagagggtgttcacccccaaaatggaataaaataaggactccagctgtgaagcagggttgagactatcaagtacagattacagcaggatgatagaaaaacgtgtcttaggctgggtgtggtggctcatgcctgcaatttcagcactttgggaggctgagatgggcagatcacgtgagcctaggagtttgagaccacccttggcaacatggtgaaaaattagcctggtgctgtggcttgcatctgtagtcccagctactcgggaggctgggggcaggggaggctgaggtgagagaagcgcttgaacccatgaggtggaggttgcagtgagtggagatcgcgccattgcgctccagcctgggtgacagatcttgtcttgaaaaaaggaaaaacatgtcttagaaaagatgaaattaatagaataactgacaattgatatttgaattgggaagaaatttaagttatcatggagaatgtgggaaatgaatttagtgatagcaaaggaaatgaaagttattaactaaagaataggacagttgaacaagtaaggagatacggtttgctaatcattgctctgttgtgactgatctaccggatcatactaacttaaatactgaatattgacttaaccaaatattgataatgggaagatggtggaagaaaaagtgtaactaggatgtgtgattttaatatctaaattctcattcatagtagagggttataggcttttaaaaaatgtttttaaaatgaaaatcaagaggccaggcgcagtggctcacgccagtaatcccagcactttgggaggccgaggcaggtggatcacaaggtcaaaagatcgagaccatcctggccaacatggtgaaaccctgtctctactaaaaatacaaaaaagctgggtgtggtggcgggcacctgtggtcccagctactcgggaggctgaggcaggggagtcgcttggacctgggtggtggaggttgcagtgagccaagattgcggcactgcactccagcctgggcaacagagcgagactctgtctcaaaaaaataaaataaaataaaatgaaaatcaagaaactgtcataaaagaatattttggctgggcatggtggctcacacctgtaatcccagtgctttgtggggctgaggccggaagattgcttgaggccaggagttgtagtgagccatgattgcgtcgctgtgctccagcctgagtgacagagcaagaccctatctcttaaaaaatgtagttttgaggcccggtgcagtggctcatgcctgtaagcccagcactttgggagagtgaggtgggcagatcatctgaggtcaggagttcgagaccagcctgaccaacagggtgaaaccccatctctactaaaaagacaaaaaattagctgggcatggtagcatgtgcctgtaatcccacctactccggaggctgagacaggagaatcacttgaacctgggaggtggaggttgcagtgagccgatattgcgccattgcactccagcctgggcaatgagcaaaactccgtctcaaaaaaaaattttttttttgaaaaatatgactttacattgaagaaacgtgataaacagtacctcagcccattagtgataagccatattgatatagcatgtacctttgatatgacgtgatgagaatggcccttttacctctgtagttttcttcccaaaagctcataacttcaatttaattgagggatgttttacaaaatacttgaccagtattcctcaaagctatcaagatcatcaaacacaaggaaggtatgaaaagctgtcacaatgtagaggaacctcggaagaaatgaagattaagtgtaatatggtatcttagatgggatcctgggactgaaaaatgaaaaaggacattaggttaaagactatggatatctgaataatatatggacttcagttaataatcttgtcttggtattggttgattagtttgacaaatgtgctttactagtgtgagatgttaacagtcggggaaactgtgtggggtatatgagaagtctctgaacaagttttgcaagttttctgtaaatctaaaactatcctaaaataaaccgtttatttaagaccaagaagaatgcttttaaaaatagaagaaaacatgaggggaaaaacaaccaagagttgaaagttacagccagtgggaatgggtgaagcaggacagagaactgcagtttctcaccatgaacattgtagaactatttttggccacttaaaatatgtagagtatgactttggttaaaataagtttagtgttctgctatacaaattaataaaaatgaaagctgaattttgaacacaatttttatgttgatactagcttgccagttttgaactaatattgtatgtcttgggcagagtgacatctatattaacaaatcatagaaaatctgtatggaaggcatattatccctatgtttcaattaggagcactgctaagaattttctgttcactgaagaaggggatttgtgagtacatatatttagttgtttactggcttatttctttttgacagatactgggtcgtcaggatggagttttgcaagactgggtcattgacgattgcattggtaactggtggagaccaaattttgaacctcctcaggtcagtgttcagttacatttgctgggcattttggaagcagaaagctcgtttaattctagccactttaaaaaagattaaagtagaatttgacttgaaattttcttttcttccctccttaatttaaattacaaaattaagccaagcacttcttattttaaaggaaaatgtaaaacaaatacaaggccgggcgaggtggctcatgcctgtaatcccagcacttcaggaggccgaggcgggtggatcacctgttgaggtcaggagtttgagaccagcctggccaacatggtgaaagctcgtctctactaaaaaatgtaaaaatcagctgggtttgatggtacaagcctgtaatcccagctactccggaggctgaggcaggagaattgcttgaacctgggaggcagaagttgcagtgaaccgagattgtgccattgcactccagcctggacaacagtgagactccttctcaaaaaataaataaataaatagaacaaatacaaaagaagagagaatggtaaaagtgaatgaattgcgctacccgtcgtctgcctttaacagttagcacatcacaacccctcattccaccgcttcattctcctaccctcatcttggattattttgaagtgtatcctagctattcatttcaattgtaaatatttcagtgtgaatcataaaaataaggatctctttaaaaagataactatagtactgttattatcatactaaaaataaacaattccatattattgtcaaatatatagtcactgttcgcgtatcctgattatttctattttctttttataatttgtttggattaggatagtctctaaagtctcttttacacacttggcaccttttttttttccttgtgttttatttgttaatgaaaacaggctaatgtttccatttcgattgcattcccctgttgttgttgaatatgtagctgtttcccctgtgtgtcttgcaaattgatagttagatctagaaattgtattcaggctcagttaatttggggaggggtaacaaggcttgtcataggcggtatataatctatacctgcataacaaattacctcaaaatttagcagcctttaggcctctgggagttgcttagggtggttctggcttaggctctgtcatgaagttacagtcaagttgtcagctgggactgcatcataaggtggaactggggttaaagtatctgatcccgagcttacacgtgtgtgtgttagcaaacttcttagtttcatctgggctgttagactaaagctttgcttcaggtgttgctggctgttgtctcaaggtctccctcagttccttgccatgagaacatctctaaaaggacaactctcaggcagctggcttacccaaggctgtgtgatccaagagatagtgagagacagagtgctagaggagtgcccaagtaggaagcctcagtctgtgataacctaatcttggcagtggcataccatcacttctgctgtgtgctattggtcacacaagccaaccctggtacgctataggagggactacacaaagcagtgaataccaggagacaggaatcattgggggtcatcttaaggcagtctatcacaattggtatagtgtacttccatcaggaatttaaaaatatttggttgtttcttgttgtaatgttagcagctcattgatgatcatttcctggtctatgaattcataagggttgtgatcctcatataaaaagaaacttatgtattactgaagtgtgtggtttgtgtagaaaaaaaaaatatgctgctattcctttacttaacatttttcagaagaatgacttaattccttagcatcctctaaagacttgactttattcaaaagagagggtaagaccaagacttgggtacaggcagtttgagaggtgattccaggaagcagcagaatacaggggagagagagaccagaagcagcagaagtaagacagggcatgttattgatctttttacacctgtgggcaactggatttgttctgttaaggaccaggaaccatgtagggactcctataccccattggataagggttgcatgaactcccttgcatttccatgttgagtcttgagtgcttgttgagacagtggcagcaaacagggaaccctctgatacttttcaaacatagctgccccgaaatcagaggtagcgtaatgtggggcacacacacacaaaaagcatgtttcagtgacctttaaagtgtcagtatgaccttttggatttaaataatttgaaatattttaatccatgataatgagtgatgatgttactgatgctcaaatattcctatttttgctaatggtggaacttcttaaagttggatcctgaattctttaggcaaattaaaaagccctatgactttatagctcctttacatgacaagatgtttcaggtcaagcattgcacaaaatatcaaccaagcaaaagatcgttcttttctcttgcttctgactcccttgtatggcagagggacaagaagataggggctgtggaagctgatgctggtgttcactacctaagaattgccaggaacacatcttggctttaaggaagaacaatttcatatggaaacagtgaagttacttgttcaaagatacatagtacagttattctaaacttttttttggcttcctgaacatgccttgatctaattggaaaatgcttagtagtgaccccagtggttttccagataacttttctgaatatcttcactcatctcccctaccactgtcctaggacagttctcttcattcagtaaggcctagagttggccctggtggtatttgacataaggtaagtgtattgatttatttaggaagcctagagtattagttagatgtcagtggaaaaggagcatatcatcttcctatctcagtctttttgtataaagtacagtcaacttaaacattaagaccagagaagaaaggcttaaaaaaataggaacatgtagccttgagcagaagaaatttggggaaatgctactcattttgtttgatcatggtttgggaacttttattgtatgtgatccacagatctcttagcttgtgctattcaggccactttctctgtgactgttaatgtatctggttttcatgacagtttaaggaacctccaaagcctgggacaattgcctcaattcattgtaccctagggatggctctgatatataattattctaactggaatactggttaggtgccaatgagtaacacagtgggaaataacataggcttttataattagataagagttgaatagatacagttaaatcttggcttcacaacttggctgagtaatcttgggaaagatacttagcctctcttagcatgtgattctgtgtaaattgaggatgatgctaatacctccttttggcagcttctgcttttatctcactttccccttatatctgttttcagcaattttaaattccccagctctcagatacaactccaacagcaaaagtagatttctgaatgtattgtggagagatttatacaagaattgtataacccttagactttttttttgttctgtgtcagaatttttccttcccgggtagcaacttccctctctaattctcttcatccctttaaattctctaaaatatacatatatattatatatatatttttatatttgtttcctcgagtaatttggctttgcccatctggcaaaacttcacttagactgctcttctggtattcctgaagcatgcaccttggcatacggggaggtttgaggttggggctggaaggaggagcaagaagcatcttgtcaaatgcctcacagcttatatttgaatttttaatgtaaacaggtctacaacaggattctagactgtttaacttactgatcatatatatatatatatatatatatatatatatatatatataatttttttttttttttgggagacagagtctcactctgttgcccaggctggagtgcagtggcatagtctcggctcactgcaagctctgcctcccaggttcacgccattctcctgcctcagcctcccgagtagctgggactacaggcgcccgccaccacgcctggctaattttttgtatttttagtagagacgggatttcactgtgctagccaggatggtcttgatctcctgacctcatgatccgcctgccttggcctcccaaagtgctgcgattacaggcgtgagccactgtgcccagcctatatatatatttttaaaaaaccagcttttaggctgggcatggtggctgatgcctgtaatcccagcactttgggaggccagagcaggtggatcacctgaggtcgggagttcaagactagcctggagaaaccctgcctctactaaaaatacaaaattagccaggcatggtggcgcatgcctgtaatctcagctactcaggaggctgaggcaggagaatcacttgaacctgggaggcagaggttgtggtgagccgagattgcgccattgcactccagcctaggcaacaagagcaaaactctgtcttaaaaaacaaacaaacaaaaaaaagcttttattaaagatactaattaaaatcggacttcattatgttttaagtatctcaagctataaatcctgtgactacatattttatctcgaatggttgactggtttactgcttgttattttatatgcattaaagcatttatttactagtgtatctgttagataagtcctggtaaagaggacagaaagtagtatgcttctcccaacagtttatactatactggggagtaaacatgtaaagaaatgaagccatggaatacatattaaagttgtattcatttgtaatttcagtatccatatattcctgcacatattacaaagcctaaggaacataagaagttgtttctggttcagcttcaagaaaaaggtaagttattttgttttcaaaggtagccatctaaaaattctgtagaataatttcaaggatacctctatttgtgttttctcaaagttccttgaacttttgggtttgttgtaaaactaaagatgtataccatgcttttagtttcaaatctgtggctaggaaatctaccttgaaagacacaaccaaaatgtattaatgagaattatcttttttcttacactttttattaaatgtaaaattggtaatttaaaaatgaaatggaagcagtgattatataataacttataataatgaattctgttttattttagccttgtttgcagtccctaaaaattacaagctggtagctgcaccattgtttgaattgtatgacaatgcaccaggatatggacccatcatttctagtctccctcagctgttgagcaggtacagaaagttgaacattttttggttcatccatattaactgtcaaatttaaaatattctgagccacttgggaaggtatagttcatgaattttggtctttaaggaaactaagaaagtagatagactcttagatcatgtgcaagccatagattaattgtgactaataccatccccagactcttaagtttcggcatgacattctggtatttgtgcaactgctcttccctaattctgatattctcaagagttaaggttgatgtctttattcaaaaaagagatggttaaatagcagtcaacagtgtgtaaatatgagcggagttgtctgtattaaaatgtggcaaattggctggatgtagtggctcatgcctgtaatcccagcactttgggaggctgaggcgggggtgtatcaccaggtcaggagttcgagaccagtctggccaagatggtgaaaccccatctctactaaaaatacaaaaattagtgaggcgtggtggccagcgcttttaatcccagctacttgggaggctgaggcagagaattgcttgaacccgggaggcagaggttgcaatgaactgagatcacgctactgcactccagcctgggcgacagagtgagactccatctaaaaaaaagaaaaaaaaggtggcaaatcgaatatcttggtgtaatatattcgttttccttttttgaaacttactatattttggcccaaattgaggcttgtgggattaggtcctgaacttttacgtggggtttgaatctttaggcagttagagtgataagaaatgcagttttttaaaagttgacttgtactggttgaggtctctattagagccagccatatataggaattgcagaataacatggtggttatgaaagtagattctgcagtcagtgttttggatttgaagcccaacctcagtacttgctggcagtgtgaccttgaacaaactattatacctatttgactgtttcttcttctgtaaatggggatagtagtctctacttcagaggattatgaggaccaagtgaaataatgcatataaaatgcttacaacagtgccagtaatctggtacatacttaataaatgttagtgaaattggccttttgtgaaagcttattgagtatgaaattgctctttctacttcgtcactaatcaaaccttatcttttgccactccactttggcctcctgataggttacaagttgaaatgcatatggggggaaaagagtcatattatttattcaaacacctacttgtcaagtgcaggaactgtgctgagtagtcagagtataaggacatgtagaaacttttcctgccttaaagaacttattagtggataattaatcaaatttatagtcttaattttttttattataagtattcaacaagtgtttttagtgtgtaagatgtgaccagtgagggaaaattggtgtagaaaatgccaaacgtggtaaaaaggcattcgaaggggaaaaaaagaaaatgccagacatgctaagggagggcagaaacatccagataaatttatttatctaatatggaaagtagtatgtactgtctttaataaaggtattgttctttttaaaattcaggttcaattttatttacaactgaattcctgcgcagtggagaagtaaaagaagccgcttgtctctgtgagcacagctatatacagtgtagaataaatgtggtagaaaagtttttttggttttatctcttttgcgatccctaaattgccacctttctattgtttgaatagtaaaattaatatgaagaactagatagtggtgtaaacaaatgtgataatgtttatttactttcggttctgctcatacttttttgtacaacattaaagaaaatggactttttttattttaatttctcattaaacttctaaaattcttataggtgaggatcatttttccccccaccttaggatggtgaatgttgcaacacaatgacaggtttaagtcagtcaagtttattggacccttgctttgataccattcttgggcacatactccaagattgtattagatttttgtgatgaagagcttccattacttctgaaaactatatttatctgagtgagtccaaggtgcaactcctaaatgaattgtgttgcagagaactcccagtataattcactgaccagtacattttataaccatccaggccttggtttgcaagcaacagaccttaaacatacaggaaactattaaaattggctcgatcagtagtcataggaattggtataagaagagactcatttagagctcagagttttcttcacataatgggggtattaattatttgtgctgttgcgaaattatgtgtcttattcttaaagccatggtaaaaatagggatctgtgaaggaaatttctaaaattggatgtattaggttttgaactctgagattgcacaaatattcaattaacttgaagttgtgtacatagagaagaaaatttggttttagcaaatgacagagccttcaaaaatatttttggaataatgtgaatcaaccgaaaactgggggcaaggcagaggacaggttttctcaggttaagagaaaaacgaaattttaaaaactttaaaaaatactgataaattcggatcaaatttgggggaataaaaaatattagagcaaaggagtttgctggttgtgtcattatttaatgatcaaagtatagcatgtatgccttattacagacttgttgactataggcttaatgtaaaaaggaatcttgccagatgtagctacttaaggaaaaaagggtttttaatagaaatgaacttttgattagtatggtgccagtcacagggctattttcctgaatattgggtgatgtcaaaggtatatgatacttgaggaaatcaggccaagtgtagctgagcaattaataaacactcaagtttttttagttggggtcatgtcaaaccctcacatggtggttaagtagtgactaactgtgcatgtccttcatggtaggtgagcaccagtctccatgatcaaaaatgccccagtttcctttgaaaaagccactagttctgtgaattgtccttttccctcctgcccctaacagtcctacccctctagcctacattagcatatttctcatgtaatgtattttgctggtaagctcatccattagctgcgtccttcagctattcctttagattggaggaagtggatatgaagatggattgattcagctcaccttccatgattgcttttgagggaaaagctacagtggccacatttcagatgttcacttttgcaatttgtggagggtggagagaggtagacttttgttgtgtgttttataaagtactctcagtaaggagtgtttgagttgaagagtcatctgattcgaggccactcatgttctttgtaacttaaactttgaccaagaaattcttcacttctcacttcttcacttcttcccaatatacagtaagtacgtgagccagtcatccatacactaaggcctagttgagaaaaacctttgattcaggatggctgggttactaaccttgaaatgtaagagatctggttttgaatgtaaaagttgcaacacacaaacggaagtcttaaaaactttttgctctggtcagttacaggtggatccccaataatctgtttttggttttctgatggaaataatagaattaggggaaatcaaatctggttggtaggtgtctacagtattagaagagggtataagggcactgtttaacactaagttctaatacttccagaaactgtgcattccagatctacatactaaatgctcttatcattttgaaatgggctcttgattaatagacccatattttttagtggcttctatgttgtatatttgtctaaaatgaaagctcttttgcgttctaaaactacaatatatgtcatcttattttccctgagtatccaagtatagtgcagattctatgtaaaactactaaatgacactggaatatgtttagtagattagggggaaaaactataaaggtttatacaattgtttgtagttacatttaggatggacttatccctttggagaagagtgaagtttgttttttcgccatgtgatgaagaccactgtgattttttaaaaaagtagataatacttaaaatggcgtaataattctgcacttgaatttgtactgttaacagcacatttggaagattttaaaactttttattgtcttataaatagcattcacttattattttggatatttaagggttccattaagttaacactgtatttggacaaagtgtgaccaaattagccagtctgttttcttccatgtttaattagaagtgagaggtagaagtacttcaaattcaacaggccagcaagcaatcggcttaaaattccctttcttaaatgttgtgctcttatgttctcggctttttaatgactttatttttacagtacttgttcagtcacttgagatgaaatgcttggggtagcttttccatcctcaaacttaatgtttttactagttcatagtgtttggaacagtatatgccaatcactgagactgcatcagagtttgcaattttgtatgtttcattgccaaagaaggcttagtggttgttgactgtagtataagtcagctttctgtagcataagatttgattttcccatacttacttcacttgttatacatcactgattatttgggttaaactggactcatttcaagcagtttgcttttgttcaaatcgtgatgagaaacctaatactgtaatttgatttgagccataaaacacattttaatattagcttgtattatagttattaagcttgtttttgtggaaaaaaacttactaaaacctaggtaactctagattaggccagttcaggtgtattttgtatcttagtaatggatcatatcgtaaaaatagagataagttgggaagatatattgattatgctgttctgttgagggaaaggtcatgtatttagaaatttaaacttttggttattgtgttcacatcatagtattcaagcatcatttatagtttggttttgagaacttttctggtattacgtttatggcaaatgtataaaagaaacaagttttggttatatttttatatttgtaaagtaagtttggttaaagtgatcactgttctttttttattttattgtcatttcaataaaaaatatttg

SEQ ID NO: 36227 - DNA, 2223 bp, Homo sapiens
acttcttttcttggctaagccgcgtttgtactgtgtcttaccatgcctgaaccggcaaaatccgctccggcccctaaaaagggctccaagaaagccgtcaccaaagcccagaagaaagacggcaagaagcgcaagcgcagccgcaaagagagctactccatctacgtgtacaaggtgctgaagcaggtccaccccgacaccggcatctcgtccaaggccatgggcatcatgaactccttcgtcaacgacatcttcgagcgcatcgcgggagaggcttcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctccaagtgagtccctgccgggacctggcgctcgctcgctcgagtcgccggctgcttgactccaaaggctcttttcagagccacccacctaatcactagaaaagagcttgttcacttattcccttagtttcttttcataaagtaagttattttagtgtgaaggtcatgggaaatggcatacgtagctttttaactatttggaactcgaggtccccagtgcgtcattggatttgcttttgaatctagagcgtgtctttactcattgtgctgcttagccttcccaggagtcggttctcaattaggctgttgggaatccgcctctttacccgcccccactcccgccccacacgcgccctggtggctccttgggtctgtttcattctaaaacgaagtggctgagttcggctgtcatttaagagaactccaggacacaattcagcccgggttccgcaaacactgcgtgacagctctgtatgactgacgcttggcagcagcttttgtgtccggtcaccagttctgccgtgcgatggggcctcctgtggataccagccgttctgtgtattttggacgaaggccgcgcagccgggtcccagccttgtcctgattgggcgacaagaatattcaaaattctgcgcctttttctaatttgtagatttcagtttccgtcgttcactttgagactttgaaattcctatttctcattttgttgataatttctgcatttaatggtctgtgctttaaatggtaacgctacggccccaggtcactgcgaggcacttaccatgtagatacgggctcaaaagtcacctctcagagacctacgtcatccactcaggaattcgcgcctctcatacttgcctgtctcattttatcttccttctagcagctgtctgaaattggttcgtctgttttcttgtttatggtattctcaagcccttgacagaccggctagtgtggttttcccgtgcatcttcagcctggcacattatggacacttaaatactacgtattgatctaatattgttgggttaatttttccatcccacccttttcttaatcgcttccgtggatggatgaagggtgctgttcatttccattagatgtatgtgaaggcacagtgaaaatggaaatgttcttggagctacttcctcaaaatgtatccttagtcacctcagtgcaacagctgggagggggccgtgttaagattttttttgctacaaagaggaggtggcaatggtagatccacccttatgcttctcagtttagcataacctcttatggattttcatcaaattcagcgtgttggtcactggaaagagccttttccttctccttttcttactctcccctcatggtgttcccctcttaaaggagaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcagctgtttttggctaagggcttttggagctgatggcaggggtttgatgaatccaaatgagctctagacattatcacagactgaatagatcttaactgtctcctacatgtgtgttttcaaatgtgtatagatgctattgttattaataaagttaccaattaatttaa

SEQ ID NO: 36228 - DNA, 31033 bp, Homo sapiens
tgcggcggcgagggaggaggaagaagcggaggaggcggctcccgcgctcgcagggccgtgccacctgcccgcccgcccgctcgctcgctcgcccgccgcgccgcgctgccgaccgccagcatgctgccgagagtgggctgccccgcgctgccgctgccgccgccgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcgctggtcatgggcgagggcacttgtgagaagcgccgggacgccgagtatggcgccagcccggagcaggttgcaggtaacgcggtctggaacaagtagttgggagaaacttggagggcagcggagaagcccgacgggcggctggaccttacggacggttttaggggcggcagagccgagaccttggaccaaatcaagggggactgttgctagcgggacgcggaagtcaggcccggggaggggaactggagttagagcaagtggaagagccctggcgactcatttggtggggatgaatggggagaggaaaggcatccctgctgccatagttttacccgcgtggaacggacccagacttctattctggaggagggatttgctgagaagggggccggtggtcagatccatgggagtaggaactcgaatcttatttggggcactgcttgaggacccaagggtcctggtgggatcgctgctgggaggcggaggctgcggggtgccagtgacaccaggaaccttggaagaggagagggagctaggaggaggcaccggcgtcccaaggggcccttccttctactggggttgtgagttggaaagaaaggacttggtactttgtaggatgagtcgcttaggagaaaaatgaaaaccaccactactatttctccatagggaacgagcagggctcttgctaccacgttgaatggaaaaataaaagggaggcatttggtaggcgaggggtctcctagcagctgaatcaatgtaacttaagcccgatcgccggctgcattccctggacgggggcagccaggctgtgcggtttcgcatctgggccccagatcgaaaggcaggagagatgcgttgccaccccccacccccgcccctatcttaaattgagggaccctttcctgtaggatagaatgaggacccgatattctttgttcaggggccctcatccctcccaaaaagttatttgagggacacaaccaggctctaaggaggttacttttttttttttttaattacgaaagcctcctgccccagtggtcgggaggaagctgtaattattttctttcctcttggagacagtggtgaaatgtgtccactgcctgctgctgttgttgaaaaagcaagtgagtcttaagtttctcaaacttaaaaagaaaaagtgaaaagaagaatgcttgctttttagcttctgaggtcttcgtaagccccccaccccatgcaccaacccgcctcccttctcctggtcggctattgtttttttccctgttctccttgagaatggaattaggggtcagagttgaaatctttcttctgtttctctagcacattttgctctggagtacagagcaagttagggcttcctctgagtggagcctctcagtccctttcttctccctcggctcgcttccttccctagcctgcctggaagttaacccttccctcctgcttctcttagaaagtaacaataaaaggaaaaagcccccacgaaatcctttcactgcggggtgcctgtcccccagtcatgcgttcctcctcatcacccctcgtggtccaccggggaggtgctgtgcagtttctgagctgaactctgacaaactaaacatcttcctcagcagggtgaactttttgaaaggcctctaagttcataggatggtttggctgctgactgttttaataaagtgtgtgatgcctttccttctttaacgttttacttttttttttttcctactcttcattcgtcttattctaagcctgaaaaccaattctacttcccaaatccctgaagccggttagggtctttagccaggaacagatgcggcagattttctcccattcacttttccctggagcctgaagggggtggggggtagttgtcaggggaggccagggacaatggggtgagttcatgggaagaatgtcactctggattttctgcctggttatgggactcccttccgccagcttgccccagctgcgttctcctccccagtgcccagacgccttccgcatttttgtgcaccggcctgggaagaggggatgttaagcaggggtggaaggtggggggtggggctggaagctgagtgggtgcactcaaaagaagtgaccaatgtcaggggtgcctgagaaagagtcgggctgggggaggggagcactttgggaaggagcctgagcttgcaagggtgcaggagaaaaaggggtcaaggttggaggcttttgtgtgggagagggtcttaggctggggcagagactggagtcactggatggagagtgctgggtccgagttgggtggggcctggcccagacggagatcttagcactgaatcctctgcctcccactccatctcccgtcccgtcttctctcctctccgaagaatgagcaccccccctccagcctgcattcctctttgagcaggttgcttttgagaattttaaacataccctcttatttcgaggcagcgaacctcagcagttccggctttgctgttagctcttttgtctttgttcccgggactcaggggctgtgttgctgctggcttcctggggatggcaaggatgcaggggtgggggtgggcacatcagtgggtggaaggagtgggtggtggtgagcctgtatcccacggggacgatgggctggggcttgttggttcaaagaaactgagaagtcagtcttgggggaaggggtgggtaggcctagaagaaaaaccgaaaggagaccctgagatctgcttgaagttgggactctaaaagcgtgtgtatgtgtttggtggtggagtggatagaagtgcctagaaatgtcagggtcgaggagggaacagggttgggccagtccaggccctttcagaattaaggctgggctagaccggttccttcagtatctccccagcctccttccctaccgtgtacaatgcaggggattatgctgaggggcggggccgcccgagtggccgtttggcccgctgcacgtataaaggtgctacagaaatgtgtagtcgttcaaagtcccagggcgggcagacaggcaggcaggcaggcgggcgggcgggcgggcgggcgggcctggggaggctctgcatctgcagttgccggggaagaataaaggggggaagaggcaagcactgatttacagtggttcagtgcagcttcaaaaaaaaagggggaaaaagcaatgggacttctggctcagagtactgctttgcatctcgtcttgcataaatttgcatactgagttcaaagtcgtaaaatagactagggaaatgagtgggatctactgtcactgattgttaacaccactaccttccacctcccctccccccatctggacagaactcccggcactagttctgctaagcagcgctgcctgagtcaccagtcaccactgttcatgaaagaaggagatggggaagcgcctgtctaggagaccaagcagggtgtggcagtgtgcaccctggcctcggaggcagggcctctctgaagggtgtggcccgacagattctggaccagtgaggcaagtggtgttctttctgacgcctggggctgccgttgcccatggtgggctgcagtttgaggaagctgcagaatccgggtcttctttgtttgaaatttccctactcagcttccacatatgtccaaaacatttactgtgataagtccctttgtgtggtggtaatgacccacttctttagacaagatatttgaggaaggttcgagaacagaaaaattctacttaacaatgttaaggaatctgagaaaagtggggcacaggagtctctaggttagaataggtggtagagcctggaaggagagaagaacccatctgttgtattcccgagggtctgcccacacaatggctcttggccaagtggactgttgagcttcctgtcaggcagagggaagagggaggcttagatagttctcactgttggcctacttcagcactgagcttcaagactttcaggcaaatcattccttcaggctcagaggctggaaattagttctataaaaatgccatggggccggtcgcattggctcatgcctgtaatcccagcactttgggaggccgaggcaggtggatcacaaggtcaggagtttggagaccagcctggccagtatagtgaaacctcttctctgctacaaatacaaaaattagctgggcatggtggagcatgcctgtagtcccagctgcttgggaggctgaggcaggagaattgcttgaacccgggaggtggagcttgcagtgagctgggattgcatcactgctctccagcccgggcaacagagcaaaaaaactccgtctcaaaaaataaataaaataaaaatgccacgggttggccaggcgcggtggctcacgcctgtaattccagcacttagggaggctgaggtgggcagatcacctaaggccaggagttcaagaccagcctggctaacatagtgaaaccccatctctactaaaaatgcaaaaattagttgggcatggtggcacctgcctgtagtcccagctgctcgggactctgaggtaggagaatcgcttgaacctgggaactggaggttgcagtgagccgagatggcgccactccactccagcctgggcaacaagagtgaaactccgtctcaaaaataaaataaaataaaaataaaaataaaaagccatgggttacctgaaagtaggagcatatccattcactcattatctgacctttgagggctgacttggagagaactgttctctggcccagtcatcaggtggcttccagttggttctcagctgggctgttcacacccatagaaaatgggaggtacgactgttcaatttctttttttttttgagacggagactcgctctcttgcccaggctggagtgcagtggtgcgatctcggctcactgcaagctccgtctcctgggttcacgccattctcctgcctcagcctcccgagtagttgggactacaggcacctgccaccacgcccggctaactttttgtattttttagtagagacggggtttcacagtgttagccaggatggtctcgatctcctgacctcatgatccgcccacctcggcctcccaaagtgctggggattacaggcatgagccacggtgcccgaccaggctaatttttttttttttttttttttttgagacggagtcttgctccgtcgcccaggctggagtgcagtcgcccagcctggagtgcagtggcgtgatcttggctcactgcaagctctgcttcctgggttcacgccattgtcctgcctcagcctcccgagtagttgggaattcacgcatgcaccaccatacacggttaatatttttgtatttttagtagaggcagggttttaccatgttggccaggttggtctcaaactcgtgaacctcaagtgatctgcccgccttggcctcccaaagtgctgggattacaggcatgagctaccgcacctggccacaactgttcgatattgatatgaggaagttctgaaaattctgcaccaaagggaatggagaacaggtaaatacctatgatgcctggcaggataggacagggggctgctgaaaggaatgaaggaggagcagaacaaaaaggggctgtgaggccacatccacatctgcttttgttgttggtccttcccgcgtactagaagactgtacccaaaagaaaagaaaaaagcttgttttttttttgtttgtttttttgtttttacaaagagtctgtgtatctgggaattgttatttttatttgtattattatttttattcatttatttatttcaagaccgagttttgctctgtcacccaggctggagtgcagtggcgcaatctcggttcacggcaacctctgcctcccgagttcaagcaattctcctgcctcagccccccaagtagctggaattatagacacctgccaccatgcctggctaatttttgtatttttagtagagacaggttttcaccatgttggccaggctggtctcgaactctggacctcaggtgatcctcccgccttggcctcccaaagtgctgtgagtacaggcgtgaaccactgcacctggcctattttaattttttaaggaactctgtatccagggagtgcatttcgtctcagcctttctctgtatgttcccgactccctcttcctcctcctgccttctccatgctgtcctctttgtccctgcagaccattctttcctttcccacacttctcccttccatgcctttcctactccggctcagctagaacacctgcttgctaggtaggtgggtggggctcaaaaatggtgtggaaaatatagtggtctcagcctcagagatccatccaatcagagggatattatgtaggtgactggagactataatgcttgaaaaaactagaatccttaaatgaggagggtggttgactgggctttgagggaaaggacttctataggccagggaatgggattctctcctataagagttagcactagcgctgcttctgctgaaaccaaggcatagaagcgggagatgatgtttgaattcatgagggaagctggtaacgtggttggcagatattctagatccctctgcttatcctgtctctggccagcaattcactgagatggcaggcagccgccaggagattggtggtgctcgcatctgtcctcaccctattatgaactggcttctgtgcctgctttgtctcctgtcttccacctccctgcgagggaggccgttctacctccattttgcaggtgtggacactgggtgactcagcgatacgaaaatgctgagaggctaacctgggtaccttcccactgcacccctctacctccgtggccgggtaaggagttgggctgttggtagagaaaagcttttgaccgtatcaaccagcagttttgttcctggacagctgccatgtgcaggtgatgtatggggcacagtaaatttctgccagatttcaattatgtagattcccttgactccatggacagttacaagtcctggagtttggggacctcacagttgtaagtagccagcatacagaggtcagtcaagagggacaagaaggtcacagggtgggcctcttgagagaagagctgctgggtagcagatgatggtgcaggcagcctggcctttgctgtcatattgaccggggttggttccattgcaaccctgtctcttaatacttcagtagttagtaaggctcttcctccaatgccagttccctgttggtaaaatagcaatgattttacctctttcccagggtgcgtgttggggtggctgtgataatggcaagtacctggcacatagtatgttcttgtacatgttagctgccttaatcttggcaagtgacatctcctccttgacaattagctggcctttaaaatgaaggccaaactggaaaggtcaggcaggccactcctctctggaggttcaaatcccaggtggtctaccatgtactaatcacccaaggtaagagatttcttgctaagcctcagttttcttatttgcaaatcagaaattgatagtatttcattgggtcaactacacagatgtgtgtaaagatataaactatatataaaacctaagctcttgcattttggtgatgagtcacttgatttccatctcttcacctatgaatggaaatatccatacctctccaacctactttcacagggctgtagtgaggtggtttatggaaagggcaatgaaactgtactttaaatgcaatacaaatgcaattgataaatgcaatataaatgcaactgataagtgcattataaatgcagtgcataaacggttggagaccatcgggcttgcattttttttttttttttttttagacagagtcttgctctgtcgcccaggctggagtgcagtggcgcgatctcagctcactgcaagctccacctcctgggttcacgccattctcctgcctcagcctcccgagtagctgggactacaggcacccgccaccacgcccggctaattttttgtattttttagtagagacggggtttcacagtgttagccaggatggtctcgatctcctgacctcatgatccgcctacctcagcctcccaaagtgctgatgattacaggcgtgagccatggtgcccgaccaggcttacatttttttttttttttcgtgagacggagtctcgctgtgtcgcccaggctggagttcagtggcacgatctcggctcactgcaagctccatctcccgggttcatgccattctcctgcctcagcctcctgagtagctggactataggcacttgccaccacgcccagctaattttttgcatttttagtagagatggggtttcacagtgttagccaggatggtctcgatctcttgacctcatgatccgcccacctcggcctcccaaagtgctgggattacaggtgtgagccaccccgtctggctaggcttgcattttttttttttttttttgagacggagtcttgctctgtcacccaggctggagtgcagtggcgcgatctcggctcactgcaagcccgcctcctggggttgatgccattttcctgcctcagcctccccagcagctgggactacaggcgcacgccgccacgctcggctaattttttgtatttttagtagagacggggtttcaccgtgttagccaggatggtctcgatctcctgaccttgtgatccgcccgcctcggcctcccaaagtgctgggattgcaggcgtgagctaccacgcctggcctaggcttgcatttttaatggattagttgggcagtgctctttggatccgatgtgctgatgtctaggactgactgtttttggtatgggagcttctgtctgcagtgtctagaatgggggttggagggactatggggaacagaggtggccccagagcttggacatctgggttctcatgctggccttgctgctcataagcaggtaacacagggttgagttcctcctttgcctggccagccaacctggaagacctagccttctggctgtcagtgtccagagctctggagaatccctgaggctacatctctgggtgggggaaggtcctctctgtatagatggccctccaggggaagtctgcaaggatccagacttcagaataatagagttaagtattaactaatccaagtggtcctagcacatttagcacatatggcatgctcaagggtgtgcaattgtgcagtcatcaaagccagtgagggcacccgatgccacccatttcctgcaccaggaaaatggacctttcacgtctctgaacctgggatgccagaatgcactgaacttgatcctggcaaataaattggaagctgtttccaaaaaagtgatatgttcttgctacattgtctccagagtttactcctgagttggggagcagcatctcattttgcaaggggctgttggattctccatagaaacgctgggttgggggagtgtcttctgagtactggggctctacctaatgtctgattccatctgtggtaccaaaaagccctctgaatggcagcctgtctgtgcacaatgatgccgaagactttcttttccagcatctaatgaggcatggccccaggaaagcagagaaggcggatgcttgagtctctgagggtcagaatacgcttatggtgaaatcagaactggggacaaggcaaagtactgccattgggaatccggggtggatggtcatgttagaccaggggtgtccaatcttttggcttccctgggccacttggaagaagaattgtcgtgggtcacacataaaatacactaacactaaccatagctgatgagctaaaaaaaaaaaaattgcaaaaaaatctcataatgttttaagaaagtttacgaaattgtgttgggccacattcaaagctctcctgggctgcaggttggacaagcttggcgtagactcttggagggctttcatggtggaggcaggaaaggaaaagccccttttacagatgggatagtaggtccagagaaatgtgttggttttcagttccagagtaatttcacctgctcccaccctccacactcacaaagagcaggctgggtgggatgtcgatttttttttcttctggagaatggaccatctccctatgcctctcctcctccttggctactaacccctgacttttccctcccccttctctggccactcctgttcctgaacaaagccagggaagatctgggctggctcagcccctgggtgtcagtcaagactcagagggagactttgctcaaaaagccagccctcccggaaagaaatacagagcaactgtagtcaggaatttttccctttccttttttctgtgggcggggggagggacacttggcagtctttggggcccttctggctgccagccccacatctcttcctggctgttgggaggcagggcaggagggaagattggggagaagggggcaggggctggcaaacacccagctgctgggcagtggaattcgtccataggccctggtggagttggcctctagtgaagcctggggaggtttctaattagtggaggacggtgaaggtgtggcagcctgtgttcattcaaggaactgagctctctgagccaggaagtcaaagggaagagggggactgagtcccggaaggccttggtaggtggggaggaagttgtacctactcagtgtgttccatcctattagaagttgagaagaggggggtgtttcagctggagtgattcaggttggactctgggggtgcagagagtcagtcattggcactaagcaaagggagccacctcaaagaataagtgatataacagtgataaacaaaatggctttgttctagacattgcctgcttctaccagaaagctcattttgttttttttgtttgttttatattcttcccctctcccacttcctgccccagctctgttttagcctcgagattctctccacttaacaaatgaagaaatcaaggctacattcaggttcaactgccaaggcaagcacagaccagattgtagtctgggtctctagattcttccagctctccatttcaccagactcacacatgcagaaaagcagtgaattatatactgcttcttggaagagctccttttccctgggaagtagtaattaaggcatatcttctcaaaaatgttcctttatgcaactctctaggaagtttcttttaggtctattgtctttacttctggatggaggtgccaagttgcctctgggtggtgaacttgttttctaaaatgcccgaggccaagaacaaaatgaaaatggcaattcccttgtgccctgtgccctgccccgtgacttcctgataatgctgagcagttgctatagcaacagtggtgggaggtgtgtcaggcaggataaagggggtgggggtaggacaggtttactggatcaaagaggcttttgcggttgagtagggctgctgacatgactgatagcctacttctagggaaagatgggggtcccatagagatggggaggggaagaaatgaagccctggggctaaaaggtcttgcttgagagtctttccttaggtgatgccaagtgaccaggtgccatctggttggttaacaacctgggcttggttttggccactggctacatgactttgtgcagttggcctccagctctatagttcatttatcaagtgtgagggggataagaaattaccaacctcatgtgcctgcttgataacaaaggtaaacatgcaagccacgtagcacagaaactcagataatcaaatgaggtagtgcaggttctgattcttgcaatacaggagaacaggagaatggcagacaccgcttttggacgttttctgattggtcatttcaagaatcctgttagcaggtgtgacttattcccttgagtgtggcttacctggacagctgccactttgctttggaaagcctccagtgagtccagagaggagtcaatggttgagagttttccagggggcagtcatgaccctcgatgccattgtgcctgtggttctaccaacagcttaatgaccaaccatgtcccatttatgccccagaagttaggactcccacttgaggctctgctggttgtctctggtttggttcactgcctcttaaaccttgagagcatagccaaggaaggtaattgatgtgatatactatcagacaaaattagtgaactttagttgaagacagagaaaagcatggtgacctatttaaagacacttatttatattcaagacacttcttgtgctggtttgagagtggccggcaatcctggacatctttgcaggttttaaatttctttttgcatcctgtgggttcaatttgtcaggcctggaatatctgagagcagagttatggggatggagaagaggacagtggaaggggagggtggtgggaaaggttggtaggattcagcctttgttacactatgggagtggggctgtgggattgcatcatcgaaactgaattgtttgaatgtgggtcttaggacaggcatgtgtccttcccatcccatctcatggttccacttgctcactgcctttcttgacttgctcactgcctttcttgactcttaaccactcttgctgatacgggctctagatgaggcaaaggccagaagaatgagaaaaagagttaatgtaacagggtactcttgggcaagtgctagatgctctttgatagtgtattagtctgttttcacgctgctgataaagacatacccaagactgggtaatttacaaaagaaagaggtttaatagactcacagttccatgtggctggggaggcctcacaatcatggtgggaggtgaaggcacgtctcacatggtggcagacaagagagcttgtgcagggaaactcccctttataaaaccatcagatctcatgagacttgttcactatcacgagaacagcatgggaaagacctaccccgatgattcaattacctcccactgggtccctcctacaacatgtaggaattgtgggagctacaattcatggtgagatttgggtggggacacagccaaaccatatcagatggtcaccttttctaatgtgtaaacattaattgagcacatgctgtgtgtcagctaggagaccatatgaaaaagcagttgtcataccacctgtaacacatgctttttcatgctggagggggacaagaaaagcattttagaaaggtgaataaagaagaaaccaaggcagcagagatgtatatacatcctatgcaaataaacaggtagctcttggtcactaaaagagcttaaccaagtctcttgggaagagcttgatgttaaataatgaagtcccttcatggtaaataaagttatgaaagtaagagaatcaagttggacaggcttctacttcttcagtcttggaagaaaaaaaaaagcagtgtcttccttcctaaaatgttaattgaggacacagaatgtcttctcacctgtccttcattcactaagtatggaaagctgtacggaagctaagaccaagtttatgtcttcaggaagcttctgtccttaggaggactaagaaaatgcacagacctacagctttttggcaatggactcaggctagagtgctgtgaagaaagttgggtcaaattaccagaagactttacccagcagtgcttttcttttttaaaattttgtaaaatttttatttatttatttattttatttattttgagacagagtccccctgttatgcccaggctggagtgcagtggcgtgatctcggcttaccgcaagctccgcctcccgggtttgcaccattctcctgcctcagcctcctgagtagctgggactacaggcgcccaccaccacgcctggctaattttttgtattttttagtagagacggggtttcaccatgttagccaggatggtctcgatttgctgacctcgtgatctgcccgccttggcctcccaaagtgctgggattacaggggtgagccactgcgcccggcccttatttatttgtttttttgagacaagctctggctctgtcacctaggctggaatgcaattgcacgatctcagctcactgcaacctccacctcccgggctcaagccatcctcccagctatggcagtgcttttcatcaatgcaatcaagtgacctttggacacttggaggccatattgttcatccttcttccttctcaaaaggtttctcctaagttataccagagggagtctgtgcaatttcttcccatctgcaatttatcagatttgttttgttctttcttatgaaattcttggatggcttctaacttggatctctcctgttttagtttaaggctgttttctctctggtccttggggagacagaacggctccttcccttcccttgggttttcctggcccttggacacctccaccactcagcaccctctggcagcaccaggatggatttgtcccttggctttcagttctcaggcctgagtcatcttgattacttcatcttccccttcttaattctgtgaccctcttctactacctttgggtcttctttctgactcatttccgagttcttcatggcatagagaacaggccaggagcccagggctaggttctgactggtggacaagtgaccctggtaacatcattgccctggccagtgagagtggtggtgaagtccgccatgtcactatcgtttggtcctcttccagtagggcttcagggacacttgaggttactgatagctctgcttgatgaggaagatgaggggtggttggtgtgagaggtgacttttttgtttttgtttttatttttgagacagagcctctcactctgtcacccaggctggagtcagtggcgcgatcttggctcactgcaaccttcgcctcccgggttcaagcgattcttctgcctcagcctcctgagtagctgggattacaggcatgcaccaccatgcctggctaatttttgtatttttactagagacggggtttcaccatattggccaggctggtctcgaactcctgacctcgtgatccacctgtcttggcctcccaaagtgctgggattacaggcatgagccaccgcgcccagccctgagaggtgacttttttaaaagaatatttaaaaaatgcagaaaagtacaaagaacaatgtaataacacaagtctaccacccagaaccgtgggcggttgatattttgtccactagcacgcagtacttacttagtgtttatctttcttagctaagcagacttgcatatatgtgatagatgactaatatgcctatgtttgcatatattgcatctatatgcatatatatgatagatgaccaatattgtccaaattgttttgtgaaaataaattgaaaatgcacataaaggttttattttccctcttaacattaggtgtctgagatctaatgttgacatccataggtcagaaatattctttttaactgctatatattgttcctttgtattaccctactggttttatttatccattcacctgttgaaacacttttggatctggttgctaatagtgtttttacaactacaagtaatgctgtaatgaccatttttgtacatgtgtccctgtgcacatgtagagagaagaattgctgggtcaggcacattcttcccattcccatagtccctggttcaagtttgaatcaaagcacagtctactcacttgggcctcagcaactaggtcaccttgccaggttcctggatggctttagttgaacccaaggagaaatgtttgggacccgtggaaaggagtgaaagctgatagtgctgtttgccatcttgatatcagtttctctggctcttcaaggacagcttggctcacggggccccagaggaccttggctgaatttgagcatgtttttgttttctcaaactgtctgcctcagccctgaccctccccaggtctttgcaattccaggaatgaccctgatgtttataaaggagccctttggagagtgcacaggcagggaggctctggagaggctgtgctgtttctgttcactcggggggagcccgagatgagatggcagcatgagggcatactctagaaacctccatgacgccaggccaggagaggcccctctgcatgtatccaagcaagcatatgtgtctgtttacaaacccatgagtggatgagcttacaaggctgtgtctctgcaaagcttatacccgagaccacctctcttgaaaagaagaggcattgttctcgcctcaccaggaagttcttcaggaaacagacagaacagagagaatcacaaaggcatgggggcctggcaatgccagagcttgagaggagaggtatcattcaacatacagattccttagtccttgcctctgactttctggggctggggtccagggctcttatttttagcaagctcatcagatgatttctgatgaagagctatgtttgggaacttctgactgggtctaattccctgaatttacagatgagtacactgacacctgcgcaagttgaacaccctgcttagcgtcactcagaatcccaggggtggtggtgaagtcaggatcgaacctcagtccttcctcccacactgggactgcttggccaaggcttcgaacccaaaagctggtgctccaaaggaaatccaaaaagagtttgcagagtggtttgacgtggaggggattcatcggccaggtgggggctctctgccctcccttggtggtgcatcatctcctgtaggtgttttgtcaccgtggaagggcagtagcctgtgcctgttgggcttgccactcaacagaggtcactgagctcttccgcactcagctgggtgattggcctgtggtagctgcaggtggagggagatgattctcagaagagaaaggccagttcttgcagtcgtgtgatcttataacctaggggacttgtggatctgaaacatctgagaaggctgtttgcagttatttactaccacaaaggaaactgggagaggagggaccacctgttggaaaaccatgctcagaagtgactggtctgttgctgaaggatggaaggatatcaggtgttgcatggctggctcccttgcaggaaggaagggctcagggggtgagaaggaataggaagggagtttacaatgaatgaagctgggtgtcctcaggagatagatggaccagttggggtgatgtcattaactaagctggaatgtgtcctgagtgccagcctataccgcgacagacatctgtgcacactattcagaattccagtgtgagaggccactgccccctctgaccttttgaaaaaaaaagtcaggggaagacacataaacagtgtcactcacccacaaagtctcaggacctcaggttaaactttagctaaagaagtaacaaatagaacccccattttaccttcctctttcctaacttctgcctccctccctcccaccagcatggcctgaattactaatcccagcctgttggtgggctgtgctattgaacatagtggccacatgctagatggagtttggtgaccaccatcagccatccaaagaggactggcttcaaattctctccaacaaaagctgtttcttgtatgtgctggcgtgtttatgagccctgtctcaactgagcatgcgtggtgattatgagctactgcctgacctccttccctttgtccctcccgctaaattctgtaaacaaagttaaagtaatttaggcaaattcattcttgcttaaggacttctattaaatggcagagagctttgatatttagcaatgtataaaatttgtacaatcaaaaccaagctttagaagaaatatgcaatagatcatattgcagaactctcatgactcattttttccatgcatttggccattctacaaatcagacattacctagccttcccctcacatggcagatataacttttatttacccattcaagaaattgattgttcacacattcctttttctttgaaacaaggtcttgctttgtcgcccaggctggagtgtagtggtgtaatcttggctcactgcaagaagtgaactccgcctgctgggttcaagcgattcttgtgcctcagcctctcaagtagctgggacctcaggcatgtgccaccatgcccagctaatttttgtatttttggtagagacaggtttttgctatgttggccaggctggtcttgaactcctggcctcaaatgacccgcccacctcagcctcccaaagtgctgggattacaggcatgagccaccatgcctggccaccacacatttttttctaaagcttggttttggccacagtgagagtttcttgggctgtcaggggtaaaaataccatgtcttgtttaacagcagccatcattttagcagaattttttttttttttttttttgagactgagctttgctcttgttgcccaggctggagcgcaatggcgcgatcttggctcactgcaacctccgcttcccgggttcaagtgattctcctgcctcagcctcctgagtagctgagattacaggcatgcgccaccatgcctggctaatttttatgtatttttagtagagacggtgttactccatgttggtcagactggtctcgaactcctgacctcaggtgatctgcccgcctcggcctcccaaaatgctgggattacaggcgtgagccaccgcgccccgccccttagcagaattgttaatatcatttttcagacttgagaaattagagctcagagaggttaaaggttctgactcgtgagtgaatctcaaagggcaaagctggcattcagggttcttgactgctgggttcattgctcattccagtttgttaatgaatcgtccactgctatggatattaatggagtcgtctagagagcagggggaggaggatggtggttagtatttattctgttgcccaacatatgtcaaggctaagtgccttttgggagaaattaacaaagacggagccatgtgagttttctgcccagctagggtggaaccaggaagctgcggccagccttcattcccctggcccattactcagaattaactcttgaaaggcttggaatgctattacctgttgcaagaggtgagttcattggaggaatgataagttcagggttggcttagatcatctctgtggtactcctctttcccaaccctgctcttagattttaagataatcatgagataggaggagaaggctggaaaatggtaagtctttcttcagaataaagaaaagaagaaagaagagagacacatgagctgttaggaagatgtgattgttctaggtagggaaaaggtcttatttcctcaccaggtctggataaggaccggggccacacactctgaggaggaaggaccagggaggtgcttttagattcttggggcttagtttcctaagaaagctttttaaggtctctcttagatcaggaatcaccaatttccaaatagagcactgaggtcagaacattgtgctaggagaaaatgagattttgtgggagtccgtttctatcaaacacaagagtttgatttgttgagtaagatcattgatgcaacaaacaggattacattggaaaaatgagctgtgccaaaattaggtctgaaaacctgggtatgaatgcatagaagtgaacaataaaggctctttctcttgggctgtcagcttccagctgctctccttggctaaattagtaagggtgggccaaaagacaatgtagggaccccatgataattgtgaagaatggcagagaggttgtttgctcctgtgaattcaaatggtagtccatctgggctcaggtttgccatctgtaaaatgggacaacgatccatttcttttcatcccatctgccttcctcatctccagctctcctctaggggtcttaggtagaaaggtgtggcagtctacccaaggcaggggtgggagttctcccctgcccttcaagcccccgactaatggctctggggttgtctgtcatctccctgacttctctttggaaaagcttgaccttctatatgtgaaatcccttgcttctgtgttgacccatttccctaggtgctatgtagggaagaagagctaatgcttactaatctacagggaaagtctcttcaggggccttggaggtttctatcaaccatttctaagcccatgagccttttccattgatgtcatttggggttgctaagaaccatttcttatagtgacctttgcaccatagcccatggagttgcatacataagtggttgcttaataaatattattctgaacttaactctcttaggcagaaaaaaaatacaacttggtatttttgttctgagggcaaattccatctctagctggagttcgacatctggaatgttttcctgtggattgttcttgcagcctataagaggatatatgggaagaacttggtaacatgtgataatgcccttgtctgactgaggggaggaggggcgctatgtgggtacttcctggtaggcaggaaatggaagtggctaagagctaaccccatgtgtgcctactgtgtgccaggccctctctgtagatgcaggcagcatctctttggatcctcccagttgcccataggaggtgcatactgtttgtccttttacagatgaacaatggaagcacagagagcttaagaaagttgtctggtgctgcacagctcagtagtaaaagcttgaattccaactcaggcagttagattttggggtttgaatctctttggctgggaacagtaacaaggaatgcaggcttttctcagcctacaatgctttctgatctctgcctggtcaactctttcatttcccttccctgggcttctacttcaagatgtggagttcagatctggctacgggatttgagtccagaagcctcttcctgagaaagaaacagatgctgatgcatggtcttgttaaaccatctttaaaagaccttgcatcagcaaaccaggcctgtggatttcttcatcttattggcatgttcgttggcactgctgagatcaataaagaaatggaatgaaacatacccttgaatccaggtggcctctgtgagggtggacaaacttgaccttcacctcagagagtttgggacatctcagggcaggaaatcaactttgtcctcctggaggaacactgccaagttgaccccagcctcctgggacctggagccagggttgcatatgacatctgtgggccctggacactgcctctgtgggcccttctataaaaacatatatttttaaaatttaaaaattattatttttcgtttttgagacaggggctcactctgtcacccaggctggagtgcagtggcatgatcatggctcactgcagcctctaacccctgggctcaagtaatttcccacctcagcctcccaggtagctgggaccacaggtgtgcatcaccatgcctggctatttttttatttttagcagagacaaggtgatatagttaggctttgtgtcgccacccaaatgtcatcttgaattgtaatccccataatccccaggtgttgatggagagatcaggtggaggtaactgaatcatgggggtgggtcccccatgttgttctcgtgatagcgagtgagttctcctgagatctgatggttttataaggagctcttccccgcttcacctggcacttcttcctgccaccttgtgaagaaggtgccttgcttcccggacctttggcttctaccacgattgtgagtttcctgaggcctccccgccatgctgaactgtgagtcaattaaagctctttcctttataaattacccagtctcaggcagttttttatagcagtgtgaaaatggactaatacagtcaggcgtggtggctcatgcctataatcccagcactttgggagaccgaggtgggcctcctgtggcaaggagttcaagaccagcctggccaacatggtgaaatcctgtctgtactaaaaatacaaatattaaccaggcgtggtgacacatgcctgtagttccagctactcgagaagctgaggcaggagaattgctcaaacccaggaggcggaggttgcagtgagccaagatcgtgccactgtactccagcctgggtgacagagcgatactctgtctcaaaaaaacaaaaaaaaaaaatcaaaaaaccatattttataacttgtttaataaatgcaaatgtattaatattatatagtaagactttttaacctaaaagttattttttttttctgatgttaatagaaataaaaatatgtcctaggcactgtgcctccagagcccaatggacaagttggccctgcctggcgccttcaggcccgaatgcacatttatctgtgtgtgcccctctcctttttcaaatgtgtttccagagattgcagagggccttcttctgaggattaatgttggattgacctctgggacgcagccaagggatggttctttggccactgtctgtggtacaagagggcttcgtgaagatggggagctgcaggctgaaagtcctctaggaagcccagggaagatcctgtgccctgcccccaagaaactgtggactattgtggctgcagatggaagggtagcggaggggtcttagccgtggatgcggaatatagtggagctagatttgctttatatggggcctggagccatttcagcaatgggctatcagcttacaggtcttgggctaaaagcctgactccagaagagtgattctcaccctgggcagttttgcctctccggggccatttggcaacgaatgaagacacattttttgttgttccaacctggggagggtgctactggtttctggtgggtagaggccaggaatgctgcccaacatctggagtacactggatgttccaggcattgagttcgggtgagcggctccttcccagaagctcatggatagaggtacacatgagctgcctttcccgtctccaaccagacaacgtgttgttatagccataatagagactgtctgccttcacccaagccacttcccaagagggcagagccaggtgagcctctgagcatcacagacttcatgtccacagattggagagttccagaaatggtggcagggtgcagtaccagcagactcccagagctcctgtcttctctaacaccctgtgagcagaatgcggtgtcgaggtctccagaaacccttcctgcctctgtgggcacaaagctgggtagggtgcggtaagcagggtgatgccaagggtgatctcaggtaccaagggttcgggtgagggcgaactggaggttcccacttcattttgtctttctcattttgatcctgagtagctgggagggagtcaaagggctcttctctatgttccaatgcaggtggtgggagtggggagactttctagctactttgctctcctcctgtgtttttggtgtctgcagagggcaggggcagggagcttgagatggtcccactcaggtctggggacagagaggcctgtctgggaagggcagcggggcggaggcagggaggctggggatgagtgcgtgcgctgcacggcatctgtgtgctgcgttagaggtcagtgttgagatggaaagttgactgaacctgatctcttctgtttgttgtccaggtttgtctgatctcagactttccccggcctttctctttcacccttttgtttctgacctctggggtccatctgaagagggaaggggggctcttctaggagggtgtggacctggtggcgctgaagaaatctgccgcacggtggggtgactcagcgtccctgttcttgggaacctggcaggcagctgagcaggggcactcactcagcctgcctctctgggtccctgggtgtctgctgctctccatgtggaggagcacagagggcagggcaggatggatgaggaaagctgtgggctggtgcctgggtctgattagacatggtggagcaggactccaacctagcctggaggcgcacgctaaatcggccttttcctgccggtggtgctgggctgccgggctgctggaacaatttaatctgtgctggcttcatttatggtacaacccaggctccccagagcccctgtgggaataaccattctaaataaaatatttttccaggtttcaggtttatacatttaacatttaaattttttttttcctggagttcaacaattttggataaaagtcttttaaaatgatgaataggtagaattttaattccctcccctttttgatgtcccaagatcatcgtcatcaacgtaattcttgttttgggctgtaagacatggaaatccccagggttcattgaggggcattcattgtttgccacacacaaaatgtacccggagtttgtatgttttgttttcttagtgtcctctttcctctctgccatttgatccttcttgctactgtccacatgcattccttctttgtcccttcaattttgttgactttcttctgcggtggccttggaaaccagacatccagaagccaggcttcctggagcagcactgttgtgaactgtctcgaggctcctcacgagatgattctcccctcatcttgagtggaaagtgccaacatttgaacatgctcagccgtggtaacagctattaggatgttcagagcttattttccttggtttccctgttctcggttgggttccatgctgctgaagtagtagataactggggcattcgtcattgtcatcatcatcagtgtaataaccagcagcaacatggatatagaatttctgtgctccaggtcgtcttttatttatttatttatttatttatttatttatttatttttgaggcagtgtcttgctctgtcgcccaggctggagtacaatggtgcgatctcagctcactgcaacctccacctcctgggttcaagcaattgtcctgtgtcacccttctgagtagctgggattacaggtgtgtgccaccacacccggctaatttttttgtatttttagcagagatggggtttcaccatgttggccaggctggtcttgaattcctgacctcaagtgatccacatgcctcagcctcccaaagtgctgggattataggcatgagccaccacacccggcctaagtcatcttttaactgcttttctttcgtcatactctcaacagctctatgaagaaagaactgttattatccagcaacttacagttaagaaagtagaggcacagagagggtctgtgtggggagaacacgtgcagctgatatagaaaatggcagagctggactttaacccggctacacccctttaaccagagctgctaccctggggacggcgtgctggcttctaaaggaagctgctgcatggcaagtgaagagtgactagttctcaggcttggagggaggggaaaggacagggacagacccccatcaaatgttccgtatgctggggcctatgctgggcacgccttgacagcaggtgctgctggagtgccagcacccggtgctgtccctggcatggaagaggtgccccctcccttagttggtgagtgagtgaatactcttgtatagagttactctaagaattattcatttgtgttctaagggctgtaagtttttgaaggtgcattaatggggaagaaaaaatgtgcaagattggttgaaaaacacccctctgcacccacccagatcttgttgggacctgcaggagagcagctctgggtgggagggtctggggctgtttgccgtgtctccaaggggttggggctggggctcggcggtgtgaggccctgcccttctggagcttgctggggcttgtctcctggttacagctctgccgtgcgattcagatcctctctgcctcctttggctggacgtgcctcagccagagtgagactgtggcaggctggagctgttttcaaggcctccttcacctaggctgtgcatacaaaaggttgaagaaagtataaggagacttaatggacgcttgttggacagacatcacgaagcttcatgccctgcagtaagctgaagctatgaagtcgaaggagtcatagttcctgttcttggggctctcagtataatggggttggggtgggctgcacagacagacttgggaacgagggaatgtcagtgtggcagagctgtagctgcctcggagcagcactatgggaccttaggcagggccaggtgggcaggtacacagtgacagcagggggatgctgggaccaggttctgggtggcgacgtggccttccaccttctcactcctttgccatatatgctgcagcccggtgatgtctgtggcacgagttttaaaaaactcaactaattggtgctcttccagaccacaaatgaagaactttaaactgggggttatagtgggagaatttgggggggtcccagaaaggacttaaacccattccatggtcagggcctttcaaatgcattcatccctctgtgtgcctctgttctgccccagccttgtaagagggtccctgtcattcttctagagccagacagcctgatttcaaatcctgaatccatcgcttttcagatttgtgatcttggtcaagtaactgacctctgtgagcctcaaattctccatctctgaaagttggggagggtgctagtagtacccacctaagagttagggtgaagctgaaattgatcatccatataaattgctcagcacgggccctgacaggccatcagcactcattagccgcgcgtcatctccaccctcatcatcattacggtccaggtggctcccggagggcacgtctctctgggaaactggacctggagcttttcttcccttcctctcttggcagacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccagggtcagtgagggtcaggtctggtggaaggggtgggaggacaaggaaagtggggtctcagctggaggagggcatcctaataagaccctcatctggtgtgacctgtaggcaaagcacttttctttccacaaacatagttgtggaacatagttagtgacctttggggcagtcagtatctctggctgtgaaatagactggacatgtggtttcttgatgttctttccttctaaaaccttcacatttctgtatggttttggaacatagacacagaaaatgaatcccagagatgaagacagagtccctgaaacttgcttactcttttttttttcctccccctgagatggggtctcactctgttgcccaggctggagtgtaatggtgccatcacacctcactgctgcctccaactcctgggctcaagtgatcctccttcctcagcctcctgaacagctgggactataggcatgcaccaccacacctggccagttttgtattttttggtggaaatgtgggtctcactatgttgtccaggctggtctcaaactcctggactcaagcaatcctcccacctcggcctcccgaagcgctgggattacaggcgccagccactgcgcctggcctgaaactcagtcttgttgccatatgcttctctcactgagctacccctcccctctttcctgcccagctctgccatcttgggtcctggccctggttggttttatggaaagaagtggagcttgggcatggggtgggggcatggagactcgagacggccacttagatggatatttggaggcagagcccattctgacacatgaaagccacggtcacagaacaaggagaggagtgaacattcccatccatacaattttctttaggggctggggttgggcacccagcatggcagggagatccccgggcaggctgtcagaagtccctgtgccccctgctggctgtgtgaccatgggaaagtcccctccctgtgcagcagcttctcgctgagcttgcgtctggcgcgtgcttcgtgggcctgctgtcctcactccgggcgtcccctgctgtctgtgcgtgcagactccctgccaacaggaactggaccaggtcctggagcggatctccaccatgcgccttccggatgagcggggccctctggagcacctctactccctgcacatccccaactgtgacaagcatggcctgtacaacctcaaacaggtgagcatggtgccagcctgggccagagcagctcctcctcagccctgggccccagatgtgccttgtttctgccccacccgcctatgatcctctgaggtctgagctgagtgagagactcagactcctgtcaccatggggattgggatgccagctgccaggccggggagggtgcagctcttctccctgcctccgacgggtcagttgctggctccacttgcccagctgcccaccggcctcacttggagtccaggttgggaggaggctcttggagaagggaagtggcttaaaccaagcatctttgctttgatcggacattgacatcacctggagctcttcctgggcccgcccccaaattgccatgtggtaggtcaggtttacagctctaacaagcctcaggtgaggctcataatctgtgagccacactcccaccatcattgatttcaaccactggccgagttgtcttcatggtttcgaagtatctcagggaatgaagagtcaggcatggagaaatgccgttggaaagattctgaaaagccatctagaacaccattgtaaatacattggagaaaatgaagtttaagtaaaccactcaggagcccttctccctcctctatccaccttctgttcatatgcattttaacagtcactgtgcatatgcaatattttccctgtaacatactttttttttttttttttttgagacggagtctcgctcttgtctcccaggctggagtgcagtggcgtgatctcagctcactgcaacctccgcctgccgtgttcaagcaattctcctgcctcagcctcctgagtagctgggattacaggtgcctgccaccatgcctggctaatttttgtatttttagtagagatggggtttaccatgttggccaggctggtcttgaactcctaacctcagatgatccccccacctcgacctcccaaagtgctgggattacaggcatgagccaccacacctggctgggcattgggatttttataaagctaccctggtggttctaatggcagtctgggctgacctaaagtgtggatgtgtgaagccaggagatgggaacagggctctgctgatggcttaggggtctcacctctccacccccttcacccaggcaccttgaccctctaaatattagtttagtattaaaagctatttgtgtacatgccctctaaatgtaagctggctaactccatttggagctcagaagaaaaagtctcgatcacttctcatgggaaacaggctgtctgctgcacctttgggtaactaaagtgatttgcaggagtagttagcttatgcataaaacagagaccttggagtgggaatgcctggcttccatctcagctgtgcttcttaccagctgtgtgaccttgggcaagttgcttagcccatctgtgcttcagttttatcatctgtaaaccagggataataatggcatctaattcacaaagtggttgtgaggattaaatgactatatttgttagaaactgaactagcagtgtgtcttgcacacacagtgcctggcacacactgattttgattgcaacatgaggttttacacctgacgctatgactaagcttcagtatgctgggtcccccccactggatgggacctctttgaggctggggactgagtcttttcatcttcgggtgtcctgaatggccttgctaatcagaggggtccctgggcgggcagcatcagcatcacgttggagctcgctagcgatgcagaatttccagctctccagggacctactgcatgggaatctgcattttatcaaggtttcctggcgcatatttgaagttgcgaagctccacccggcagcgcatgggtagctgcaaggggtggctgctcagtggacgccgggttgagggacagaaggaaagttgctggctgcgggctcctccatgctcttctcctctctccccagtgcaagatgtctctgaacgggcagcgtggggagtgctggtgtgtgaaccccaacaccgggaagctgatccagggagcccccaccatccggggggaccccgagtgtcatctcttctacaatgagcagcaggaggctcgcggggtgcacacccagcggatgcagtagaccgcagccagccggtgcctggcgcccctgccccccgcccctctccaaacaccggcagaaaacggagagtgcttgggtggtgggtgctggaggattttccagttctgacacacgtatttatatttggaaagagaccagcaccgagctcggcacctccccggcctctctcttcccagctgcagatgccacacctgctccttcttgctttccccgggggaggaagggggttgtggtcggggagctggggtacaggtttggggagggggaagagaaatttttatttttgaacccctgtgtcccttttgcataagattaaaggaaggaaaagtaaa

SEQ ID NO: 36229 - DNA, 48261 bp, Homo sapiens
ggtccgggccgcaggcccgctgcggcggactgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaaggtaggggggcgctcgtggcgggcggcggctgcttcacctgcgcgggtcgcgcggcgcgcggcggccggaggtgccgaggtgggtggggctcgcgggccccccggtgtgagcccggctctgggtctgcggtgccccgggcccagggacctggccccctgggtagaggaggtgctcggcggccccgccagctccccacactcgggagcgacagaattggaagcgcgagcgagggcgggcgcgggactcttctctccagtctcacggaatcccagtggttgtaggtgttggaaactttacttaagatgtttcagctctgcctgtgcctcctcaaaaggaaaggacgagcttagggcgagtgcgggcgagaccgtgacacttcctggctcaggaagttgaatttcattaagcctttgtggtttggggctctgctgtgctttgacagctctgatctcctcccttccggctgggctgtctggggcgctctaaaatgagtgttgatttaatgcactgccttcgcacccgtgctggtgataacttctaatgtgatttttttttcggtcattcattacttgtctaccgaccgaggcagtgcctccctcttagggaattatctgtcaaagagcgcattctccttgtttggcaggtagtcccaaagggcggttgtcaccagcgtctcagcgcagggagacattttcagcttggctgctgcctcgcaggcactggaaccgacggccctacctgagccactcccgggttatgcggagcctggtgtcgcctgggagaaaagggtggggaccagactatgactcagaaggaatgctgatgtcacattcgagtgaattgccctgtgcgaaagttctcctcgttccaggggatttgctcatgttttactttgtggtaaatttaagctagctgtcccttatcaaatagagaagttttgcagagagaggaagggaaaaatacagaaaacagtttttgtttttctcatactcatggttcctaatattttatcttctaaacacaaagtttttgacttgagcattaattctattttatgcccagaactggatttttgaaaatggatacaaaatattgtgttaggactgcagagttttcggttaggaagctattgaccaataaaaactcgaaatgagaaaacagtttttttcattccttgcgactaaaattctcaggcactcaaaaaggtatccaagaacagaaaaacataaattgttaatggtagcgtgattgcattctattctcttcccatttggtttctttctttttttcttttaaataactgtaatatttttggttaatcttgcttgtcatgggggaaaagcggggaaagcattttgcccgcttagctttctgttgatgaatactactctcatttagttttcaagtaggtaagagctacttaatttagtacttgtctaaaacttggggggtcttgtccttgcttttaagtatttatttgaagacaactttgcaaaagtaaacatattttgggctgccgaggatgaacaggtgaagcacaggatttttagggtaatgacactattctgtatgatactataaaatggctgatacatgtaattatacattaatcaaaatccatagaatgtagaacaccaagagtaaaccctaatgtaaactatgtatgttggggataatgatgtgtcaatgtgtttcatcacttgtaacaaatgtactgcactgatacgggttgttggtagtccgggaggctgctggagacaggaaggcatgggggaggtacatgggaacttcgaattttctgctcaattttgctgtgaagctaaaaaatgctttaaaaataaagtctgtttaatagggggagaaaaatcaaagacatttttgaaactttttgagacaaggagtaattctgagggaagaagttcaaacttaaaaattgtatatgcttgcaaaggaaaaatccagacgttgtttataaacaatttccttagagtttgaaaatgtggattatgataaataatgcccttgacatatggtgtaattttcctcgtttatcccccactttacttttaaaagttatattttcaaccaagaatcttaactttctctaatcctcctcttctccgcctctaccaccccagaaagaattccataaattaaaggttttagagagaatcccatgatataacaaatccctgtttcactacgttgtcttcactgatgattcttagaatcctcaactggtaaattggaagctattaaaaaaccgcagagatgtcccgtatgactccaatttgtgagtcccttaataggcttgatagtctaacaaaaagtttcccagtacaaaatttggaaatctcaggaatgtatttcacaatcttagccatactctcaaaaagaaatttatgttccttttagcaattgttttctaacacgtccaaagaaggaaatattacaagactatctgatttaccagcagagtcctcaccctattttggtacctagttttcaagtctcctttctttttgactcagttattcaagaaaatttatagtttgaatgtaccttgagaaaaggaagattaaaagttggaacaaagatacaaccatttaaatacaactaatatgacttctgttttaagatgtatgacattttttccttctaaaacttttacattgttgatttcatgaggaatttcttccagacagatgaaaagcatcattgttccacattaacatttcatgtaaaaagaattaaggaggactgtctttattaaacagtgattgagatagatgatactattataaaattcttggtttgtaaaaggaaagctcgtccacatcagttgtacaaattgggattaattaccagttaaaacccaccatcacaaagacaaggggtttttataattagattttgctatattttgttttgtttgaagaaagcgagctgttgctaggatgtgggagctagtttggttatacaaagtttttgttttaataatactttagaacagaattgattctatgtccttgccctgtcttctgagttacacatctagacctctttcttattttttaagtctcatcttaattggctttgtgtcagtatggtccatgtctgcttgggaaaaacagtggactttgagaagcagaaacagtctcattttgcggtgaatggtaaatcatggccaacagccagctgttttcctctttcctttctgtgttactctcccatgagaaatattttttttcaattaagaacataccaacagagaaagagaactacaataatttcccttttactgcctggaattgctgcagggctttttcattttaccgtgttcattttttctctcctctaacccctttattttgattaatcctaatattttgcatacttttcttaagactcttatttctttaattttactttttaaaaatatgatgcattttaaagattacatgttactaaaaatcccctttctctgtatccaaacttgttttcaaaacctttgtcattagccaaaaaagcatagtgaaaccaaatgaatactattggaaaaaggactaaactacaaagattatttccattggaaattagaatgagttatttgccttaggtagcccctggttgaagtggaaaaggcaatatatggtgacctggatgctcaaatctacaattgcattccaggcttgaagccattcttgctgcaagaaccattggcaagactaagggtaaaggtagggcaaggcacatccagggctttgctttagaggtgttctgcctctctgaacaagtgcagaagaaaatgagtggtcctcggccaggcttttataaaactattctaacccatggtgtgattcattacattggtagaatatgaaaagtccctttctcttaattgtcctgaatattggttggagaaaaaaactatagtaggttttctattgattctgttcctttatgctgtcctatgaagtagaaataggaatttatattgctactggctattacctatgtcccatcaactcaccctatgactttgcttgtgcatgcccatactccatctacagttctaaattttttccatccttcaaggaccaacccttcacactgcacactcctctaggaaatctttctccatgctgccacctagatgaaaaatattttctccttttctcctgaattcccaaaacatgttattggtaacacttaggacactaatcactctccacctctggattatacttatctgttgtatgtttcaccttcttaccttgcttacaaacttcttgagagatgaatccatatcctgttacacttacgtggttattttgtttgctgttcaaagcaaccttaggaagtaggccttagccccattttcaggatgaagaaactaaaagtttagatagcgtaatctgaaaccttactatagagaactttactatgaacttgaaccataatttgaagaatccatgctgcttccatcatgccaactaggccgagtcttatattcttcatcttgctcactaaatatatgtggaatgataactgttataaaaagagaaataaaataaggtacatttcaacactttcactcattttttaaaggaattatatttgaggaagtggtttatattccaataaaatcaccatcctgctagttttctatattttgtttctactttgtccatgttgtatgtattccctttagtgtaagttgccattgacattctttgggcagaggcaaagtatacgaaaagtaaaagtattgtgaaaaggagtttctgggaaacttctacagtcaaagaaatagcataaactccaataatattctgtaccttatcttctaagattctcccaacttcctgacttttggtgtgagccaatggtaatgctgtctcctaactatgtaaaatggccctaggtaacagtgaccctgtatttggctctttgttttgttaagtttaaccaatggcatctggaactataaagggatgctcgtggtcttttctcgtgttgagctctgcagttgagagaaagccttacacatagcatgagtaggctaaacctcttttcccttgtagcaaagtgttcagagtgcctctggagtggcagaccagacagctaagaatggagcagctaaaaagaaacaaaaaacaaacaaaaaacctcttaatattgggagaactatttttttgttttaatttcccattcttcatgcaaaaacatttcttatgaagctgagaagctgtgggaaacaccaaaatgatcagatatttcatgaggctctcatggagctccagagtgacatccagcattgttagcatgcgatcaacatcatagaccatcagtgtgcaacacgagttaccaagaggggctttcttagtggaaagagagtgataaattggtaacatggaagctacttcctgtgttctttttctgagaactagaagaaggaatacaagttggccccatgctaatgtgtatataccttttttacataccaatcactagtgtgtttagaaattaggaaaggtcagtaagtctccagtatatataaacatctatagtgtatggaaaggtcttccatagtgtatccgttttctcacttccatttatcagtataatatatttaaaattgccctaagctgagagttggtagatccgagtccactattttttgtgatattaaccactttggctatcaatttctatttatataaaaatcagtaggggaaccagatgatttctgaggtttctccaagtcctgtgactctttgatcgtgggaaataatatcagtagtctaccatgtgtaatgttccacagtgctttaaaatcacacaaatgaagaacatatatgtataaatatatacataaaggagatggcatagtttaaatgttagtgaattccatgaagaacctatagattgaaccaaataatttttttccacaaatcttagctattttcaacttgtttgtacttaattttcataatatttgtggaggtatttgaagatattaggttaagtttaattaatttaaatctgtagtataaggctctgaaggctgtaatagtgtgggtcccataagtctaggagtgatgtattacttaccttggtatttaattatgggaaaatgaaaaataatggaacatttattttctttaaaagttatctctctcaaaataaggctgttaaaataattttaaaagattaaaaaaaaactatatgagtgcttttttacgtaccatgcactgttctagactctggggttatagttgtgaacaagaatgacactgaacttaagcttgtatcatagaattatgctattgcaagtgttgatagagcaatgtaaatattgaaagtaagcacaactggaattatacccgtcagtgaactcttgataggttagcagtacgctatgtttctaacacagacagtgagcaattttgatggtgatccctgggcttgattcttggttttgcaaactttgtaattagggattcttatttcatttgtcttaagtaatagcaaatgtaaaagatgggaaaatgagaaagcagcttttatgtattagaatgtgaaaaagattatgaatgcataaagctatacaaatagacttacacctataatatacacaaactataagtcttctccctgcctacaaatgccttacaaaagagtcattcttggatttcctgtttgcagtcatagctaatttttgtttggtaactactgccatggtaaccaaaattatgattttaaaagaattgtttattaaatcattaatatacaggaaattattttactttttacaaggtggtggtatccagagaaattatattattaattatgaaatcaactttttctaggagaggaagataaggaaacaaaagactaatcaaaaacattgcaaaactgcagattttcaggattttaaagaaaaataatttggtaattgataacttcactactgttctttgagtaaatatccatgtttaaaatttgcctcaagcactattagaggattaaatttagaggttatgcttttcaactgcccaactacaatctttgactctcctacaaaagagctgccatttagcatggttttgtcaattttcagttctaagtgccctgtctacctaacattctagttagataatggggaattagagcgataaggatatgcatgactataattttctaagtatcactgtatttattttggtcaaattcaaaaaagtaaaaaagcatagtttagaattgccaatttctctgttccttagtctgttagaatggtggggagtcggctcagatttgagcatggcttaaagtgggagagcgttattagaagccagcctagtggggattgctgagatctcatctgctgaatgacagcaaagttactactctgtaaatatacttaatctgaaatgctgaattatcctcaaaccatgagtgattcagcttgtgtttatcattgtgacattctggccactgtgaaaagctgtaaacaggagtttcagggtgttcattgcatagcttatctgagcagcgagcccagcagaaaagatggcattcagcccagcagaaatgccttgataaggagtccattaatgcatctctagccacaatgaacttttcccttgctttgtttgatgataaagtgatatcatgtttcattgaaaaatgaccatgtagatgttaggtggatttttgtttttatatgaccacaacgtgacagtcttaacagaatgagtcacaaagtaaggatcaaggatctgatttttcctttatgagatactggcctacaataaaaataactgggggttaaaaaaattaccctttgtttttcgtagagaatattaaaagtgcagtttagatttaaaactacagactctaaactccatatctatcagtatcacctcttgagcaaaataccgatgtcacctttgatagatttttttttaaaaaaggaaggaagatgagtgagcaaaacagatgtgtaagttaactacagtgctggatagaatgacataagtgctataatacaatttcttatctgggatgaggaacctttttataaacaaaaattaatcattggttgatatttttaaaaacacaataaaaatttattacttaaaagacaaatacagggccaattaaaaaaattattaaatgcaagagacacaaaattactttaagtatatagtagttcctaattgcctactgtcagtttctctgcctatctcatcacagactagtgacttacactttgtgaactgccactttgagtagcacagcaataatagaaatacaaacaactgttatgaagtcttagaagcagaagtaactaactttaattgtgtgggttgcgattattttatcaaggaaacacctcctatagaataaagaagctttcattaggcaaagaaagcattccataaagaggaaatagcatgaaccaaaggtacctggctgtgaaaagtcagtaaaaccacccttgacattttcagttttgtctcttctaaaataaagctaaagtagatgagctgcagtaatttgtaatttttccacagtacaggtttgaattaaagaggtatgtcactgagctagtataagaccctagcccacagctgaagagtttctgatctcccttaactgtgatgattatttaatacattgtgtcatctattgagagagaggaggaaatttcacagtagagtctagctcatttaggctggtctggactctgagctgtggactgggaccacaatgttgccaggttttcatccttcttagatcagtgaagccaacagtaaaggtcatgcccaactgcaggagcaccttttaagcctcttcttatgccaaagcagtcacatgtccagttctgaagtcaaggagagaagtccagtctagcaactatgaggctagggcagggatatgatgttgaatactattacgtgggaatgaaggattgggaccattacttcagtctaccacgtgtgctatagagggacagttgaatgtaggggcttgaggatacttttctgaagatctttcatgtatcaagagtattctgagatgatattctgtatggtatcagactacacgtttcaaagcagagtagtttttggtcattctgaaaaactgtagaggaaagttaactttgcagtatcccttacttgatatttagggtttcctttttttaatctggtcactcttctgttagctttgaaacataggcctctccaaattcattccagccgggtcatgtgacttccgtgttaaacgaagacatgtaaaactcatttctttgggaaatggcaagttgcctaaggttttgaaggggaattacaaaatattaccttttatatactgcaacaaatggaaaatatattctgtgaacattccaataatatgtgttagactctatctttggtaatggaatagaaggttatcccaagataattggcagaatttaaaggtaaaaagaggcaagacagatttcagtggcctaactccacagctcttttaagatgtcccaggtaaaccagtagtgatgttattcattgttactttctcatggaccagataaaattaagccagagggtaggatcatcctgtggaccactgttgcccacttttctctaacagttagggaatttaaaggaagcagcgcagactttgacttttccagacatagatttggatcccacctttgatatttactcagtaatttggcaacagttgctccttggtttcagagatctaatctgcaaaacatggatagtacttctttattggattattgtgaaattaaataaagtagtacatgtaaatgtttagaacagtgcctgacatatagcaagtacctggtcagtgttattaatgttctctgatcagttttgtttagttagttagaccttagtaccaataagtaaacattttgagaaccagaactgcattaaagttgggtatcagctttagaaccctgggttcagtttttggccctggcgtttattagctgtgtgaatttgggaaagctacttagccctgtaaaccttagtatcctcatctgaaaatgggtttcaactgtctacctcacagggttgtaaggataatcgagatgaatatcttaaagcacaaagtatggtgcctacacatagacaataaacaaatgtgtggtaatcctcttcaagaaattcaatctagagggaagaaaatcctgcatagatcttcatgctatttaacagacacctgaatatattgtcaagaattttatgatggcatgctctcagtaaattattgccacttggtactttgttggacacaaatatccatttaaagttcgataactgggggatatattaaattactggatttaatatatccttttgctaatttaaaaatttaatatatttaatgtatccttttgctaatttaaaaattattctgatttatatttttataatgaaattaaaatttataaatatttctggaacttgagtacctaccatgtgccaatcgctatgcaaaggattcaaagctgggtatattaggttccctgagaaagcacttgattgaacactgcaacgtattgtggtcccgtatagggaattggtatgtttccctgattggaatcttcctcagagtttctgaggtaaattacagaaatggttactattctttgcagcacctcccattaaaaagtggagtctgttttccttccctttgaatctggactgctttctgacttacttggatcagtagaatgtggtagaagtggtgtgtgaatcctaagcttggacctcaagagaccttgcttgcttctattgctctgttgctgggatttaagtcttcacagcttcccacagtgaaagctgtggaaggagtcttacagaagactgtccccactctgaattactctcatattcctctgtacatctgaaagaatcaagaatcaatgtactgaaactgctctaatttcattggtggcttaagattgagcccactttctgctctagacgaatctgattttgatttttgtgcttgttgttccattaaagtgaaggaaaattaaattaacatgcaactgcaattttatcttagttgtaaataggtggtatatgcatattttgaaaattgtctgatttccttgaatcactagacaaattttaaatgatgtctgtgcaccttctttagtggtatagtctaaatatagagcaaaaagtatggtaatccaaaccacttctctgatacatcaaaagttaaaacatgggtcaaaaattagttaaggctctttgatttatgcagcacaacatatcaataaacagaattcttttttttccagaataagggatggtgtgaaaagggtatgcaataaataaataagcaagcatgaggacctggcagtagggttcttacatctctcccttcctttcctggtttccaagacccctctccttgctataagactttgtttttgttctaaatgcctgtgaatgctaatttggggcaaaagagaaaaacgagaagactgtctttttgcacccccttttctgttttctttgctgtctctgttgggcattactctctaggtttccttggatcctcctgctcctctgggcagcctccttcagtgaagccctcagccaatgccatgagccttttctttcattctccagtctgtgaaaacacatctgtactgccgtctttttctgcatgtgctccagttagatagttaaagaattagtggcaataaatcacttaattgtacagtcaatctactcatcccctcacccatgtattatgatgggttacccctgaagaaataataccatagcctttaggcatcgcaagaatgatcgcagtattcaagtttggggataaagagccttaattaagacctctcaaagcagctctctgtgggatccaccctttagaagcagctgtggagatagtgacacaagaccaaattaggaatggttgccatgatccagattcttttatggaactcctacagatgcgttttggaatcaggtttttaaagtcccttttatagcaaataaataggaggttttgagggctgtttatgagcgcattccattacagtgtctttcagcggagccagagctcagccaatcctaattaagaagcaatttcagctgcagtcattgcttattataataattgtgacatttttatagccctacattgtctttctcaaagtaacggattcaggaggagtccttttctgagtagagtccacagaagaggtattctattggtaagcatttcaaatgacttccttcatacagtagtataaaaataatttgatagcagtccgtttgaaaaatgtttataaggaaccagcttaaactgatcagatggaatatattttcatcagtcgcttacctgaaataagtacaaaccttttttattttttaaaaggggggcctaaatttcgctcctaataatattgtaaggttacatattaagtttcaaatagataagtagtactgtgagggaaggaactgctaactgtaaatactacctaatttgaatcaagtaattttggctcctgatgtcacatggaggtactgaaatttattttcttttacttaattccatctccaggtggatttatataatggaatttaaaagtttatgtaaatcttttccaatttttattctgtgttctttaaggatgactgtggcataatataaacattgcgaaaattttctcccaagtatatttggtattttaataatctggtttgcagctgtcttctgtaacacaagtgtgtgtgtatgtgtgtgtacccaagtgtgtgtaactatatattgagaaagaaaatgagacttagaggctaaaaatcatattctaccctgtcttctgaaagatcatttcctggttcttactgagtgaacaactaacaaattgaagggaataagtattaatgaggaaggaacaaagttctgctttagatgcccattgggtgaagagaatttaaatatttgaaatgggcaaaataaagagaagtggtagataagtaccccatatacccctgttcccctttataatatgtctgtctcgtcacaaatcacttagtctttggatttaaaatcaaaacagaaaagaggatatagtaggcagcatctaagatggttcccaattactcccacctactagtagtcacacccttacatattgccctgccattgaatgcaggctagcctgatcagttgccaaaaaatgaaatgtggcagaagcaatggcatcacttccgagattagggattacagcttctatcttgtggttctcttgctctctctgggatcacttgccctggggagaaccagctaccatgtcctgaggtacccatgtgggcaggcccatgtgagaaatcttagaagtgggtctctccctagtcgatccttgcagcccagctgaccccgattgcaaacttgtaagagaccgtaaacctgcccatctacctaagccacttccaaattcctgacacacacaaactatgacatgataaatcgtattttcaaaccctaagttttggggtagtttgcagcgaatacagaggtgttccattatgaatctagaaattcagtgatttgaaaaatttgaaaagaatgatattttgcttcattgccctgagtactgcataatgtatgtaatcttacatataatatagcagataatttttagtactagtcgtgtctacatgttttgagtaaacacctttcaattttgaaatataatttgttcatttgtatttcttgctcattcttttaattttttttttctcttgctgtaacattgaaagagacctattttgcgtcaggaccctggagatttttgttgactcacacctcattcttctgaggatccccttgtgtgtgaatttatcacctcggggacttccatgttagtgtagctgatgtgcagacattcagcttcctcataataagtcccaggttttgcctaggatggaggaattcctgcctagcaaacaatgagcagtctttaagatcaaaattgattactctagagaagttacagaagaggaatattaccctttacattactatttacctttttagtttcagtttggagggaaaaaaaaacagtgactttgtagtgagtgcatagagtttgagtgagaaatgccaagatgcaaatctcacttctgccacttgctagttgggtagtcttaggcaagttaatttctccaagtctcaatttcctttttatgaaatagggatgataatacttttccaataggttgttggggattaaatgtgatggttatatgtattttagctggcaggtagtaacattttaacaaacggtggttgaggtgtttttactaacacttccaccatcacaaccctcagtgctcattttttaaagtatagttaaaaacacttcaacatatcctgccaaaactaaaatttattattgtttcctagaatgtagcaggatctatttctgctcttcttcaaatatgttactgtatgtattgaggtatagatgttttgagtaatcagctacaacttgattacatctcaaactcaagtagagaaattgtcttgatgacaatacctttgtcattaacttaatactgttactgccttaagaaatgtagggatagattgagtaggaatcatccactttaatttgttaaagtcccagaaaacttgacgtactacctccagaatatattttattacaaaatatttaggcagaaagaacacttgtttccttttcattcctaacataatagtctatgtgattatttactgctgtctgtgaacaaaaaagatttctgaccatttggcttacagtggattttgtgatagagatgcatacagggcttctggctttatacatctaagctgaaaaggtgaggggatgtggaaatgaatcctagaatctgcagtaaatagttttattcctgtttccttatggatgagccatgttgacaactaaagacccttaactgattattctattcttgagctataatatttggtcttcagttaaaaattccattacattctatttttaaaactgatttaggaaatagggcttctttatcagggcgttccattttatgacctatcttgaggcactatttattggttaggagcagtcacagctctgtcccagtttcttcatgtggataaaaatgtgggtagtaatagtatctcagactctcataagattgttatgaggttaaaatgagataatccatgtaaaatacttagaaccctgcatggcagtgtaagtgctcaataaaaatcagctgctgcttttattatcaccaccccttccagtgtctttttgtgtgtgtgtaaaaaggcagtggaagttccttgggataaagatatgttatgataaagattgtttgataattaaaacaattaaataaataaaactttctagcactattgtaaatctcagacactggcaggtactaggagttcaaatatgaacaagaagctcacaatctaatgggggtaaattgatgtgcacacaatcataatatagtaaggaaggacttaataacacaatttgtgccaaggggatagttaaagaaaggtatcacagagttactgacattagaattgagtctgtgggcccagtagagacaacgactttggcagatggagaagaagaggagcagaggttcaagcaaagtgaaaagctccgcttaaaacagagagcggctggaggggagtggtgtgaggaaggcaggtggcgccaggctttaaaggatcttctttgcatgctaagaaaagtgaaattcattgaacttattaaaaccatctagcaaggggagtgttatgattatctttaggtttattaaaataattttgagaatagcaatacaacgtcatacaaaatgatcagttaggagagtgtggtctcaggatgatatgatgtgagtttgaacatgaacactcgagtgcagatgagggagcagactgtgtggtttttagaaaagagacactagaatttggagcatcgtaagcatggctagacaaggacaaggaggcctctgggccccaggttgggtgaccaagtgggtggtgacaactttgtcttcagtcttcttctcatgtatttcagccttgagtaagtgagagatgggaagtttttgtttttattagcaaagaaagagaaatgtagcagatttattaagaatgactaattgtagctcttaatcacactagttctttgtattcttacctaagaaagttggcaaactaataaaatgtgcaactatttttatatttaagtttggttttctgtgtaacctacactttttattttatttatttatttatttatttatttatttatttatttatttattggagatggagtctcactctgtcacccaggctggagtgcatggcgtgatctcagctcactgcaacctctgtcccctgagttcaagcgattctcctgcctcagcctcccgagtagctgggattacaggcatctatcaccgcgcccggctattttttgtattttttttttttagtagaaacggggtttcaccatcttggccaggctggtcttgaactcttgacctcatgatccacccgcctcagcctcccaaattgctgggattacaggcatgagccaccgtgtctggccaacctacacttttttggtaatgcaaatcttgttagagatttggaaacaggcaatgaactaaaacgttcaaattttaaatcttgtgtcagatcttaataaaaatatattgattgggtgggggacttcacagatcacactggatttctaagagagccatttgctaagaggaattatttagatatgtagttcctttgtccagaatatttatctggatgaacaaaatctaaaatgcttctttaggagtgtaatatgaatatatgtgtgtgtatatatacatgcatatgtgtgtgtatatatgataggtggataaacatgcatgcacacacacactgagaaagcgggagtgggagagagagatgtatatttcatatgatctaccttcattccaatattattaaagaagtcttagtaatgcttgtttagtaaccacataggattctttactccagagggaaatttggttatgaaaacagcatgaatcagatgatctcaccctgaatactgcataatatcttccagacccaaattgtctccagatcaactcagaccatgtttgaaataccagatgttccatagtcttttttttgtttttttttttttgtttttttttaagtatctgacatgcagtacctttttctgggtcagaagggtcacctgaaatgttgccaacctattcgactgctgaaaattatgaatatggatacattgattccattcccatttcttattctaaaataagcaggggataaaagggtgtttggaggcacagatcatgggaatgtaaattcagtttatggagcctgcagttaaagatacttaagacctatttgtctatgattcgtgtttcacagtaaaattatgtagtcacttttatttttttcttaggaccttgatagatagtcccaaagcctgactgtaatttctcccaatatagtcaatccaaaggacctgttttcttggacgctgaagaagaaaaattattctgtcatatccttttattgatgctggccagaatgtgttactaaaattatatgaagtagacagctttgagacttgtgcgcttatgaaaaacatgtgtttttaggcactaagtgttgagtctgcagggaataccgtatcacatttactgttgaaattatgttaaaataattacgtgcaacaggactgagttttatcattcacagcttaagtcttttgtttcctatgcatactttataaaactactccaccagagttacaagtgattctgacttctgagagtcattaatatattagctttttcaaataattattttctatttagtgattaaactttgagcagatgaccatgctgaataataaccaaactaagacacagttaatctgacacatgatttgcaataaaattaaaaggtatcttggagccaatctagtttaatttcctcattatctagatgaagcctaaagaagaaagatcactttcaaaatccctgaacacgccagtgacactctgtgaccagaacacaggtttcctgactctcctccagggatctttctacattttcaaagttccccgttagctctctagtatctataactatatatatatatatatatatatatatatatatataatcatttccttaatatttggtaattctcacaacatagatatgacatacaggtacacctatcttggttatatttgtccaagggtctagatttcactttctaaacagctagttcgccttagctgaggagctaagcctctctgggctcaccttcctccctgccactctctctcgcaccctgggcatcattaaataacaccttccctatttatatccctcaccaagagttctccagcccagacatctgtagacatcttgtaggcagaaactaacctacaagatttggatgtccaagaatagtcatagccttggctcttcaggaaaggagaagaacactaaggagaaggtgtggtctatgctgagggtaaagagaagagatgagaagaattctgggtcctggacttcagggaatcctgaatacaaagtgaataatggagagaaattagagaagcccttagagtagatggggttccaaatccttgaactgaaaccaagaggagttgaggaacctcagttcttgtgacactctgcccaaaataggccctaagaaactgtacttggggcagttctggctgtgaaactccttttaccacagattagagtccatatgcttcccttcatctgatatgcatttgacttatgaaggggagaatagcagatgattagatgcctcagttggaagaaatttgcctcacactggtagaggtatgtctgctactgtgtaattttataatataaattggatttaacaactgcattctaaattataattcaatctgaaactaggcacatcctaaacaaggaaaatgctagagtgtgaatcacgtatcttctttcttggaaaggcattgtttttgtttcctaacagagggttgataaagaggataaaaatatggaaaaagttctcacccaataatgtggcataagtcagagatcttcagtgctggtatcaatgagatttaagttttgtagctatatacttatagctataaaataaatttcttactgaaatgttctcaggaaaacaagtttattgccagtctgaaactctaatttctctagctgctaaaagtgattttgaaaacttggtgtcatttttgtttgtgtttggtgtgtgtgtttgtttttaattaggactgcttccattgggttatagtaggagaaagtgtatcatattgccgtgacccattccactctctttcacttacttgctctctgtctgtgatgtttaaaagttccctcacacttaggtctgagcatgtggggaaaatgaaagtgtttgtgtttggaaaggtagaggggcactttttccaggcagtcacaaatctaactggaaagagtccataaagagattaagttggccttccaggcaggtcccaagggcaaaagaaccctggaacaatactttctgggttttccagagcggcctacagagccaatttctcaagttactgcttttcccaaggcctggtctcctggtccctgtgagggcttcctgagcttctgctagcagagcttgagaggtgctcttgctcctcaccctcccctgttgccctgtggctttcctctttaccagtctctcctgtctctgaggatgtcatcctctgttaagctggtagcctaagacatggcattgaatgcttcaagaggtttagtttcttccttgggaaaatgaaaaggaaaacaaaacaaagtactccgcctgctacaaggccagccctgtcactctgaaagtgctttacaattttttggctcttcctttgccctcttctgccacaggccttgtgtatggtgtttcctctgccctgaatgcacttctctgagccaaattagatactgctcagcctttccattgtaattcatgcacctctccttcagcgaagcttccccagccttccttatttatcttgtcttcctttttaaagctctcagaaagtcatctacacttagagatggtgcaagagtgtttctggaaaagaaagttcttttctttggggcagaaattagctagtgactctttggaagacaagagctcccatttgacacgctagtcctctgccccaaaagaacagtagagcaggagccagatgctgagttttaggtctggtttgctattgagtagctgtgcaaccaggagcaaattatccctcctctctggattctattttcctgatctcttacatgagggagatgcctagtcctgtccagaataagaatatgtgggagactttaaaagagcagcagttcatgaaataccaccagctctagtaattctaataaataaaatgatagctattttaagaatatattgatgaaaagtgtcaaactctgtaaaagtatttgaagatcttattctgagccaaatatgagtgatcaatggcctatgacacagccctgaggagactctgagaacatgtgcccaaggtggtcaggctacaacttggttttatacatattacagacatccgtcaatacatgaaagatgtacattgcttcagtctggaaagacaggaccactggaggtggggggcggtccttccaggtcatgggcagattcacagattttctgattggtgattagttgaaagccttattatctaaagacctgaaatccaaaaaaaggaatgtctgggttatgataagggggcttgtaaggaccaaggttttatcatgtagatgaagcctcctggtagcaggtgtcagagagaatagattgtcaatgtttcttatcagagtctgttctgtcagtcttaggtctctgtgtttctgctaatgctggtcagctgtgaagcagcgcccacccacccccagctccccatttcctatcatggcctgaactagtttttcaggctcactttggaatgaccttggccaagaggtggggtccattcagatgcttcatgggtttataattttatttttgatttacaaagataaaaagttggtaggagaaaacaacttgcccctttgcaaagttgactttgtaagtcagtagcgagctactccaaagccttagtgtaaaaactgctgactcatggaggttctagttacatttgctgaactttcaagttggattcagaaatagtgaatgagatggtattgttccaggatgtttgcagtcttttataagcccagtgttgttcagaccaggcaattccaatctgaaggcatgcaagaatttaagtggccatttaatttagaggcagaagcatatttctagatattatctgtccacaaatatcaggattttatacacacatgtaagtttgtatgtgtatgtgcaagttctttgtcatgaggtaaaatttattccatgttgtgaattatataaaagagagtttaaaagcctctgatttaagctaagctatgtgattaagccttaataatgtaatcaaaattttcatttgggattagagtttatttagcaggagatgcatgaacatagtatgaatcatatccatactccaggcacattcagaactaactcttctgtaatggaaaattagaaagggcctgaaaaagaaaacttttttggatttgcttttcattttactatggatattgtaatggagaaaacatgtaactatgcttattacacaagaccagaaaagtttccctctgtcttttgtttaacctacattatttccatactgtgtgaactgtgatcatcagtgacaaggaaacaatttaattgctttaaaaaaaagcttagtgttgacactaaatatacaatttaaagactttcatttcttttgaaaattggtaatatggacatggcaaagatgataaagcttagctaatgctggacagttgtttattctttagagagtatactttatatggtctaacttaaaagtattgtgggttttcctaagcaactgtgtggaccagttgggtttgaatatggccttaattatggaaaaaggatgtggtcattttctttaggacaaaaggaaaggcttcacttaaacttcaggacatgtcagactgatctttcaaggaaccagttacaatgtggttttgattgcatagtgacaaacacagcttggtaaagttacaaaagagggccattgaaaaatacctattacttgtccagcttgaactgctactctaggcactaaccagtaactaattcctcatggtcactgatgtgatatttaaaacacagagtaatctgattactggtggtttgccactgtactgatgtaaggctggctactcttttttttccaatatcagtcgttgggtaaaagagcttaattacaaccttgtgtccttctgccatctgcaccccactccttccacttattaggccatgtctcagcaagttctcaaagactattgtttaatatggtaaagaagaaaagggtttgctatagcaagggtgataatacagctctccactccttgcctccctacaacttcaggcagaagagcacaggccttggagtcagaaagacttgaactcaaatctctaccatttattaacattttgatcttaagcaagtttcatagtctctgagtttcagcaaaaacatttcaaaaatggcaaatcatattgcctactttgtaagcattttatatagttctgtaagattttaatgagatataagtaaagtacttacctctattccttgtgtcttagtctattcctgctgccataacaaaataccttagactgggtaatttataaataatagaaatttatttgtcaagttctggaggctgggaagttcaaaatcaaggcactggcagactcagtgtctagtgtgggcttgctttctgcttccaagatggcaccttgttgctgcatcttcacatggaggaaggttcagaagagatggaagagaggaactcactccctcaggggctaatcccatcaatgagggtggagccctcattgctaactgcctaatcatttcataaaggcccagcttcttaatattggtacattggggattaagttgcaacatgaattttggaggagcacggacattaaagccatagcactggcattcaataagtgtatattgtagctattataataatatttatcataataaaaataatatttcagttgtaattcctaaaatctttaattccttgtttgatgtaaaatatgttattcaggatgagacttgctttttaaggtatagttttctgagtgttgtacctattgtgctatggggctgtactatggggcaagtagtggccaaagacataaattcatgagtttttgttatttgcaatatttgtagttttctatacagttatattctgatgcttttcttttcatgataaaaagcaatcagaatataaaatatgttatgtatgtacttggaactgccatgtacatacctgggtatcatcattgactaaatataagatttgtttgaaagttatctcaacacaagtggtaagtggaattaaaagtgcaatttattgaatttttagatttgtaaagaatctaataacagattcatgatgttttctttttaacagatgggcttaggtcacgagcaaggatttggagccccttgtttaaaatgcaaagaaaaatgtgaaggattcgaactgcacttctggaggtattgttttgaaaactgcaaccacattagtaatttatactttttgcaatacttcctcagacagtggagatatcttcgagttctccagcatggttgctaagttgcagacctgttactgtcttttctgagaaatgaatacaacataaaaagtgttctgtcttactgtcattaagtttgacttagtgaattggaccataataactatttagagttgttggatttgcttgctgtctttaagatttccttcgagcctgaaatactgaatatatcatctttctggtggtaaataagtttgtggtaatcctccaggactgtttaataatttatttgttactttttttttgagacgaagtctcattctgtcacctagactggagtgcagtggtgtgatctcagctcactgcaacctccgcttcctggttcaagcgattctcttgccttagcctcctgaatagctgagattacaggcttgtgccacgacacctggctaatttttcttttttgtattcttagtagagatggggtttcgccatgttggcaaggctggtctcaaactcctgacctcaagtgatcagcccacctcaacctcccaaagtgctgggattacaggcgtgagccaccatgcctggccctgtttaataatttaattattctcttcttaaaaattggtaactttacatctcatgtctacattttccgtaaacaaatatgaatactgaatcaagcatgtatatgttagttatcaggaaatgaagttgaatttagatctctttaaaatttttagctgtaaagttactagtgaaaaaccattgaaacacttgaatttttttaagaaaaaaattaattgtagtgtcttggtttgaatgaagtgcatatatacacaagacaatgttagtgagtcaaaaatgtgaattttctatagatcttatctttaggttgttttgaaagtactactgcatatcatataaatctaaaatcagtatttgaaacctgtgcttatgaatgactgtcaagtccatagtggtaattcacaagtctgctcaaagttagaattagcaggaaaaaaaaataaagataactatacagttttaggatggcagctaccttgttaggatgactctcatttgagaaacacttctgtactacagatttccacaggaaaccgtttagaatactttcatcagctcttggagatgtgtacagtgtaaattaaaggagaatataaacaaataaaattttagacattaatctcttttaaaaactagtttattgaatcagttttcagaaacaaagataattgtttaaaataggaaagtcagtagaaacctgctagaactgatacagttcttcagttttgatacaattcttcagttttagggagctaaagttttccagaatttttttttacaagacttaagcagctctcccttgtgctgtctcttcaagggacatagaagtggcagtatgtctctcatgttttaaaaaggtaaagtgacttaacacaaaatagttttcatgaattagaacatctctgctcttaatgctcacactattttctattgggcctattagttaactttacagaaggctgcactgccctctcctgggcatagtttttaccttacaatcttataatacataaaatccaaaatccaaaatgctccaaaaccaaaacttcttgagtgtcaacacgatgccacaagtggaaaatttcacatacctgaccgtgtgacaggttgcattcaaaaatgcattcaaacctttgtgtcttgtacaaaattatttaaaatatgtataaaattaccatcagcttatgtacataagctgtatatgaaacagaaattaattttatgtttaaacttgggccctatccccaagatatctcattgtttatgcagatattccaaaatttaaaaaaaatttgaaatctgatacacttctgttttattttacttgtgaaacattttgggtaagagatacttaacctgcattctttttagttctgctatgcagttgccaaaaaccgctcgtgagattttaaagctcattcctaagagatatcatcttttctctaaagcaagttagtcatttttgttatgtctatattaatcattttaatcgatattttcagatgaaaatatatccgacaagagcagatctccatggcatgaaaataaccttttacatttcaatttatcacacagactcatttaatcaactgggtgtagtctgaaaatctaagagccataatagtctaggactttgcatatggcctgtcattcagctggggttgataacagtccaccccattggtatttcttagtagttctgacatcttcctggcatgggtccagtcacatttctctcagaattcttgataattccctgactttttcaccatagctaaaagagctgaagcaggtgcctttgacctccctatgtagcctctttcagtacagtctttgaagtaaaatattctagactagttgtcctgagtgtaacaaagattccaggtctagtctagggccacagaacttatgtgggtgaagtagacatgggatcccatgaccctgcccacttagcctcctcctccagcttcatggtgatccttgacttaggaccctgagggctccatcgggcacatttcaaaaatcagagttaaattattctctacctctttattagtctggcctctcacacaatcacaagaatggtcttttgaacatggatactattacatacttcagatgacttaagaaccctcagtagtttcccactggacttcttttaggcaaatttcttggcctttgacattaaaccctaacatctggcctctgcttgcttttccagcctcttccacttcccttccaagcactctatgatccaagtgcttgatacatactattccctgaaattttgtgccttattgcatggtgttctctgcctggaaaaccctacctcccaccactaggaaacaaaaagtctcagctcaagaaatacctctgagaagtcttccctgcccatgtatgtcttttcaggctgccataacaaaatatcacatacctggtagtttaaacagaaatgtactttcttccagttctagaggctggaaagttcgagatcaggtgccaacatggttgagttctggtgaggtctctcttcctggcttacagacggctgccttctcaccacgtgctcacatggcctttccttggtgtgtgtgggtgtgtgtgtgtgtgtctggagaggaagagatctctctcccttttcttataaggtcacctattccaatggattgtgacgttcaccttgtgacatcttttaactttacttcttaaaagcccctgctccaaatacagtcacattaggagtttgagcttcagcatatgactttgaggaaacacagttcagcccacagcacccccttcccctgcttccacatacccccaagttgttaggaatcattttcctttttatcaccttgtatacttacagaaagccaggagataaatacccagacctcattcttcatcactctgattttctgctggcacctcccattgtcccattgccagtgacaagggatcccacaggtgtagtccttaaggatcagccttctgggaaatagcacagagtactgaggcatggagaatgaatctggagaggtgaatggaagatgccggatcaaggtgtatcaccatagttgcaggagactaaaaattaattattaggaatttagagtgaacttgtaacttaactagtctaacctcattttacagatcaaagacctaaaccaaaggaagttaaaatgacttgtttgagcccatgagttattaataatataatttgtgaatgatttctatgtgtcacacaccagtaagcacttgtaataattttctactgctgcataacaaattactacaaactttgcaagttaaagcaacaactgttaactcaacatccatcattattattattattattattattattatttttgagatggggtttcacccttgttgcccaggctggagtgcaatggtgcgatctcggctcactgcaacctctgcctcctaggttcaagtgattctcctgcctgcctcccgagtatctgggattacaggcgcccgccaccacgcccagctaattttttctatttttagtagagacggggtttcaccatgttggccaggctggtctcaaacccctgacctcagcagatccaccagcctcagcctcccaaagtgctgggattacagacatgagccactgtgcccagccaacatccattatttttcaggttagaagtctgggataggggagctggcttagctgtctatgcttagcacctcaaaaagctgaaatgaaggtgttggccaggctaaaagtactcacctttaagtgcgagggaagaatctgctttcaagctcattcttgttggtagaatctattttctgtggttggagaaccaaggtccctgtttccttgttggctgtcagctgggggctggctactctcagcttctagaaaccagtcacattcattgaggtacaatgccttccatcttcaaagccagcaccactgcttagaatccttcctgcacctcacatgcctccaacttcctcttctgctgcgagccagagaaaattcattgctttttaagggctcacatgattagagtaggcacgcctggaaaatctcccatttgccatataaaagtaacataatcatgaaagtaacaccaggggacagaagtcataggggccatgttaacattctgcttaccacagcactgtatgtacctgattgtacctaatcctcctaatatttattttattatgtatgagaaatcaaagacgtaggaaagttaaataacttactaaagttatggcttatagatggcagagctgaatttgaactcagagttttccaaaacctttctccatggcagagtagatattagaatgcacatttttcactctcagggccagtgaactttgaactgcaccaggctgtcgcctctgaagtgtgattgttgtgacacagacatccttgtggacaaaggtgtacttttactgtgagctctctcctttttcagtgtgcccatgattacaacagtagaggaaaataaaaggttcaggaagcctaataatgacccaataagaaacactatctgctgggaatgctttcaagtaatatatagagataaagagtgtttattgaaatgtatgacacagacccaaggtttccaggagtttatagccagttatttcacattgaaggtataattaatataattgcaaccatgtcatttatcatattaagtaacagaattattgttttgctttacctttgttaaagtctcctaataaaacagttgcattttattaaaaatgcgttacttgattataacatacatctgttcagaatttctgattgatttagagctgggtgaaaactaaaaattccctaccataaatggattaatacttgtgttgaattctgtcacagaggcccacacttaaatccatatatgtatatccctgttacaaaagggcagcttccaacccttttaaattatggtttgtagcaatgccatggccgtgcttttaaatcactgtgaatgctggcagcatgtcaaagcactctagtttctactgcttgccttggaaaaatagtaagttttacaaatagtgatacaaaaaaatttcttttgggagaataaaggatagtttcttgatttttttcagcttgaaaatgtaaatatgtttatttgtctgaggcaatacttttggtagttttgttcttgcattcgctctcccaggctcgctctttctctctctctcactccttccctccccctcgctcctccctttcctccatacatattaatgtttgcatatatatgtgttaatggtgctaaattctttttgtacaaacaactttttatacaaataaccctcctccatccccacaccttagagcttcccaatctgccaatccacctttgcacctttttaaaagaatcatgaaaaagacttttaaactaacttaattctgaatccccttccctttttttccccatagaacttttcttaacatcctatggagaatctggagagagaactgctcaataggacagtttagaaaatttagaggtttgaaaactgtgttaaatatgggaactgatttatatactctcttaaaactatcaactcagtatagcacaaataaataaacaagctgtttaaatctatatatatcatcagaagttacttatggatcatctgatgaaagataatccacacaccgtgcaaacagccccttgcacatgggtattgtgctcacccatactctgtttgtgtttttgttttaggtttgtataaaaccacgtttttaaagttcttcattttcttaagggtagaatctgggttagtttaggctgaaattgaatatgtgataaacgtcccacttattctcaggccgctcttggataacaagatcacagtggcatccttttcttctccaattccacaacaaggtttttcttttaataaatgtattggattgcttccaaatgactttgaaagtttttataggtatttctaaaagtaaaatgttttagtttaaatgtgggagactcaaatataaaacactgtagattagaactctaagaaaaatatttttaaaacctaaaactaggtaagtggtaatagcacagatttccacaatagatagctcctggcacctggtgctgattttatagtatgttttcttgcagagtagtttgtagctggctcttctccttgtagaaatggagctccagtgtaaggcttctggaagggatgtggtcatcccaactgttttaatgatgacagctctagttgaagagccatcccacccttcttgggtcacattcttaccaaggactctgtcaccacaattcaccacattggaggatgcagatgaggcttttaatatagtcatgatttttaaaattataacaaatcaatcataggttttctctacttaggaaactgaaaattatatggcatagtatgacttcttaggtatttcttttttcttaccactagcgttattggtatgttgttttaacctgattttactcacttattaacaaaggtatgttgggtggttaaaggcattgatagaaaagcagaggcttcctgagattgtgaattcttctaattgtcaagacaaataataatttaaaaaaatacagagctggttcttctataattagtaaatttaactctttatatttaacactttcacagtaaatataacttttttaaccaagccacagctcaccatagtttattcatgcttcagaaatcatcaggctttatttcacttgtatcttttattatttatctttcagattctaaaatctgacccttattttgtggtattcatgttgtactggtgtagaacatagattgtaaaaatttccaaagtccagtgtttattatacggcctcgatcctttaagataccactttgctaattattgggatgcatgctgtagctcacagccatataaggatctatttagctatattaagaactaaattcccactccaccttcttcccccctcaggaaggtataattttaaacttgaaccaaaagcagtgtgatagttttataaataattacattgtttttgttaaccaaagagtaaaagtaaagaacatgctgtagtaggataacttgctgctttccactagatgggagtatgagataaccagatgttagaaagattattttatagctgaactagcatatgcaaattcttcaacaaattcttaccaaataaagatttctgactagtgtgcacaaggaaagcaatttgcctcttcaccacctatctctctctctctctctctctctctctctctgtctctgtctcggaatatacaagtcaaatctaatattttcagtttgcatactgaaaagtattttaagaaaattcagaatacaacaaactaaaatctataattaataatgtattatttggcaatgagatacatttgggtttttagttgttttttctgtttctgatgtagataaattccatgatttatattaattttaaatttagaaaacttagtaaattcttcttaatgctaattaatacattgcatttctctgtggtcatagcatctgtgaatagcaacagtttagtttttttctttctgatgaattcttgtaacttttcacactgctctgattagtaccttcagaaccatatgattagaattggtgatagcaaggttgctttcttgcttcacatcttaaaactaatgcagtaagtatgatctatgctgagtgtctgggtttgttccccccatgcctcatcctctaggaactctttctagaatagtttctatttccttttactagtttctgctattctctttattttccttccttttacttcaggcttattatgcctttttcctaacttcctgagttgaacacttagtactttattttttccttttttctaatttgagtgttttaaactataaattatttagttatctagttacttcaacatgcattcttagcctaattgtatctaatgttaatccatgtttatatagactgaacaatgtaagtatctttagaatgtgttttacaacactcagatcgccactcttattgttatgttgtcgttgccatgtatattgcttccagcttaaatttttaacaccactccctactcctctgtttttctctgtcaccttttccagcttcttttcctctactagactctttcttgagtccttactttttccctctacatttttgccaacaggcacagatgatctctttaactcatattcattatatattgttccctgaccaccaaatttatatttcctaccaggctacagtttttaacatgagagttatagatcctacactctgtgatatctttaccttgtctcacaggcatatcaaatttatcagtggtttcattttggagacttccatcaaccttccccactccatactgcaaaactgttcatcttttgaatatactatcttaataaattatattcattctactaatttactcatcccagaaacttggttttatttttcaagagactgagtgtattagtctgctctcagttagtcaagacatacccaagactgggtaatttataaaggaaagagctttaattgactcacagttcagcatggctgggaagtcctcaggaaacttacaattgtggcaaaagaggaagcaaacacatccttcttcacatggtggcagcaagaagtgcctagcaaaagggagaaaagccccttataaaaccattagctctcatgagaactcactcaccatcacgagaacagcatgagggtaacaggccccatgattcagttacctcccaccatgtccctcccacaacacgtggggattatgggaaatacaattcaagatgagatttgggtggggacacagccaaaccatatcattctgccccagcccctcccaaatctcatgtcctcacatttcaaaacacaattatgcccttccaacagtcccccaaagtcttaactcactccagcattaactcaaaagtccaagtccaaagtctcatctgagaccaggcaagtcccttctgcctgtgagccagtaaaattaaaagcaagttagttacttcctagatacaatgagggtacaggcattgggtaaatacagccattccaaatgggagaaattggccaaaagaaaggggctacaggccctatgggagatcaaaatccaatagggcagtcattaaacgttaaaattccaaaatgtcctttgacttcatgtctcacatccagggtgtgctaatgcaaaaaaggtgggttcccatggccttgggcaactccgcccctgtggctttgcaaggtacagtcccactcccagctgctttcattggctggcattgagtgcctgcagctgtccttggatctcccattctggggtctggaggatggtggccctcttctcacagctccactaggcagtgcccttgtggggactctgtgtgggggctccaaccccacatttcccttccacactaccctagcagtggttctccatgagggctctgcccctgcaataaacttctgcttggacattcaggcattttcatacatcctctgaaatctaggcagaggttcccaaacatcagttgttgtcttctgcatacctgcaggaccaacaccgtatggaagctgccaaggcttggggcttgcaccctctgaagcaatgggccaagctataccttggccccttttagccaccactggagctgaagaagctgggatgcagggcagcatgtcccaaggctgcacagagcaagggatccctgggcgtggtccacgacagcatttttccctcctaggcctccaggcctgtgatgggaggggctgctgtgaagctctctgacatgccctggagacattttctccattgtcttggtgattaacatccgggcaccttgttacttatgcaaatttctgcagcgggcttgaatccctccccagaaaataactttttcttttgtatcgcattgtcaggctgcaaatttttcaaacttttatcctccgtcacctcttgaatgctttgctgcttaaaaatttcttccaccagacaacctaaatcatctctctcaagttcaaagttttgcccctgcctacagattctagggcaggggcaaaatgccaccagtctctttgaatagccagagtggcctttacatcagctcccaacaagttcctcatctctatctgagaccacctcagcctggacttcattgtccatatcactatcagcattttggtaaaactcattcaacaagtctctaggaagttcgaaactttcccacatcttcctgtcttctgagccctccaagtctctaggaatttccaaactttctcacatcaacctgtcttcttagccctccagactgttctaacctctagctattacccagttccaaaatcacttccacattttcaggtatccttatggcagcaccacaccctttaaagtaccagtttactgtatttattagtctattctcatggtgctaataaagacatacctgagactgagtaatttatttataaaggaaagagatttaattgacttacagttcagcatggctgaggaggcctcaggaaacttacaaacatggtggaacgcaaagcaaacatgttctttacattgtggcagcaaggagaagtgccgagcaaaaggggaaaaagtcccttataaaaccatcagctctcaagagaactcaatcactatcatgagaatagcatgagggtaacagccctcatgattcaattacctcctaccacatctctcccacaacacatggggattatgggaactacgattcaagatgaaatttgggtggggtcacagccaaaccatatcactgagccttccctttgccatcactatgtccaaataaaccactaagtttagtcagttttttgttcaaggagacctcaaatttcttcctttcttttcatctccactgttgaatactctaatccaagccatagcatattttacctggaccacaacaataaccctccaagatgtaaattccatttgtgaagtagtggcagcatcctgttatttagaaccatgccattgcaaactggatgcataattaacatgttagcttgtctccctattgccagttatgtttcacccctaatccatttaccacatggcagatattgtgatatttaaaattacagatctgatcattttattccattaccaaaaagcctttgctgcttcctgattgctcttatgatgaagcccaaattccttaatgtgttctatgagcccctgcatgacttcatgcctacctctccagtcttatcaccctcctattgactcatcttcctacagtcataccaacctcccctggttatgacacctaaggggacaatttctttcctaattcaggaccactgaaggtattcctctttatacccaatactagagacttttctttccttttctcctccccagatacacacccacatacacagtttacacctatgtttcatacatcgtccagatctcaacctaaatatcatcttcttatggggtcccttcttcacgagtttgaagtccaaattacaccctctcaagggaccctatactttctttcctatcacaaatgaaattttctctgtgtatgtgtgtgtgtgtgattatttaatgtctatctcccaccagagagtaagttctagaaatcagagactaggccccttttttttttttttttttttaagcactatgtcctagtgtcaagtacattgcttggcacatgggcactcgtgtatgttgcatgaatgaatgaatgtctgtgtgccagaccagagtgaagaagagaacattgtccttgaactataagaaacaccatgatggcagagagcacatggtaggtggcaataagtgtttgaagaaataaaataagggaaggaaagagaaaggaaaaacaaagggaaggaaatggagggcaaaagaaattgagaaaaaaatgagaaaggctgtaaacctaaatctaggattataatctttgatgggaaaagtttccctgtctctcactaaaaaaacaaacaaacaagaaaccttggataatagctataaaatgttaacatgcaataaagtacaaagcctcttgcttaaataaggaaacatataatttttgtggttttatttaattcatttctttttattatttattttattcactattgggtgacagcataaggaatatcagatggggttacactcagacatgtccctttaagtgtgcactttttaatcagtctttttttttaatggtacaattgaagatgtctattattggggccatcaccacttctttcagtgaattcattgaaaaaatcttggttggttttgataaaaatcaaatgaataattgcttctcgttatcatatcagaaatgcagatgcacgtttggttgacaaaacacactgaatttgttaaaatacttacttagaaaattcagttgaaacgttatggtaccatctaaatcacaaaacttaattcagtaatttccaaaaatacattattagtgactgataattctgctgctttcctctttttttcaccttccattttaggttcagaatgtacctgtgcagtgcaggtgttttacatgggtaaattgcatgttactgaggcttgggttataaatgatcccatcacccaggtagtgaccatagtacctgagagttagcttttcaaacgtttctccctctcaccctccccactctaatattccctagtgtctgttagttccatctttgtgtccatgtgtactcaatatttagctcccacttataagtgagaatatgtggtatttggttttcctttcctgtattaattcacttaagataatgacttccagctgcattcattttgcttcaaaggacatgatttcattctttttttatggctgcatagtattctatggtgaatatgttccacattttctttatccagtctaccattgatgggcgtctaggttgattccaccatgtcttttctattgtgaatactactgtgataaacatacgggtgcattgtccttttggtggaacaatgcattttcctttgggattgctgggttgaatgatagttctaagttctttgagaaatctccaaactgctttccacagtggctgaactaatttacattctcaccaacagtgtataagcattcccttttctccgcaacatctgttattttttgactttttagtaatagctattccgactgatggaagatggcatctcatcatcgttttgatttgcattccttaatgattagtgatattgagcatgttttcatatattttttggccatatgtatatcttcttttgagaaatatctgttcatgtcctttgcccattttttaatggggttgtcttttgcttgttgaattgttccttatagattctgaatattagacctttgtcagttgcaggatttgcaaatattttcttccattctataggttgtctgtttgtcctgttgccagtttcttttgctttgtagaagctcttcagtttaattgggtccctctttcaatttttacaacctagcttttaaaagccttatcaagcaaagtcgtgttttgtttccttcttgcttaaatatatggatacttattctccctcctaaaaaaggacttgcctttgcataccatgatatagaataggcctaaaagtattttatgaactataaatgtatgaacataaatatcaattaggtacaattaatcattttctacttattttcaaaattatagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggtaaatgatatggaacagagagtttctttattgaagttcctggagtatttatttggggcagtttctttgatgacctaatcaacttcacacatcccagatctgttattcttccggggttctcattactttgacttctgattcctgttctagtcttttgaatgtaagactagatacttcataaaatttttccaactccctagatatgtttacctttttgagggaatggtctaacgttcttaataattagatggaaatcagatgttttatatcaatctagtaactcttctagcttagtcttgagaggatttatcttaagatggtaaagaagagaatttttgtcatagtttagaactgaaaaaaatattcaacattatctttgtgtttttttcatttcctttattaatactatataagaccaaaaagatcacagttttatatcaagctccttccactattataacaaccaaatgaaacatttggaagtcttttaaggttagttaaatcattaaagtgaattttgcgatatcattttttatgtaataaaaatgttcctggtcctacagaccattccaaacatgtctgcctaaaagtttatgttttctttcaattgtacatttgtttatttagcttaagtaaacagtagtaactcagatcttacaaactgaaaaaatatataatttcatggagagaaagtgttactttttacccaactaaatctatttagtgtaccgtttttgagttttaacttcttaatatactgtgagggtgagttgctgctattggatagaacccacttctttcttaagtaacttgcttctgatgtgtgttatgaaacatcacactgcctaatggccaatcccagttaacattggcctccttgtggttcaggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatatgtaagtagagtggtcacactgttagcctgatttgtatactttacagaatttttttcccttactttgaacttttttggggactattcctctgagtttccaaaagggaataagtatggggaataaataggatttagattcagtttagacttcccacagagggtcatcgtgtttgaaacttctgtctaaagccaaattttctatgtatttattatcaaggataattgtggatagtgagttttatgtacagacagtagttggtattggcatgctgatcaaagacagcattattattctatagtctgtttctaatcataatgttggtattaattgcttatctctgctgcccataaataggaatatatgcttaggttaattcagttttgcttgtgagaacgtgcctaaaattcaaacttaaatttaatttttgtggatatatagtgaagcttttttttaagtctcttctaaagggagaaattgaagtattttgctaatgacttgatggtaggaggcaattatgacacagatgaacagacataagaactaaacctgctgtaatatattcctcatagctccagttagcacaccaaccaataaggcttagtcctgaaaaaagagcactaataagccctgaggtgatagttttagagaatctacttaaaattgacctgaaaattactattttcctttttccataagtgaccttaattcaggaaataatgcctgttacacacagggtgaatgaagtagatttgaatagccgggagaaagctgagattccatttcacagaattattaatacgttattatctacatcgacaaatttgtaatttcagtagaaattatgtctcttcaaagttgtttctctgaatttctactgaagtcaatgataagaaatggcagtcttagctgggcacagtggctcacgcctgtaatcccagcactttgggaggctgaggcgggtgaatcacgaggtcaggagattgagaccatcctggctaacacggtgaaaccccgtctctactaaaaatacaaaaaaattagccgggcgtggtggcaggcgcctgtagtcccagctactcgggaggctgaggcaggagaacggcgtgaacccaggaggcggagcttgcaatgagccgagatagcaccactggactccagcctgggcgacagagtgagactcagtctcaaaaaaaaaaaaagaaagaaagaaaagaaatggcagtcttctaatgactaggttgttctggatggcttccctttcagtcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgaggtatgttctatgggaccaccggcatgctggtgccctcttagaccctcatatggtccctttacctagaaggcaacaagacttgaccaaacagcagttgctctgtttacatccaaagaagttttaaaaaataaacttctgatatcattcattctgtctgtgttaattgggttgacaaatgaaagactagaaatataaaagattgatttagactaaactaagtgatagcataagttcaagctttaggttatcattttcaaactttagaccctgagaaagtatgttgttacagatataaatctcttattatataaaaatccatctttatttttatcttcttcctagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgagaagtgttctaaggatatggttgcctcagcctgctttaggacttgagtttatgcttttcttaaagcctcttacaaatgggaaacagaaagcagtcctcctaagtagaaagcaaattattcctaccacagggtgttaaaatcaaggcaattcaaaaacaatacatgcattgactatgagccacctcaagatttctacttgtgaaatttacaatatcaattataggtactgcttaataataaaatcctcacttaaaaaaattcttaatgggaatgagattgttttattttcatggttagcaatcagattccatttcaataaaggtgtctaggggctattgatattctttagctctatttgaatatgatgctttctgtttgtgttattggaccacccactggaattttgtttttgctacctggagattgtaagatacctatttcttaaaccctcattgaattgatttagcataacaaaacttggcctgcgtatttagatttttgtgtgggccaaacattccaatgtgaaagtatattttttcttgcatttactctgcttacacagagctgctgttgtataatggccaagtgatggtaatgtagataaagggtaaaaagttgaccatagatggtaaagtgtataatccaggagtatccaaatagacatttacttctttatatgcagcaaaacacatatgtgttaatggtcccctgagctatcaagtaaaagggactcctggctaaggaatgaaattacatatggtttatatagttatatatagttataagagtgtggtactgtgaagataaggtaacaagtttttatgtcaatgccaattttcagcgttcacccattgccccagatacagttattcattctctatcaactgtgcctcaccaatatatttcacattcttataattacaaccattctactttagacctttttttttgttgttattttgactattgcagtggcctcaaatttcgttcctccactttcattcatcttgctcaaaagctacccaccataatgatggaaaattatcttcctaaaatgcaaattattaaacttttgatagatctggccccttcttgcctctcctgtcccttctactagttatccaacgcaaatcatacatttccacacgttcaccatcattttctagtttacacactgttgtcttttgcttactcctaatagtttttctaatacaccgtacttttccctgttttacctgactgtacctacacatttattcctttagattcagtttaggtttaactttttttcggaacacctttcctgattcactatgcccaaactccaccatttcctccagactctccatgttcccaatggtgtgtgtgtgggtgggtgtgtgggggtgtgtgtgtgtgtgaatatcattcatctgtctccttcactagactgtaagcagctggagggtagagcttgccttatatcttgctttctatatcttcagtgtcagcacttagaaaatgtttgagtgactgactcgtgttcttaatatttctcgctttggggttaccatggtcattcctttacctagggaacaagacgtcaaatcaccatgtaacctgatacattatttagctaaaaactgcttcaatgaatattgttgcaacagtttttctacagactaaaggtattataatgtatacctttttttttgctgctgtctgacctttagtctcaaggactagaatgtaactccatcagggcagggatttttttatctgccttttctattctgttcccaacactaggacaacataggtgctcaataaaaatttattgaaacagatgaaactgcttttttttctttttttagctgttacaagcttctctgtattacattgtttctaatcaatggcagggtataaccacagatatgatttgtttaaataaaagaattttcaaattatttagttttatagcatagcatcattttggccaggcatggtggctcacgcctgtaatcccagcactttgggaggccaaggtgggcgaatcatgaggtcaggagttcgagaccagcctggccaacatggtgaaaccccgtctctattaaaaatacaaaaaaattagctgggcgtggtggcaggtgcctgtaattccagctacttgggaggctgaggcaggagaattgcttgaacctgggaggtggaggttgcaatgagccgagatcctgccactgcaccccaagcccaggtgattgatagtgcgacactccgtctcaaaaaaaatatatatatatgtgtgtgtgtgtgtgtgtgtgtgtgtgtgtgtgtgtgtagcatcatttcttttatgtttactttctcagtgggatataccattggcctttgcctaatattaaaatgagcatacatatccattgccagaacagattccagctaacagcaaagagagctacccacacagcatgctacattatataaaatttggagaaggttatctagttcagggcattgatctgcttagatcttttcatcttaaagagagaaaatacaaattatttttagacctgaaatcaagtgctcaactccaaacaacatttctgagaaaaaaaaaaaaaagtacctggaaggaaaaaacatggcagatgcacctactttgtctctgtgtagtcactagaactccatagttacccccagaattcacatccgtcagattcataggacactcctgcagagagctcattacaacaggtgtcattagctcttttacatcctgtgtacaaataagaagagggattgaaggaaataagaattctttgaaatattaaaggtttaggaacatgggaagatcaaatggcaggcaggaagtggtgaagcacatcatctccctgaagggttctgcagtccccaggcccttggcgcagcctgggccaattttagatttttgaggaattagggaacagtagattcgacctgtgattacatgtcagattttgaatgaatggtaatcaaattattagtaaaatgaaattttatgaaaccccagactttaattctctataccatttatgtgtactaattatctttttgcttaattttcttaatttcatgtgtaattgaacattagttatctcttttttgtaaattgcaactgaaaatgtgtgttttgggtaattttaaaaaatcacaggtctgagaaaaagaagatagatcatggtctgaaagcaagggaataaaacacacggtgtattttacaagaacacattcaaaatacataaacaagaaatattgaaagactgttcttatcacaaggaaatcataaatgtttaaggagagggatatcctaattaccctgatttgatcactacactatgtatacatgtattgaaacatcacatagtacacccataaatatgtacaattatgtgttgatcataaattttaaaatggaaagattaatatgaaatgcagaaaataagacattctaaatgcataataaagctataaaaatatatacaaaaagcagttgcttgcatggtgcagctgcacattagaaatgtgcttgtaattgaaacgttcatttttatagtattcaggaatagtgtgttgatcaaagaattttcattgtatctcagggaagactgggttgacctaacttatagattacagagctataatctctgtaatcagaagcaatgtaacaaaaatatgcaggtctgaaatggacatatataaccaggcctcacttcactgcctaaaccaattacccagtgagtagcagccacattttgaagtcttttcaagtaaggaggctcaagctgaatgacctccactcacctgttcccaccccttatccctcagtaattcctgacaatcacattacgagaccaagggtgcttaagattagtcactgtgataccagacagtcttgctggcttcttcacttgttatgaaatatttaaaacaaaaactttaagacagccatattcattcagaacatgtataaactataaggcatggactatccagtgtttcagaggtccgaactggttttctgttttctgctataacataggttatttattcattttcctcatgtgcatgtttgaataagaagaaaattttgtggtgtaaatgtatgtatgtttgtgtatgtatatacatgtttgtatgtcatgtatatatacataacacatactgaatggtacagggattgtaagtattaatgttctacaatattagattacacataaattatgactgatcttatgacagaatagaagccaattaactacaagttatatttttagtgcaaattcatttttctcaaacactgtcagtatttttaattgagtccttaattactttgaacatgattttaatttactactgtctagaaattagtggtgttaataatctcatgtgtcataggtaagacaggtaaaattaccacttcaaagctttaatgaacaaggaaaaatcataaacttctgtgtaattacaaatgtgcaatctaataaaatacatcagaactaagcacactgctttggaacttcccatcaagactttctgccttgaatgccatgaagttatcttacatgcatcaaatcacctgtttggccttcactcgttatttctcaggctgctcagaatattgacctccattaacagttggccaaaaaggttagctagaaggccaccctccattgtgtatttctgaggttgtcattatgagttttaatttatcatctaaagaaatatgtcctaagatgaaaatgttaccattacagcttgatctctcaccctcttctcttgtattatttcttaataggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaaggcgctacgtttattgcctcgtcttattcactgacctttgtaatgatacacagtgaattctttttgacaaagagaaatgcagtgtagtatgcagagctgctgttttaatgcctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttatttttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcacttt

SEQ ID NO: 36230 - DNA, 61985 bp, Homo sapiens
cggttgctggcggagcccgggaggcggagaaggctgtcgttgccttggccgtcgcatccccgagggagtcgtgtcggcgccaccccggcccccgagcccgcagattgcccaccgaagctcgtgtgtgcacccccgatcccgccagccactcgcccctggcctcgcgggccgtgtctccggcatcatgtgtggtaagggggccgggagcggggggcgtgttgccgggtggcgctggggtgcggtgcgggtgccgctaaggcccaaggcgacgggcggaagcgggagtgtggagggtgcgaagtctgggtgatgggcaaggggcgcccagtggtggctgcgggggcgggggccggcatccacgggcgggagagggggtggcggccgggagaaaggcacctgagaggaaggcgggccccctttgccgggggctagcgggcgccttggcgcggagaaggaaccgaaaggggagagaaacgcctttattgaaaaaggaggagagagctgagggaattgaggtgtggagggggttgccttcaaaagggcccaccaggtgagtgaggaaacctgtggaacctcgggcgaggtctcttgaacttaccttgcatttttctaaaaatctttaaaaaaatattttacttgtttctggggaggcccaatagaaaacagaccctagctagagccacggtagtgccattaaacgtgatacttcctgccatcccttgtctcaacagaaaccattgctaatcaataacttggttcatgggcttagacctgatcctctggtggaagaggccttcaaatgtctgtggcgataggttatacataatttatcatttgcgtgtgcacccattaaaaatgccagctctgaaaaatatcagttataccttggatgtatacccctttagaataccaactatgaaaaatatcatttatcccttgcatgtgcatccattaaaaatactagctatggaaagttgagcaaatatctttcctagagccttaaaaaattaaggttaggcccttttattccatgttttgagagtcgtttattatgacctaagtgttagtgaaagagactttgagaatcgtgtctgacatgactgatatcttctaaaattggtgttaatttggctattgccagtaaaaataattgtattcttacctttcttattgaaatttacaaccgactttatccctggaagaaagtacactttttttttttttttttaaagggaagtaccattgtaagagaattgaaaactctctgggagacttcttatttgcagccttttacacgaaggaactgaacaggaggtggattgtactcgttagtgtatatatttcctgtatttaactttatgctcatttcagcttctgaaaatgaggagcaggtttaaatttagagtagattaaaaaaaaacccacataaaaacagaaacacctataaatagcttactgaaattattagagtagagctgacttcagaatcagacttttgcagtgtctacttagtagaatggttttgcatttagtttggagctgtgaagtagtgaatttgcaaactggtcaatctccagtgtgcttcatttggtagttaactgttcctgaatgatgaggggtgtgcctcatcaagtactcaacattctggttgcaggtcatttcatcatgttccaagaaaaaaacgtagtcaaagtacttactgaaaaaaaaataaataaataaataaatcagcgctgggcgtggtggctcccgcctataatctcagcactttgggaggccgaggcaggtggatcacctgagctcaggagttcaagactagcctggccaacgtggtgaaactccatgtctactaaaaatacaaaattagctgggcgtggtggtacgcgcctgtaatcccagctactcgggaggctgaggcaggagaattgcttgaacccaggaggtggaggttgcagtgagccgggatcgcgccattgtaatccagcctgggtaaaaaagagcaaaactccatctcaaaaatgataaataaatataaataaataaatcagatatggaaatcaggttcagataagggagatacctttagggtggagactaaatgttgggagttttcacatagtttgtgtctccattccatagagttttacggctgaggaaacaggtattgaagaaataaaaagtgaatatttgaggcatttctgaggtcctgcttttaagtcataccacggttttgcctgattctagggatagggttcagaatttattttctctctaatgtaaattctgaaagataagaagatgagtgtcattattttcctcccacatcttagtcattgaactaaaattcctgagcagagaaatggagtgaaaattagactagatgggaaaatctggaagcttactttctgattacttgctatctagttaagtttttctctttctttccttctttcttttcttttctttctttctttctttttctttctttcttctttctctctctttctttctttctcttctttcttttctttctttcttttttctttttttttttttttttttgtgacggggcctctctctgtcgcccaggctggagtgcagcggcatgatcttggctcactgcagcctctgtctccggggttcaacctcccgagtagctgggattacaggggtgtaccaccacacctggctaatttttgcatttttggtagaggtggggtttcaccatgttgaccagactggtctgctgacctcaggtaatccacctaccacagcctcccaaagtgctgggattacaggagtgagccaccttacccggccctagttaaatttgcctaaaagattattttatttcaacgttgtgcattgttgaagcagaagaatgaggattgaagattctgatgtgctttttttcaatcagatatactgataaaattgatatgtttaccagcttgtattgggatgttaataagtgttaggaaaaaagatcctctggtccagtaaatttgggaagcaacatattaaatcgcgtggtaatgttttgttttgttttttgattggaggatttcttggaatctttaatgtattaataataagcattgagaatctcccagagaagaatagtgtgtctattttccaaatttattttatcttcctttttcttggtagtttggaatatactttgtcctttttatttgcattatttttggttttgctgagtgtcaagtcacttaagctatccctagcttttaacagattttgctattgtttttataaatgtgaagttatacccttctgattcgacggtgtatataaaatggaattttggggatgggcgcggtggctcacgcctgcaatcccagcactttgggaggctgaggtgggtggatcacctgaggtcaggagtttgagaccagcctgaccaacatggtgaaaccctgtctctactaaaaatccaaaaaaattagccgggcgtagtggcgcatgcctgtaatcctagttactcggaagcccgaggcaggagaatctcttgaacccaggaggtggaggttgcagtgagctgagatagtgccattctactccagcctgggcgacaagagtgagagactgtctcaaaataaataaataaataagtaaataaataaataaataaatggaatgtttgcaaatgagatcctttttaaaagcagtaaaggaacttgcaattttaaagtatcctaaaatgaatttttcaaaagttttttgtaattatactgtctaatggctttggagataattgagggatgctgagattggctgctaggattggtcataaaaccagtactattaacatatccttacatatactggatatgaagaagttgtgagagaaaataattgcttaataagcatttcttcaattgtcccctggaaatggaggttaataggttctggtaatgagcagtagaaggcgggaaagggttttgtaacacaagtttgggaaattctgctcttggagattcacaattagcaagattaaaggttccagaaagttctaaatatatacctaactttaaccaggtagttcttaaacctttaattatgaaacctttctttacttcattcctttttagcatccggtgaaatagtgttctgtttctgtggtttgagaattttttgaccgtatatttcaggtgcctagaaagtgttagaagatacttgcaggtatttgaaatgatggctttatacttggcactctgccctttgcagagatgactaaaataagagagttgccttcaagaaattgctgcctgatcagaggaaagaaaatgaatgcacatgcaacagcttcaggtgaaaatacacagtccttgttcattgccatgtcatagaccacaagtagaatgagtagaaatttagagactggagagctctggggtttgggtttctgtgttaggttcaggaatgttctgggtgatggggcaggacttttactcaacttgtagagtattagtatactgtgagaggtaatcattaatggcatatgttaaccgtcagtgaatggaggcggaaatagtttgagaactactaccagatgaaggaggaaatagaagtgccaggaaaacagaccaaggaacagtggttaaaggcagaagagttccaaagtagtatattgccttgaacagagtctataaaagtagaaaaaggtcattcatatgtaatactgcagagaagttaattggatatggttatgaagaaattattagagaaattgcatatgtcaaggcagaagggtctcagtttgtgtttaggaggagggctgcaagtaatatgaaaaagaagaggattttgggattgaggtcccctgggagtgttgagaagttgaattctagagctgtggttcctgacctacaagccctgaagttgttacagggtgttcattgcttattcatatgcttataactttgtctgtaagttgaataaagattgttctagatcattgaataataaaaatttaacccattgttgtgaaggagcctcagaatattttgatgttaacaaaagagttctgtatttacaaagttggagaaacactcatcaagagttaggagtaaggcccagtgtggggttccctctggtaataccagcattttgggaggctgaggtgggcgaatcacttgaggtcaggagtttgagaccagcctggccaacatagcgaagccccatctctactaaaaatacaaaaattagccagctgttgtggtacgcacctgtaatcccagctacttgggaggctaagggaggagaagtgcttggacctgggaggtgaaggttgcagtgagctgagaacacgccactgtaccccagcctgggtgactgagtgacactctgtctcaattaaaaaaaaaaaaaagagttataagtagccagtgttttggcttacacctgtaatcccagccactcaggaagctgaggcaggaggattgcttgacgctaggagttcaagatcagcccgggcaacatagtgagatcccatctctattaaaaaaaaaaaaattagccaggcatggtggtgcatacctgtagtccagtctacttagaagactgaggtgggaggattgagtccaggagtttgaggctgcagtgagctatgattgtgctgctgcactccagcctgggtactgggtgacagagcaggactgttaaaaaaaaaaaaaaaagttacaagtaggggagaggctagcttcagagagtagtatgtgtaatatgtctctcttgagattacaaggaaggatgagaagtatttatatattgttaaactgttgaaaagaagatgggtgaggggcagtgactcatgcttgtgaactcagcattttgggaggctgaggtgggaggatcacttgaggcttggagtttgataccagcccggacagcatattgagaccttgtctctatattttaaaaacaaaaaaagaaaatgaagactttaattctggccaggcgcagtggctcacgcctataatcccagcactttgggaggccgaggcgggcagatcacctgaggtcaggagttcgagaccagcctggccagcgtggtgaaaccctgtcactgctaaaaatacaaaaattagccaggcgtggtaacacacgcctgtaatcccagctgctgctcaagaggctgaggcgggagaatcgcttgaactcaggaggtggaggttgcagtgagctgagatagcgccactgccctccagcctgggtgacagaacgagactctgtctaaaaaaaaaaaagactttaattctataaagtaagaatctaccaaaaatgaaaaagaagctgggaagagaaaatgaggatttgagagtagtatgtagcttagactctaaaataatatctgggagaagtttgaaagttaagcaagtgatgaattaataggattggtcagcagttcggagggcccatccgaaagtggaccgaaatggataggatagatgagttctccttggctgtcatagttcagtgtagagatgctcagagactaggagtcagagcacagtggacccagagggtttgacttggcagtatgatgaaaaattgtagtctgatgtgaatggtcagaagagagagagatggaatatttgaagattgtgagcaggaagtacatgcttttttttctcaagaaagatgatgacataggttgactgtgagggaatgtatagagatgtcatgacttaactagtgatttgagctccagaatgttaaatgtgcaagagacgtgtcatggagccccttctagtggcaatagttacagtaaagtaggggagacatgaaccaattaaacacacaaataattgaaagtcttaattgtttcactccatatgttatttttgtatgtgtgatttattttattttacttttacattttttatttttttgagacagagtctcactgtgtcgcccagcctggagtgcagtggcgcaatctcggcccacttcaccctctgccccacctcctgggctcaagtgattcttctgcctcagcctcctgagtagctgggacaggcacgcgtcaccatgcctggctaggaattttgtatttttaatggagacggggtttcaccatgttggccaggctgatctcgaactcctgacctcaagtgatccaccctcctcagcctcccaaattgctgggattacaggcgtgagccacggcatctggcctttatatgtgcttttaggattgtagaagatgtaccttggctggatgcattggctcatgcctgtaatcccagcactttgggaggccgaaacaagaggatcgcttgagtccaggagttcgagaccagcctgggcaatgtagtaagacctcatttctacaagaaataaaaaaataactgggcgtggtagcttacgtctgtaatcccagctactccagaggctgaggcaggagaattgcttgaacctgggagacaggttgcagtgagccaagatcgcatcactatactccagccttggcgacaagagcaaaactccatctcaaaaattaaaaataaataagtaaataaataaataaattacaggcacattagcatgtgcctgtggtcccagctacttgggaggctgagatgaggggatcacttgagtccaggaggtggtggttttaatgagctgggattgtgccactgtactccagcctgggcgacagagcagacccctggtgaaaagaaaaaagaaaatgtatctcaaataatacttaattttaaagaaatcttaaatgtagaatgtgattccataattataatattgactagttcactgcaaccttgaacccctgggctcaagtgattctctcacctcagccttccaagtatctgggactacaggcatgcaccaccatgcctaattttttatttttggtagaggcagggtctccctgtattgcccaggctgatctcaaactcctgcccatgatcctcccgccttggcctacgaaagtgctgggattacaggtatctgctactgtgcctggcctgtagaaaaatttatagctgaaggactgggagtgtgtgtatgggaataacagtagttatctctgagaaaggggttggaacctgtgtggagacagaaaggagagattttcacaattctgtagcatctgtatagttttaatatttatttatttatttcaaattttaatagagacagggtcttggtatgttgccctggctggtttcgaactcctgagctcaagtaacctctgcctctcttcccacagtgctgggattacagatgtgagccactgctcctggcctactttgaatttttaatgatggtgatgaattaatttgtgactagcattataagaaaaataaaatttagagtttaagtgacattgtaggtagattttgattcagaagttttaagtttagagaatgaatttgaacacttatcactgataagttacaatgtttagggtcccaaaatattgcagctgtcaaatgataaaatatataaaaataaaatttagtattcataaggacataaatgcaaccagacataggaattttaataatttgacgagtcagttttcttttcagtaaggtttaacagtctgtatttgcagctacattgctttcaaccaggtgtgtctagtctgtgatccagattgcttctgaaattttgttagcaaggtgctcataattgcttttttgtcattgaatttaagttgccatttattgagaatgatgcctgtaggttcaagcatctgcttcagttatggagttattttattccaagtatattccattagtaagaaagcttacacttgtgaagtgcatgctgatttgggggtagagaatctatgcttatacagctactgtgtgtgctcttagagcaattactgaagagtggcggaaagttgatattaggcttttgtcattaccttacttaagaactgtttattgggagtttaggccgggtgcagtggcttatgcctgtaatcctagcactttgggaggctgaggcgagtggatcacctgaggtcaggagttcgagaccagcctagccaacatggcgaaaccccatctctactaaaaatacaaaaaattagccgggcatggcggcggccactgtaattccagctacttgggaggctgaggcaggagaattgctggaacctgggaggtggaggttgcagtgagctgagatggcgccagccttggcgacaaagcgagactctgtttcaaaaaaacaaaaaacaaaaaactgtttattgggagttttgataagacaagtcaaagacctgaaaatagaggtcagactaacgatttctgctctaacaagcatcattgtgagttgtgaatgcctcccttgtgaacatgccctgtgtacctgatgaattgctgccagtattgtctcgggcaccccaagattacagttaacccggtatccccgcaggtggaatgtcttgggctagtagtgctatcaagggacagggctatgaaactgacaggttcaacttcttagctcccattttcctcatcaggtatgtctgaggctaatccccttccttcttctagctctgttacttttttgtttgtttctttgtttgtttttttgagacggagtcttgctctgttgcccaggctggagtgcagtggtgcagtctaggttcactgcaacctctgcctcccaggttcaagctattctcgtgcctcagcctcccgagtagctgagactacaggcacgtgccaccacagctggctatttttttttttttatttttatttttagtagagacggggtttcaccatgttggttaggctggtcttgaactcctgacctcgtgatccgcccgcctcggcctcccaaagtgtcgggattacaggtgtgagccactgtgcccagccaaaatgttcttaagctctcaagattcatatagtgagccattataaaccaaggagattggagttagaagtattattaaagttgaatgctgttgttgagttacattattaaaaacagtgaatttaatattgcattacttaatcttttttttttttttttttttgagacggagtcttgctctgttgcccaggctagagtgcagtggcacgatctcagctcactgcaacctctgcctcccaggttcaagcaattctcctgcttcagccgcctgagtagctgcgattgcaggcacctgccatcatgcctggctaattttggtatttttgtggagacggagtttcagcgtgttgcccaggctggtcttgaactccttacctcatgtgatccactcgccttggcctccaagttgctgggattacaggcgtgagccacccagccctgccgcattaatctttaaaaaaaagtagagtctataaattgtcttaaaaacaattttatatcattagcatttaaatagttttaacacattcatatacatctttaatctttaaatcatttaccatccggcttacatttttatgtttttaccaactttcatttttatcatctggcttacatttttacttttactatcagacttagatttcttaaaaaagagagagtttaggagtgagtttttctggatgtgcttagaatttggcagctctggacaatctgcaaacaatcctcgacaggcttctgttttcaaataagctagattgtatcctcctttagtggactctagctgatgcagtcacagtggtgggaactagttcagattcagtttttttcacacttttttttttttcttttgagatggagtctcgctctgtctcccaggctggagtgcagcagtgcgatctcggctcactgcaacctccgcctcctgggttcaagggttcaagtgattctccccgtctcagcctaccaagtagctggagtacaggtgcacgccaccatgcccggccaatttttgtatttttagtagtaactatgggtttcgccatgttggccaggctggtcttgatttcctggcttcaggtgatgcgcctgccttagcttcccaaagttgggattacaggcgtgagccactgcacctggcccacatttgtattaaagtattgttttagaaaagatttgtgtgctgtgtattgtcttttaatgacctggttaaaatacttaattgatagttatctgtacgtgtttaatctttctcaaagatcagtgacccataggtgaagagtgcaaagtttgatttacaattgggttattcgtttattcatattacagatacttcatgaaggaacagcagtagcaacaaaaaccccggactcattcttctgaattaaatgggtgcagattggtctggagactcttctgctgccctctagtgtttatatcatgagtagccattgaaagttggaagctgcacattgctgtgccgctaccactcttaccttagcaatatccttaagcagcatgttgtttatccttatcttaattgctgtgctttgaggttgggaatgctatttgtgggtatctctgggatatcagttaactcaatttctatttttgaattatgtaagatagatgttctaccctcccttacagggtggtggtgctgtgaaagtaagatgactgtacattacaggaaagcttaaaaaaataaaaatgtaaggtgtgtgtgtatctttttttaatctgaatgaaatatgggatttctgtaagtctttggcctggaactgcttctttggggagagttgaaaccgttgtttcaggttattttggattttaatgtgtgagtttctcttttttagggcataataatttatttgagaaaattgcaatgtattgatcatggtgatcagcatgtatgttatggctttcctgttgggtatcaacaatgtgccatttttgtatactgaaatatttcagtaggatcacactctatagaagtaaatgtctcttttcagatggaaatgaagactagttttttgggagttctatctcacagaattaatttaaacttcttatgaatcagaattacagtgaaatgtagttaagaaaaaaggaagttttaaaataagcagcttgaacttgtatttttgtatattttatataatttagtcttcagttttgatacattaaagctgtgtccactctggccaaagcacagccatggaaaacctcagataatgcccatgctgccattcctaaaagtgtggatttcctttacctgtgttttgttacttctttgcttatcccgttcagttcacattgtattactgctttgatttctagttttgtttttccaaatgattgctctttttctgtgaattttcaagggttgttatgtggttgtcatttgctaatgtgatgaacaagtaattcaagcaattatcttttaagatagttatatatttggtcagtttttactattttacgtaattatttaaggggtgagtatttttcatatcatttattcctaaatgtcactgatagcatggttattggaaataagcaaaattaatctcattggtacagattttagggcctatatatgttgcttaaattactttagaaatttttttcttgaaacgaaatgctctgtatataggacataaaccatgaatttgttaattggtttttaaaaaaattaaatttcacttgacaaaaatggcagtcatggaaaataagtagccagctttataagcttctttgccaggtgcagtggctcacacctgtaatcctagcactttgggaggccgaggcgggcagatcacgaggtcaggagattgagaccatcctggctaacatagtaaaaccccgtttctactaaatatacaaaaaattagctgggcgtggtggcaggcacctgtagtcccagctactcgggaggctgaggcaggagaatggtgtgaacccgggaggcggagcttgccgtgagccgagatcgtgctgctggactccatcctgcgtgacagagtgagactctgtctcaaaaaaaaaaaagaaaaaattataaatgtgtattttgacatgtttagttttttatacttatgagaaactcccccttgaaaaagttccattgcctttaaacggtttgaaatgtttgaaagacagaatctaacttcacgttttttcacatacttgacataattatgctaattttgattttttaaatcagaatttttcattaaatatttgtttatttgcaggtatatttgcttacttaaactaccatgttcctcgaacgagacgagaaatcctggagaccctaatcaaaggccttcagagactggagtacagaggatatgattctgctggtactttaaaaaaaatactatggattttgcatgattctttaaatagatactatttttattgttattaggagactagactattaaagtctgttttgttttgagtaagtgtaaattggaagaatttttgtcttttatcatatttaaaggatttatttatgtaatctcaacagtgttaccatttatgtggagtattgcttatgatgatctcttaagaatattattgtaaaaacatcatatgggggattattgtggtaaaacaaaattcgtgaaggtcttactctaaattcttttttctttcctataactttaatttttatccattgatttcatgctttgacacataaacttgcctcagattcttttttcttatttttattatttatttttgagatagggtctcactctgtcaccccagctggagtgtagtggtgcggtcatagctcactacagtctcgaactctgggctcaggcaatcctccctccgtagcctcctcagtagctaggactatagctgtgtgccaccatgcccagctaatttttaaaaagtttttgtagacacgagagtctcactatgttgcctgggctggtctcaaactcctggcctcaagtgatcctcctgccttggcctttcaaagtgctgggattacaggcaagccactgattccagcctcatctatcttaaataaattacacataaacataactttctggcaactttatgttctaccctagctccttccctcaactatgtcagaggttcctaagaccatcctcagatttgacgattccctaggaggactcacagaactcagcatttggttgtactcatggctatgtttcattataacaaaagaatacaaagcacaatcagcaaagggagaaggtgcaggaattgaagtcttgagaaagctaggcacaagctgctcaccagtggatcagtgcctaaggttttcattgggggttggtcacataggcaccctctgcccagcatgtaccaaaattctagactcccaaaataagagcagatgttcagcataaaccactttgtttgcacagtttgtgtagtgagacacttttggttagggtggtaggaatccttccaaaaaccaagtttctagacaccagtgaagggccaaccttgaaaacaggcctttctgaggatagcagtttcacacctgctgtgttaactcttttttgtacacttaacattgccacatggaatggacatttgtcttccttgactttccttagtaatggaaagtcagttcctcaactcctttgtttttaaaattctctccttccttagcttccttgacagcacatcttattctcttcctaagatgctaagattacttcttttctgtttgctttggaggctcctttcttctacttacagctcaaatattaatgttcttcaagattctttttttttttgaggtgagtcttgctctgtcacccaggctggagtgcaatggtgcgatctcggctgactgttgcaacctctgtcttccggattcagctgattcttctgccttagcctctccagtagctgggataacaggcatgcaccaccacgcctggctaatttttgtatttttagtagagatggggtttcaccatgttgcctaggctggtcttgaactcctgacctcaggagatccacccgccctggcctcccaaagtgctgggattataggcgtgagccactgcacccagccaatattcttttctagatccacttctcttatttggtgtcttcatgggtgagctctgactcatcaatcttcttttttttttttttttttttgagatggagtctcactctgtcacaaggctggagtgcagtggcgtgatcttggctcactgcagcctccacctcccgagttcaagcaattctcctgcctcaccctcctgagtagctgggattacaggtgcctgccaccacacccagctaatttttgtatttttagtagagacggggtttcaccatgttggccaggatggtctcgatctcctgacctcgtgatctgcccgcctcggcctcccaaagtgctgggattacaggcgtgagccgccgtgcctggcccatcagccttctgttaatatatgttggtaacttctttgttttattctttttattttttatttatttttaatttttatttttttgagatggagtcttgctctgtcgcccagcctggagtgcagtggcatgatctcagctcactgcaagctccacctcccgggttcacgccattctcctgcctcagcctcccgagtagctgggacaacaggcacccgccaccacgcccggctaattttttgtatttttagtagagacggggtttcaccatgttagccaggatggtctcgatctcctgacctcgtgatctgcccgcctcaccctcccaaaatgctgggattacagacatgagccaccgcgcccggccagtattttttatttttaattttaatttttttgtgtgagagtatgttggtgacttctaatccagatgtatttcttttaatccagatttatctcccaagctgtattctaggcctcctacaagtttcttcctagatagaccatgatattttaaactttgcatgttcaaaaattgaactgaggccgggcgtggtgactcacgcctgtaatcccagcactttgggaggctgaggtggatggatcacttgaggtaaggagttcaagaccagcctaaccaacatggtgaaaccccatctctacttaaaaaaaaaaaaaaattagccacgcattgtggtgtgcacctgtgatcccagctatttgggaggctgaggcaggagaattgctgaacctgggaggcagaggttgcagggagctgagattgcgccactgccctccatcctgggcgacagagcaagaacctgtctcaaaaaaaaaaaaaaaaaagaaaagaaaagaaaaataagctgaatacattgcagtcctcaccctgctccccaccctgttttttgtttgtttgtttttgagatgaatctcactctgtcgcccaggctggaatgcagtggtgtgatctcagctcactgcaacctccacctctcgggttcaagccattctcctgcctcagcctcccaagtagctgggattacaggcatgcccactctgtttttctatgtcccttttattgagaatcattcaacaagtccttcaagccattcaacaagtcctttgaggtattccacacttctcctgctttctcacttacattcagtcagttccacttttcaatatcatttatttctgtctgcattaccactgtttagttcaggtcctcttcatttttgctttgctgtagctgtagcttttgacagctggtttcttccttccgtttctctccctccagttctttccctacacttgtttctagaagggctttgctaaacatttttgccgaatcacttctctgcttaaaggacagtgttttcccagtatcttcagggtagctttttcaaattccttagcaacttaaggagactcttaagagatgtattctgtgaccttctttccttagctaccttctgaggtgggtgcccatcttttgcatttctccattgtatcccaattgtaacctgtagtatttttattataattcataatcacgctgaattattttttccttgtctgtcttctcgatagacttagaaatttgaggacaggaatggagttatttttgtttttgtgtctagcagctatcctggttcttgacacacaataggttttcagtaggtaattgaattaatacattagtgaattaattagatgagaatgtattttttaattaaaaattttgcctcacattaataattttatcagtagccagtttctaaattttgcttttttacctcatgatggtttaggtgtgggatttgatggaggcaatgataaagattgggaagccaatgcctgcaaaatccagcttattaagaagaaaggaaaagttaaggcactggatgaagaagttcacagtaacgtacttaatttgatttttgtcccctttccccttctcttccttttcccctccccattctcctctaagttactccctccccccatattttgggaccaattttaatgataatggtctgtaacattgaagggaggaaagaaaagtagttttgttactgtctggactagttttaaaatgtacctgagcctgaaaaataatcattgcaactagggaaggaaattagttaggtatattaccttcagtgtaagctctgaatattaaatgaagtatcttcagagccaccattcctgaggaagagcttttcataagacaaaaggtatttttagtgatgcccttttacacatgtcttcacttgctaattgtcttcactttggattaaatgcctagcttggatgtagtcaattttgacattgcacctttgaataggtctgatataatctggtaagtatcatgttttccctcacagttttcttctctggcacaaggagttgtcagagatgtatgccccatcaaagaggatttacttctcagtatttagatcataacattattcttacacattttatttttttcacaagaaacttgaaaacaaagcaaactttgaagtagattgattgaaaaaatatttttaaaattctccacaaaacccaggaaaccgcaagtattttatgtacctactcatatgaatgccatcataatcattgtaaaagagtacaggtagaggaaaatgatggattttgtcttttttttttcccacataagccatacgtttagctctgtagtacttgtttaacgaattaaatcaatacttattttgcctgtattgtagtgtaagattagctaggggtaaagcagacacccaaataactatacttcaaaaacagtagtataaatatctactatgtgttctgcatcctgtataccaggctgattgtagcaggttctgtaggagagaacagacattgctgtgagattcaggggagagttcccacaagttgacgagactgggaatacatagggaatgggtgctgattatatttggtcagtgaagatgtgaagggaggaccttctgagtagatagcatagcaagataagaagagtaatggcaggcgtgttgatggaatgatagtagtcctttttatttacagtattggtagacaaataagggaggctagaaaggcagattgtgaacagaatcaccatttttcaatgtcagcatattgaaacatgcctcttcgtggtcaacttttttttttttttcttcccttcccagatggagtctcgctgtaacgcccaggctggagtgcaatggtgcaatcttggttcactgcaacttctgcctcccagattcaagcgattctcctgtttcagactcccgagtggctgggattaccaggcgtgtgccatcatgcccggctaatttttgtatttttggtagagatggggtttcaccatattggccaggctggtcttgaactcctgacctcaagtgattcgcctgcctcggcctctcaaagtagtgggattacaggcattagccactgagcctggccaactggtttgtttttgaagtgtagttatctgagtgtctactttactcacagctaatttttttttaagatggactcttggtctgttgcacaggctggagtgtagtgacacaatctcggttcactgcaacctctgcttcctggttcacgccattctcctgcctcagcctcctgagtagctgggaccacaggcgcccgccacaacgcctggctaattatttcgtatttttagtagagatggggtttcaccatgttagccaggatagtctcgatctcctgacctcgtgatctgcccgccttggcctcccaagtgctgggattgcaggcgtgagccaccacaccttgctaatttttgtatttttagtagagacggggttttgccatgttggccaggctggtcttgaactcctgacctcaggcgatccaccctctttgacctcccaaagtgctagaattacaggcttgaaccactgcacctggccaacccctagctaatcttaccctgcaatacatgcaaaataagtattgattgaatttattatctacaaatggaaacttgtagatattgctggtgaatttgtaactggtaaatcactttaaagagcaatctggccatatctacatgggaaatgcctataacctgagactaagcacttccactcttggatatatacttgaaggaaacacagtgaacaaggtgacatgacaacaagattcactgttgcaaaatttagaaacagcctaaatgtctataagtaagggaatgggatgatataataagttgtgtgtgccgggcgtggtggctcacgcttgtaatcctggcactttgggaggccgaggtgggcggattgcctgagctctggtgtttgagaccagcctgggcaacatggtgaaaccccatctctactaaaatacaaaaaattagccgggtgtggcggcgtgcacctgtagttccagctattcgggaggctgaggcaggagaatcacttgaatccaggaggcggaggttgcagtgagctgagatcgtgccactgcactccagcctgggtgacagagtgagactccgtctccacaaaacaacaacaacaacaacaacaacaacaaaaaataagttgtatatgatagtgaatgagcatatgtagcttttgaaagaagtgtactgaatctggttctgcatatgggaacatggataattcctggtatgtaaagtataggacatttaaaaacacaaaacggtactatcatttatggtctcatgttaacataatcatagtttaaaaggcatgaatagtaagactgtgtcaacttgaaaatcttctgaggagtaagtgaatgggatggggatataaaggaggttatcaactgcattttttacatttatttatttcaagtttccatataccacactgattttttacattttagatcttaaaaaatatgtaaagcacagatgactagatgttttgttaactctgagtatgggtagttgggtgttcattattcccagcaaatttaaatatgtttgaagtattttttttgaaaagggaagatgacatctgagaaaaggcaggcagagggcaaggagccatgggagtagaggtagggtaagatagaagatgcaaatgaggaaattattgaagcactacggcccaagaagatcaaggcacaggcaaggagttagcctttaaaggaaaaagtgtactttaggaatcaaagatgaaagacaaacttaaagcagataattaccaggtgagaggacaaaagctgagtaaagtggaaattgagggattgcaggtaggattgagctttatggagaatagaaaagatatgatgaactgtcagggaactggattgagctatcagtttaatgaataaggaacttggatacatgtttcttaggtagcaacagtgaaatagatatgtgaatttgaaagggtcttaatttacagaattttctgactttcttcagtattgcttggcagtagatgggagaagagaaaccgagtgtgggggttaatctagacttaagattcagcaaagggctttaaaatgggtaacagacaataaggaagcgtcaaggattcaaagtcatgattaatttatatgacaggaaatatttattatgagaaatgtgcttattgtcatagcaataattttttcttactagacattcggtaatgttcctacagcaacagtgaaataaaggtgtggtaattatcatgaatttgaaatggattcaatatatagaatcttgtgactttctccagtattgcctgccagcatgtgcaaggagatactgctttaattatagttagcttaaaaaagttgtcaaagaggccaggcgtggtggctcacgcctgtaatcccagcactttgggaggttgaggtgggcggatcacctgaggtcaggagttcgagaccagcctggccaacatggtgaaaccctgtctgtactaaaaatacaaaaaattagccaggcgtggtggtgcgtgcctgtaatcccagctactcaggaggctgagataggagaatcgcttgaacccgggagggagaggttgcagtgagccaagattgcgccattgtacttactccagcttgggcacaagagcaaaactccgtttcaaaaaaaaaataaaaaaagtagtcaaagatgttttcatttcttgcattggcctgttgaataatggtaaatggtatttttcttgaggtcatttatcaggttgccttaattacttagaacacagttaagccaggaaagaatagatgcctgagtttattcattgatagattgagccatccaacaaaaaggtatctgccatgtataccttttagtgcttaggattcaaaaataataaggtaggctgctgtttttgtagaactcaaattctggtggaagctaggttgacaacatataaatgttatagtacaatagaatataccattgtggttttatttatttatttatttacttatttttgagacggagtcttgctctttcgcccaggctggagggcagtggcatgatctcagctcactgcagcttccccttcctgggttcaattgattctcctacctcagcctcctgagtagctgggattacaggcgtgtgctaccacgcccagctaattttttcagtagagacagggtttcaccatgttggccaggctggtcttaaactcctgacctctggtgatccacctgcctcagcctcccaaagtgctgggattacaggcatgagccgtggtgctcggccagtttgctcttaatttagacctaactctgataaactttgttatctgggttcttagccaaattaattttatatttaggaaattaagagcattactagttaataactggagctgtccatttttttaagaaaccccaagaaaagatagcttatatgaaaaataagaatcagctacttcttttttttttttttttttttttttttgagagggagtctcgctctgtcacccaggctggagtgcagtgatgtgatctcagctcactgtaacctctacctcctgggttcaagcgattctcctgcctcaacctcccgagtagctgggattacaggcgcgcaccaccacacccggctaatttttgtagttttagtagagacagggtttcaccatgttggtaaggctggtcttggactcctgaccttgtgtcccacccgcctctgcctcccgaagtgctgggattacaggcatgagccaccacatctggacaaatcagctacttttcaagataaaggaacattggcctatgccgatttcccagtagccccatactttcatagcattgctcggttcttaaatacctatttgattttggaggcactccatagttgcagtttctattgtgagacgtgtgtacactcaccagagaccaaagaaattgcagtcataaggttgtgtgtcattgggaaaatgaatttatttttacatgtttaattaaattgataatgactttttaaggcaagaattaaatatagatttaaaagattacattaattgtttttgtccttaactcttgagtatttgtatctccaggaaacttgaaagaatagtacattattacctatatatacttcacctaactttatctgttattaaaattttgtcatgtttgctttaactctgtattagttttttggttgttattgaaaccatttgccttcaatatttcagttgcataaactcctaaatctttatttatctttatttttaatttttgtgggtatatagtaggtgtgtaaacttactgggtacatgagatgtcttgatacagacgtacaatgtgttcctaagtcttttttttttttttttgagatggagtctcgctctgttgcccaggctggagtgcagtggcatgatctcagctcactgcaacctctgcctcctgggttcaggcgaatatcctgcctctgcctccggagtagccaggactacaggcgcgtgccaccatgcctggccaatttttgtatttttagtagagatggggtttccccatgttggccagactggtcttgaactcctgacctcaggtgatccacctgcctcggcctcccacagtgctgggattacgggcgtgagccactgcaccctgcctcctaagtcttttaatcactattttgaatatgcctgatctttagtttcagtgattgtatattccaagagagcagcattgtaataattgtatttaaatatagcttatagcattatctctgcagcatgatttaatattgaaatttttcttttcatattcttcagagcaacaagatatggatttggatatagaatttgatgtacaccttggaatagctcatacccgttgggcaacacatggagaacccagtcctgtcaatagccacccccagcgctctgataaaaataatggtatggaaagattttttgtgctttggaatgattgtggaaacctaataatgggggcagaatgaaggcttttagattttcattattttaataatttttcatctggaaaatttcaaacattcagaagtagtagagagcatatggagctgagagtgctggctcatgcctgtaatcccagcactttgggagcctgagttgggaggattgcttgagtccaggagttcacgatcagccgtggcaacatagtgagaccctgtctctacaaaaaataaaaaaataagttaggcattgtggtgcatgcttgtagtctcagctactcgggagactgaggtgggaggatcgtttaagcccaggaggtagaggctgcagtgagccgtggtcacacctcatgccattgccctccaacctggacaacagaatgagaccctgtctgtccaccatgcctggctaatttttgtatttttagtagagacggggtttcactgtgttgaccaggctggtcttgaactcctgacctcaagtgatcctcccgtctcggcctcccaaagtgctgggattataggcatgaaccactgctcctggctgagaacttttgttattggttttgtccttagggcatatctctctagaaatgtataatcaaattactgtgttttagagttacttggaatagtctttctccatgcagttgtgctacgtgttactttaatatgttttagaaacattttttttatttttattattattttttgagaccaagtctcgctgtgtcgcccaggctggagtgcagtggtgcgatatcggctcactgcaacctccaccttccaggttcaagcaattctcctgcctcagcctcccaagtagctgggactacaggtgtgtgccactacacccgggtaattttttgtatttttagtagagacggcatttcactgtattagccaggatggtctcgatctcctgaccttgtgatccgcccacctcagcctcctaaagtgctgggattacaggagtgagccactgtacctgtcctattttttatttttaaggattgatattctttaaaaataaatgttatttataattatttaaaatatttacataattccgaagtcacatctttaaaataagacacactaaaagaagtctacccagcactttggaaggctgagatggagggattgcctgagcccaggagtttgagaccagcctgagcaacatggcaaaatcctgtgcctacagaaaatacaaaaattagcttgatggtggcatgcgcccatagtcccagctactcaggaggctaaggcaggaggatcacctgaacctgggggttgaggctgcagtgagccatgattgccccattgcacttcagcctgggtgacagagtgagactgtctcaacaaaacaagtctagactcttctgtttcctcttattcccctcgtaggtaacattcaccaattattgagtctgttctttcatttaaaaaaaataagcaaatacatacagaatacatacaaaagtgtgtatgtgtgtatttatccctccccattttttttccttttattttagagacagggtctcactcctccacccaggctgggtacagtggtgggatcatagctcactgtaacctcaaattcttgggcacaagtgatcttcctgcctcagcctcctgagtagctaggatcacaggcttgcaccaccacacccagctaatttattttatttttgtagagataggggtcttgctttgttgctcaggctggttacaaatttctggactcaagtaatcttcccacctcagcctcccaaagtgctgagattacaggcatgaaccactgcacccagcccttgctgatttttagtttaattcagaagctgcctatttaggcttcttgtgcttcaatacttactgttgaatttgatcataatgctagcaataatttagacttttgacactgacaaggcctttatgaaagattcccgaaaacttacatctagattatgttttgagaatttggctttaagttaagacctttaaattagctgtttattaatctctttgttctagcatgaagtttttttttttttttttttttgagaaggaatctcgctctttctccaaggctggagtgcaatggcatgctttccgctcactgcaacctctgcctcctggattcagcgattcttctgcctcaagcctcccaagtagctggaattacaggcgcctgacaccacgcctggcaattttttgtatttttagtagagacaaggtttcaccatgttggctaggctggtctcgaactcctgagctcaggtgatccatctatctcagccccccagaatgctgggattacaggcatgagccaccgcacccggcaagtttttttataaatttatttttgtggttgctatcatctctaaaaaatctagtgaaaatgtttattatttggtttctaattactgtcagccaaaatatcagatctttatgtatattaagaacattgttgggggccgggtgtggtgactcatgcctgtaatcctagcactttgggaggccaaggcaggtggatcacctgaaattaggagttggagaccagcctgaccaatatggcaaaaccccgtctctattaaaaatacaaaaattagctgggtatggtggcatgcacctgtaatcccagctacttgagaggctgagccaggagaatcgctggaacccaagaggtggaggttgcagtgagccgagatcgtgccacttcactccagtctgggtgacagagcaagactttgtctcagaaaaggaaaaagaacattttggcctggcatagtggctcatgtctgtaatctcaagacactggaaggatgaagtgggaggattgcttcagctcaggagactagcctgggcaacatagcgagactctctctacagaaaaataaaaaaattagttgagtgtggtgtaagcagctgtaatcccagctgcttggaaggctgatgtggaagaatcacctgagcccaggagtttaaggctgcagtgagtcatgattgagccactgtactccagcttggtgacagagcaacatcgtgtctccaaaaaaaaaaaaaatattttgataatttcatataaaatttaatttagcagtaatttttctcctaactgaaatgaactctgaataataaatccaggattggtaggatttttttttttttttttttttttgagacagaatctcactctgttgcccaggctggaatgcagtggtgggatctcggctcactgcaacctctgcctcccagattcaagcgattctcctgcctcagcctcccaagtagctgggtttacaggcacgtgccaccacgcctggctaatgttttgtatttttagtagagacagggtttcgccatgttgaacaggatggtctcaaactcctgacctcaggtggtctgcccatctcgacctcttaaagtgctgggattacaggcatgagccaccgtgctcagccggattggtagtttttatgtaccagcagtcgctacaaataatgatattgtcaactcttgattatctgttcttacagttttcaaaattagttaaaaaagatgaaaattatcccgagatcatgtctattttctcttggaatgatattttaacatttatgtttctgacattctatgacttatttggatctcaaacaagtaaatttaactatggaactgattggtttttcttagcaaattccttagttctagttcttaaattcatttagtgtaaatcagattattgttttagtttgaaaggacttctctttaaacttttactcaagaatgaatgaacagagaaataagaagaatatttagttcagctctctcattttgcaaatgaggcaacagacccaataaacttgctcctttcacatgggtaacatttgattactagtttagccacaactgaaattgttatctctagacttcctgtttatttccctactgtacccacctcccctgcactgtttgcttcagctatgccacataaacaatgctgctgatctacctgatgataatctggtaaatgagaagtagatgtaattatgttataaataacataaatagtatatagcatgttaaaaatttttgacttgagaaaaatccagttagagtaatagctattttagatttatcatacttctaacttttttgtcttcaacacttttacctcttttagaatttatcgttattcacaatggaatcatcaccaactacaaagacttgaaaaagtttttggtaagtaaggtgacctcaaaagaccccagtctttgagaatacttctaacgagagcactggggtcggttgttgggatgtgcaacaaacaccatatgtgtgtcatcaattaatttcttggacaattccaagggcacggtggtttattggatttttctttgctaacagtggaacaattgtgttttttaatatgaaaaggaaatgattagcatttgactgtaatatacatgacaaaaggctcaaataaaattggaattttgtggagacattttttgcattctgagagattgtcatgctttaaagttcctaggatatattaatacaagaagaatcaggacaaattaaatgaaagttttatgtcgtaaatagctatatactgtatagtagtggtcatagtgctgacctgcatgagtgctttcttagggctgttcaattgaactttctccagtgttggaagacagtgtatctgggctattcagtatagtagccactgtccacatgtggttgttgagctagtatgactgaggaactgaattttaaattttatttaattttaattaaattgaaatagccacatacagctaatggctatttattagacagtaagttaagtgtatgttcagttaaacagagtcccacactgttttagagtcactgatcagctggtgactttaattttgaataatgggatatggtgttcaaagaatattagaaattagtggcattttgacggaacaattctgtagaaaaggtttttttatcattaatatttctttaattgtatcttttttttctttctacttacaggaaagcaaaggctatgacttcgaatctgaaacagacacagagacaattgccaagctcgttaagtatatgtatgacaatcgggaaagtcaagataccagctttactaccttggtggagagagttatccaacaattggtattaagccacatttttaaagataattatgccaacattaatgctgagaaactttctggaaattaagtttgataagcaggaactgtgctatttttttatttttggcttttatttctcatataactattcaagttgaataattttgagaaactgattgatttattgattcccccccaccctccatttaaaattctacttacttcattcaggtttaatgtcatgaaaatgaaaattaatccaaaatcagtgtgtctaaaaactatgcatatatgcacacatccatatgcaccacacgtggacatgtacacagtacacacgatggaggattagttattcccttgcttcttgctcatccgagtgttcttctcaaccaataacttagcacaatagtagcttcacagctaccacagtttattttctgggataatgcctgcttgtctctgagccaacaaagtcaactacttatttttccttttggggactttcccttggctctgaacttctatagaaaagcatttccaagcccatgagaaaatcagtattctttttgattccatccaacattcctaattaaagattaaagacatcaaagatctacaaatgtccaaatccatagtgatacctacatttcccttccccactcataactctagctttcccacttaaaagtcctttacttcccaaatacggtccagccctcacttctctcccacctgcacccaaatcttatatctgtagcaaaaagaggaagcaggaagatggagaatgtagaggcctattccttccctttccccaaggcagagtggagtagtgtgccttcccagccttttctcgtttctaacaggctttgccttttattcattgtataatccagtttgtgttccaaggtggttcttccctctcctacttcatgttcctcttttatctgttcttgattcctgtaagctctgtccctgaggattcgggttgatggagttgtatggtgtgcatgttaataattgtatatatttatatctctaatatcaaggtcagaaagagtggaagttaacagtggtgtacaattactagggcagagaataggttttggattttgatcttaggatcttttctaattctgtcgttcctctgataattcatagtattatgacgatatagataggtagatgatggagataggatatataggttcagaagtgttcatagcctgtagaaaggatgactttttaaatgatctatttttgtagttgttatctattgagcatattttgggtgtaggcttggttaaaaaagtgggtcttggctgcgcgtggtggctcacgcctgtaatcccagcactttgggaggccgaggtgggcagatcacgaggtcaagagatggagaccatcctggccaacatggtgaaaccctgtctctattaaaaatacaaaaattagcgtgggggtgcgtgcctgtaatcccagctactcgggaggctgaggcaggagaatcacttgaaccagggagttgggggttgcagtgagccgagatcgtgccactgcaccccagcctggtcacagagtgagactccatctcaaaaaaaaaaaaaaatgtgggtcttggatacaccaaagcttaggagtaagtgtttacttaaactttagacttgtttataaactggtacaaaagagcatttgtgtgaacaaaaaatttctgcgctgaagccagtatgttctaggcatttctgacttgataattgattaaatagtgctaatggatttttttccctccctaggaaggtgcttttgcacttgtgtttaaaagtgttcattttcccgggcaagcagttggcacaaggtacatataactctaacaatgactaatgtatttcaacatatttgagttacatgtttattcttcgtagactatacatgaccctttattataaaggctctgccctttattagatatattcatgtgagcatattttcacatcttccttcttgtctgttgcttaccactcttccatttaacagaatccctgaagaaagcaaatacaggccgggcgctgtggctcacacctgtaatcctagcattttgggaggtcgaggcaggcggatcatctgaggtcaggagtttgagaccagccaggccaacatggcgaaaccccgtctctactaaatatagaaaaattagccgggtgtggtagcacatgcctgtaatcccagctactcgggaggctgaggcaaggagaaccgcttgaacccaggaggcaagaggtttcagtgagccgagatcgtgccactgcactccagcctggcctacagagcgagactctgtctgaaaaaaaaaaaaaaaaaaaaaaaaaagaaagcaaatatattttggcatttaattggccttttgtctttgttgggcgcaccaaggttactttgtgaatttggatattgaatattatctaataaagttaaaatattagctttttctgtattttttgaaacatatattctagacagattcctagataattgtaccatcactacttcttgctaggatatttaggcctgatcatgaagtcctaagtgaggcgccctaagatattatggtaagagagatatttttaatctgaaaacagggtgactaaggagaaggtgctacactttcatatattggcattctgtgcacaattgaaaggaaggttccctttaacattacaaaggaaaaaaattaaaatacattgttacagaacaggtgttggcaagttttctggagtgggccggatagtaactattttaggctttctggaccatgtagcctctgtagcaactactcaactttgcagttgtagtgtgaaagcagctgcagaaaataagtaaaagaatgggcatgggtatgttccaaaataactgtatttaatacaatttttatttgtcaattaagaaaaataattaaaaaaaaaccaaaaacctgtattaggctgggcgtggtgactcatgcctgtaatcccagcactttgggaggctgagatgggtggattgcttgaccccaggagttccagatcagcctaggcaacatgacaaaatcccatctctataaaaaataaaaaatttagctgggtgtggtggtgcatgcctgtagtcccagctactcaggaggctgaggcaaggggatcacttgaggccaggaggtcaaggctgcagtgagctgtgattgcgccactgcactctagcctgggagacagagcaaggctgttgtcaaaaaacaaacaaataaacaaaaaccgtttatttataaaaataaaccctggggctgcaggtcagtttgctgacccctgatagagaatattttggatataggatcttgttctgtcatccaggctggagtgcagtggcgcgatcttggctcactccaaccttcacctcccagactcaggcaatcctcctaactcagccttccgagtagctgagactgtaggcacgtgccatcacacctggctaattaggagacggggttttgccatgtttcccagagtggtcttgaactcgtgggctcaagtgatctgcctgcctaggcctcctgaagtgctgggattacgggtgtgagccattgcacctggcccaatactgatttttttaaaaaattctttttatctagttcttatatctgaagttgagcttggggaggatgatttaaacatttgaagagtattggcccattaaattttatgtcattagtccattatttataaaaatggtttaattctaactgcttttgcaatttacaggcgaggtagccctctgttgattggtgtacggagtgaacataaactttctactgatcacattcctatactctacagaacaggtaaaattacctctacaaatgcagtgcagtagatatgaagaattattttccttaagttggaatagatggctctttggtcagatgcacatgtatatatagttctgtctagacatgaaaaagatttgtttttgtgagttctctgatgattagaatttttttctgttgtgtatccttagctaggactcagattggatcaaaattcacacggtggggatcacagggagaaagaggtgggaaatgcactctgcatggatggggaggatcttatcctcttttgtttattctttactaattcttttgttcttggagtgaatgaatgtgctgggcctctaaaaatgtgcttattttgtggggaagcatattttgacatttttctaatttgcggagtatattttgcgtgtctgcttttggcatttagaaagtgcttttaataatttcattaaaatttctgaaatttgagaaaatagttgaaattgtaaattattttttcctttgttttaaaatcatgtaggatgtatgcttagattaggaaaagagcattgtgtgctaggttattatagattgactaagtggtagttatttgaatcatttaggctaacttttaactgaaatatgtttaagtggtctttattttttatacatgacatattgttggatttacatttgctatcttgattggctttatttgaatttgtagtgattgttcttttatattgtttatgtgtaaagtttattttttgtttttcttatttatttacttcgatgtaacttttttatagagcggcagggggagacagggtcttgctctgttgcccaggctggagtgcagtgcagtggtatggtcatacctcactgcaatttcgaactcttgggctcaggtggatcctcttgcctcagcctctcaaatagctagtactacaagcgtgtgccatcatacccagctaattcttatttttagccagggttttgctctctcagccaggctggagtgcagtggtttcgtcatggctcacttcagccttggctgcctaggctcaagtgattctcccacctcagcctcttgagtagctgggaccacaggcatgtgccaccacccccagccaatttttttatttgtaaaaaggaagtcttgctatgttggccaggctggtctcaaactcttgggcttaagggatcctcccacctcaacctcctaaattacagggattacaggaatgagccactgtgcctggctcccagctaactttaaattttttgtacaaatggagtcttgctatattgcccaggctgttcttgaactcctggagtcaagtgatccacctgcctcagcctcccaaagtgctgagatcacaggtgtgagccactgtgcccagcccagaagtgttcttttcatttaaacagacattgatatctcaaattttttttaccttatttatttattttttgaaacagtcttgttctgttgcccaggctggagtgcagtgacatgatcttggctcactgcaacctctgcctcccgggttcaagcgagtctcatgcctcagcctccagagtagctgggactaccagtgcacaccaccacacccggctaacttttgtatttttagtagagacggggtttcgccattttggccgggctaatctcgaactcctgacctcaggtgatccgcccacctcggcctcccaaagtgctgggattacaggtgtgagccgctgcacccagcctcaaattttttttacatattttaactaaatatactttgttatttgaagaatgaaattatcaatatttggagaaaaaacacagtgaaactcaagcctattaggacattttataagcaaaagtagttgtttttttttttttttttttttttttgagacgaagtctcgctctgttgctcaggctgtagtgcagtggcgtgatctcggctcactgcaacctcggcctcccgggttcaagcgagtgtcttgcctcagcctcctgagtagctgggattacaggcacgtgccaccacacccagcaaatttttctatttttagtagagacggggtttcaggctgttgctcaggctggtctcaaactcctgacctcatgatccgcccacctcggcctcccaaagtgctgggattacaggcctgagccaccacacctggttgcatttatttttttaaaatgctgagctctctttttatgtgtttttaaattcacttttttgttttgtttttgagacaaagtcatgctctgtcacccaggctggagtgcaatggcacaatctcacctcactgcaacctccacctcccaggttcaagcgattctcccacctcagcctccggaatagctgagactacaggtgtactctaccactctcagctaattttttgtgtttttagtagagacgaggtttcaccatgttggccaggctggtcttgaactcctgacctcaagtgatctgcccacctcggcctcccaaagtgctgggattaaaagcatgagccactgtgcctggtctctgttttttaacatacagtaatatttactctttttcatgtagtttcaccaattttgtcagatgcgaaattgcataagtaccaccataatcaagatacagaacaatttcatcactcaataaggtccctcaacctgccctctgtcatcaacccttgtctcattcccagcccctggcaaacactaatatgttatttttctataatgttactttttcttggatgtcatcttacatttatttttcagtttggcatctttgctgttaaatatgaatgggaaaagttactttgttttcatcactaaaacatcaaataatcacagatggtggaaaacttcgaatatactttttttggcttttatttttaatagatatataattatatgtttatgtggtgtatatttcaatacatgtgtacaatgtataatgatcagctcaggataaatagcacatttgaatgcacatttctgataattatcaagtctgcctttatatgtgcattttaagaggatagatgaaatagcagtttttataagtatacttgtgatgttctctggctattgtgtccatagttctaagttctgttatgtcctggccttgaagaaaggtgcatttttgtctctaggacatttatgtagtcttcaactaatagatttttttcctatataaggccaatttataaaaccttagcattccagttttgatgaaaaagttaatattaatgtcttgacaaattaagtagaggtgtcataattctgaaatacaagaattaaaaggatattagctttgcaaaaagaccctactttatcctgacttaaaggaagagtaagaaaacccaagttgaagaaaggagagtttcttggtttataaattttgtctctaacagtgggtgccacatatgatataccgtgattagagagtgatatgcatctgttttgttttcaaatcagaattagtgtagactacaacttgatttgttatgctgacttgctgctaaaatctagtgaggttttgttatgatacaataaaaattaatttgccactagccttcattttctttttcttttttttttttttttgagacagagtttttgctctgttgcccaggctggagtacaatggcgtgtgatttcggctcactgcagcctccacttcctgggttcaagtgattctcctgcctaagcctcccaagtagctgggattataggcgtctgccaccacgtctggccaatttttgtattttcagtagagatggggtttcgccatgttgaccaggctggtcttgaactcctgacctcaagtgattcacctgcctcggccttccaaagtgctaggattacaggcgtgagcccctgtgttcattttatttttcgttgcacaattttgatattttaaatgtaattttgttataattataggtacacaaacttttatgtgttaagatcattgttttgtataaagttaaaattaatttatacatacttttgatttaaaaaaccggttaatattaaggaattacttgtcttttacctggaaaataaatattatattaaaaaaacatataatgtagcacttttacctgccacgcactctttgatagttgctacttcactgtacactttttgtctgttcttattggcttattgcatggaaataaggtgatctacttggctttttaaatttgctaaaattgttttgtgttgctatgattttttcttgattttatagaatattatgcatatttctacattggacatgattttctacatgtttgccaattcatgttaactatatgctttaggcaaagacaagaaaggaagctgcaatctctctcgtgtggacagcacaacctgccttttcccggtggaagaaaaagcagtggagtattactttgcttctgatgcaaggtgagcttccttagttgattcaaagagatttttagtaaaacttctcattctgcaggaaacccaagaagtcattgtgtatcagtctagttgtgctctgtgagataactttttaaattaaagaaatacaggtgaccattttggagatggggctgtaaggacactttttctgtcatttcaaagtatgtgggtcagtttactaagaacacatatactgcttgagacttgttccagtgtatttattttagagctcttacatttttttccttcttatttcaggagccttatccaggttttgaagggaggagattctagattgaagagtaaaatggcttagttagtatcccaatagttatagcatagttgctaaactattgtagttttagtctaatgtagatactcatcttttacatttagaattaatttgcagcataatcatttttataaagggatagtagtagactaagatattttgagagaaaatgcagggggatgtttacatgcatttgtaaatgaaatagtaatgaggataaaataaaatcaccgaaattgcaaacaagtatttgagtcatccactgtacctgaaaataagagaaaataataaaaataagaaaataatgccatttaggacatcagggaatatattatctcagtgggaaaacaagctttactctttaatgtttttacaggtgtgtaaggtgtgtagtcagggctaagatgtgtaagattacacagttgacagttatggcttaaatacactggaattacagaaacatatcagccttttctcattcatttatacattcatattgaacactgggtgaagtcatatgctagcgtcaggagataatggtgagtaaaaataaaaatattacttttccttaggagctcttccatagtgaggaggcaaattttaaacaatgatcacagaagtgtagaattccagctgtgacaagagctgcagaatgctagtaacagagtgatttacccttggtgggtaaatttctttaagggaatgatgtttgaactgagagttaaggagagattaggagttaattaggttaacaggtagagggaggaacattcattctttgcaaatggctcagcctgtgagagtttaggatggctttgagtgtggccagaatagagagagtgagaggaagcttggggggagatgaagctggagaaggaggtatagggattacggtaaggcactttgttgtctctctgagagccaaagggaaactgtcaaatggtttgttgagtgaaggagaaatctttattagagttgttgccttttgatatcaattttggcagaaatggaggatggacggagagagatcagagagaaagtgggtggactaattgggagatcgctgcagtagtccacccgaggagctgatgggagcttgaatttgtctggtggtggacatagaaactaagaatatttggaagttaaaatttcaggacttggtaatggatagaatgaggaggaaacaaccatgctttctgatctaatctgtttggtttagattgctatgcagagttccttttattttttgtccacaatgaccaccttccccatactttcctgtaggggttggcattagtaaccagaaaattctctgagatactgcagagtgatagagtttatattgaaatttggttcttgtatccaaatgatagtttcatttgtaataatgatccttggttatcgattgtaatatctccttgaaaactttatagtgctgtcatagaacacaccaatcgcgtcatctttctggaagatgatgatgttgcagcagtagtggatggacgtctttctatccatcgaattaaacgaactgcaggagatcaccccggacgagctgtgcaaacactccagatggaactccagcagatcatgaagggtgaaagtttttgtcatgttatagcttgctgtccttactggaaagaatatattctacttcctttcctagcatattaaatctagtaatgaatgatgagtggaatcttccacatgattagtgaagggacaacgctaggaaaagggatgattctttagagaaattatctgctgtttttacaatcgtcttcaaactaattaatgatttgttatttgtaacattataaaaaggttattaacacttgatactttaaagatactttataaacataaaaatagttaatgttctgttcctttttattctctttgtgctttagttttcttatatataacatgaggataatatagcctgcctcattaaggttgttttgaggattaagaagctactatatggctgggtgcggtggctcacacctgtaatcttagcactttgggaggccgaggtgggcagatcacctaaggtggggagtttgagaccagtctggccttgccaacgtggagaaaccccgactgtactaaaaaatacaaaattagctgggtgtggtggcgcatgcctgtaatcccagctactcgggaggctgaggcaggagaatggcttgaacccgggaggcagaggtttcagtgagccgagattgcgccattgcactccagccttggcaacaagagcaaaactctgtctcaaaaaaaaaaaaaagaagcttaaaacagtgtctgacacacttagtcgtatgtaatatttgcttctgttaactattataattattatgatttggattattttattcctttctgatgggattgtggtaggaataaaaactaacattggccaggcacggtggctcatgcctgtaatctcaacacttagggaggccaaggtaggaggatcacttgagctcaggagtttgagaccagcctgggcaacatagtgagaccttatctctactacaaactaaaaaaaaaaaaagtccaggtgcactggctcacacctgtaatcctagcactttgggaggctgaagcaggcagattgccagagctcaggagttcaagaccagcctcagcaacatagcaaaaccctgtttctactaaaaatacaaagaaaattatgggcatggtggcatgtacctgtagtctcagtgactggggaggctgaggtgggagaatcacttgaacccaggaggcagaggttgcagtgaggtgagatcgtgccgctgcactccagcctgggcgacagagtgagactctgtctcaaacaaaacaaaacaaaacaaaacaaaactatgagccgggcatggtagtgtgtgcctgtagtctcagctactcaggtggctgaggtgtgagaattgcttgagcccaggagattgaggctgcagtgagcggtgatcttgcggtgatcacttcagtctgggtgacaaagaccctgtctcaaaaaaaaaagtaaaaataagaaataacatttattgcataactctatatatatatatgtcagattttttgctttattaatccatactacaatccatactgtgaagtaattggtctcttattttatagattaataatttccccagtttagatagtaaaggatagaactacagtttgggtgggttgcactccaaaacttaaagcttgtcccagttgactgagtgcggtggctcacgcctgtaatcccagcactttgggaggccgaggtggttggatcatgaggtcaggagttcgagaccagcctggtcagtatggtgaaaccttgtctctactaaaaatacaaaaaattagccgggcgtggtagcacacgcctgtagtcacagctactcaggaggctgaggcaggggaatcccttgaatccaggaggccaagattgcagtgagcctacatcatgccactccactccagcctgggtgacagagcaagactccgtctcaaaaaaaaaaaagcttgtctcattcacttgttgtaactgcacatttcaagtatgaagttaattaaaagtgacttttactgttatttttttccacagagtaaaatatgttcacccaatcttttaggcagtcatgtctattgcatgaacttttgttatattttatttaccaagattatattaaaggaaacttttagttgtgtacaaattcttttatttgatttgtttttgttttaattatgtgatttctattactataggcaacttcagttcatttatgcagaaggaaatatttgagcagccagagtctgtcgtgaacacaatgagaggaagagtcaactttgatgactatactggtaattacatatgaattattttattatttcagtgtctctgacagtaggaggtgccattaacaacctgaaagttcattgcccttaatagccttgtagaacaactacagctgccagccatcagtggagcccagccatcttggaaaaagttctttagtgtgtgattctacctatataagatatctagaatagtcagattcacagaaagagaaagtagattaatggttaccaagggctgtggggaggggaaatggggagtcactgtttaaagggtacagagtttcagttgtgggatgatgaaattacagaaatggattgtagtgatggttgcacaataatgtgaatgtgcttaatgccactgaattgtacatttaaacatagttaaaatggtaaattttatgtgtaggtcacccactgtgtaccagggactgtcctaggtactgtgaattctaagaagaataagacctggtcccgttgctgggcagcttatgtgtatctgcctggcctaggtttcctttctgagtgtataaataagtaaaagtgtgaacttccccagaggtctttcagttatttgcctgatgcctttggataacctgtaccctcctgcatttttaaggtagaggtgagagtacaacactactcttttttttaggatggagttttgctattgttgcccaggctggggtgcagtggtgccatctcggctcaccgcaactgctgcctcccgggttcaagtgattctcctgcctcagcctcccaagtagctgggattacaggcatgtaccaccagaggaattgtatctgcctctgtagacagaggtggttgttgaagatggttgagctggaagaactgggagagtagcagtaaattcttttatggtatttatggaaatgaggtcaggaaaaagatttgttttataagggaagaaaatgagacaaactttgggaagttcacggttttaaaaagtacttttggctgggtgcagtggctcatgcctgtaatcccagcgctttgggaacccaaagcgggaggatcgcttgagctcaggaattctagaccagtctgacctcctttttactaaaaatttttaaaaaattagctgggtgtggtggtgggtgcctgtagccctggctactgaagagcctgaggtgggaggattgcttgagccctgtagatcgaggctgcagtgagctctgactccaccactgcactgcagcctggttgaaagacctgtctcaaaaaaaaaaaataaaaaagagtacttatatctgtattatgtacataaaagttctgtaataaaacaggatagctgtcatcttttttgttgttaggatgaggagattgaggctttcagtttgtcaaaggtcacattgttagtcatttattgaaccaaactactccccatgtattcattgttctaagtgctctccatcccctcccctgtccatcaggcattctttcttttgcctgtagtgatggcttacctcatctcaaaagggatcaggcttttctcaaaagcatcaaatttagagctttgggcagcttctttcagaactatcccaactatcctcagccaccagaaatttctaggactaattttaaggaaacaaccgtggccagctaatctcactgtcttacatccatgtcattctttgtcatcatctgcaatacaggtctttctggtagttggtctgcctttttttttttttttttttttttgctttgcttttatattgagtctttgcctttgcatgaccctgatccagccttttactgctgtttcctttcttctcaaacatttgtaattaatgccaaggtctgtggaaaacactgtaggcagaggtacacaaacaggcttggtctagtgcagtaacagcaagaaggccagtctggctggtgtggcctgagtgagaagggatgtgctaggtcagagtaagcaggagacaggtcttatgggacttgaaggccaaagtaagtagttcggatttgattataaattatttgggaagctagtgacactttttattttgtttggttttgttttctacttgctaattttttaaaatagagaaacataccttctttcattattgaaattcaaaacggagaacatataattattcaaaagataaaaagtaaaacacataccttggttttatagtataactaactaagataaaaaagaaggtggactggctgggcgtggtggctgacacctgtaatcccagcactttgggaggccaaggtgggtggattacttgaggtcaggagtccgagacgagcctagccaacatggtgaaaccctctctactaaaaatagaaaaaaattagctgggcgtggtggctcgcggcctgtaatcccagctactaaggaggccaaggctggagaatcgcttgaacctgggaggtggaggttgcagtgagccgagattgcaccactgcactccagcttgggctacagagcaagactctgtctcaaaaaaaaaaaaaaggtgaggagatgaagagagcaggggcagagtagacagactgaaaatggttcagagagagcagcaggatgaggcccacgaggaggtacctgtcattctcctcagccagatttggaattgtttgagtccagaagctctcagtgccttgaccactatatttacttggtgggtgattagggaattttagttgaccagttgaatgaatgttgaatgagaatttctcacagatagaaaactagcctgtgtggaaggatttctggacaagacacatggagaacaacatgtaaatagctatagaaactgaaaatgaaaaagaggacagacttcattggagggtctttatgtttttaaaggatcactgtaagagatccttctggtagcatatggagagcagactccaggaggtggagaacagaagagagaactggagaatgttgctgtcgtccagggagagatgctgggtttgaagataaatgtggagggatcagaacaatcaagcattttgactgaagcattaggggaatggggacggcaaagactgagaggagagtgggtttatgttactctacagagcacctttctgggcaccagaggggaaataaacgtaactgagataatgtttttcccagacaggtttattgagacataattagatataataaaattcaccattcctagtgtataactctaagtttgacaaacctctacaacatagtcataatcataacctctacaaagtcaagatgtagaacagttccatcactcccaaaatttccttgcaccctattgttgtcaacccctcctccagctccagccctctacatctaatgatctgttttctgtgtccctctacttttgcctttaagataactttcaaagagaagaatgtaaaaataactaactaaggtagaatgtaataaatactgtaattgtgtggggatgtagagaggtgagtaaggtcagttacaagtttgggggcgccagtgaagttgtgacttatttaatttacttttcaaaattacagagaactgtgctttccaagaggaatattaattctttaaaacagcagtattcttcctcatattggcagtggatactcacaaaatgcgattgcctagttcacatggttctttgctaaataattatgtacacaaacttttatttcagtgaatttgggtggtttgaaggatcacataaaggagatccagagatgccggcgtttgattcttattgcttgtggaacaagttaccatgctggtgtagcagtaagtgctttttaaaattttaattatgttgaatattagagaatatctgtagaccaagtagtagtctaataacatactgtgtaaaactatgttttgttaatgtgttatcttttcccttttgtgataaaaaaagaaggtaaggggagaaatttaccagctgcttggaattatttatccatggaagatctgtagaaaaggtccctagatatacagatagacctcctgcaacggacttcatgaaaggccaagagggggagagtttgtgtactgtcctagacttgtagcctagggagcttgcctacatgtgtaagagccatcgttgggttttgcttagcattgttcacttgccctagacagatggcctgcatcatgtgtgaacctcagtgcaattttactttgtgggcacattactgcaaagaaaggtagtctgcttttttttttaaatcagattttattctttaaattgttcttttagaagctgaaattcagtatcaaaaatgtgtattgtcagtgcagaagcataggtgtatgagggtcttttattccaataaaagaccaatatttgcccacgtagtttccttagaaagagacagtttatgtgttgctgatgtcaactgttatgaacagaagacctttacattcaatttctgcttttaggattgacttccaaagttcctgacataacttatttatttgctgaggcataaatatttattaggagccatttatttaagcagtgagtgaaactatctggtcacctgcccttgcatctcaacaagctttgctcttttctaagactacaccaaatacctcctcccctcctcccccaaaattatatggtcctaaacagaaagtctatgtaatgttgaagggtagaggtctaaaaaagtgattgttttgtctgggtgttgtggctcacacctgtaatcccagcactttgggagggcaaagtgggaggatcagttgaccctaggagtttgagcctgggcaacatagcgagaccccgtctctaccaaaaaaaaaaaattatcggggtgtggtggcaactccctgtagtcctagctacttgggaggctgaggcaggaggatcgcttgagtccagaaggtgaggctgcagtgagcctagattgcaccgctgaactccaacctgggcgacaaaaccaggccctgtctcaaaaaaaaaaaaaaattttgaacacgggaagaagaaagatgtaaacacgttagtggtggcttagatctattactgaatgagccctgtattcagaaatagaaaatttgattaaacgcttcatctaacgctaagacaatttgggggcagaaattatatactctgttagaattctctaatgtaagattttttgttgttttgtggatgccaagactactgtagtaaacaaacattagaaatccccctgtggtttatcagacaaaatagtaccatttattttatcctgttttacatttttgttgttgtttcatgacacatttacatgttttttttttagtatctatatcctgaataactgactacactctaatcattcttaactcatttatgccagaggttgcaaaatttttttgtgaaaaatcatcagaccttggtgctgaccttgagcagtaggatataaataactcccacatgcttaacgttccagtgatggaacactaggcataaatgatttaagtatagcctacttaatatgcttttcaaaattttaattttctctaggttttgtagtggcattcagtggaatttatagcattaagttactctattgtgatggaaatatgtcattttgtgtatttataaaaagttgttcgcagctgggtgcagtggtgtgtgcctatagttccagctcctcggaagctggggcaggaggatcacttgagaccaggaatttgaggccacagtgccctagaatcatgcctctgaatagctgctacactccagcctgggcaacaaaccaagaccccatctttaaccaaaaaaaaaaaaaaaaaaaaaaaagttgccccaactaaaataataaactattaattagcacagataaatcttgagattacttttttggggtttattacttttaaatatctggtaagcctccagatttctatctttctctcttctttccccatctttttattttgaagaatatgattccaatgtaacatttatattataaactgggtgaaaaggtttggtttacatttatttgtgggaaaacatttagcattttagtgtcggtaacttaattatgtataataaaatatattaatggaaaagaataataaaaaataggagcattttatcttcaatgattttctttacatgatgttgtaatattgttaaaaaatgccaaatcaaagttatttaatatttttgggggaaccaagtaaaacgattctgttcaaatttgtgggcaagcaaaagttaagggctatgaaataagggcacctttaagttctttattgctgagaaggaggaaagctgagatgggtgagagatggggagggccacttgcctgaagaggctggtgaaaggctgtcaggttaggtgagctccacagttagaattaaagcaacactaaatgtatacattggttgagcttaaagtttttgctgcctaaaagataatttttctgtttttgattttccgatgtttagtgtaaaaataattagaatggaaatttactgaaatgaaggttaaactacgttttgcacagaggcatactgctccctacttcattccccctgccccatgccacaaaagttgaaaatagtgagccctgttaaacaagatttctaaaatatattgacttcttttgggaaatggtcatatttatgaatacgttgtacttttaaagtgtttaatttttctctatatatttgtacatctgttacctgatttgaaacccctccctaacatgggtattacatgaattttcattttaaagattaggaattgggaggttagagataacacacaagctgactcagaaccatgctctttccacttctcaaaacgttttatatgtgtgggtatgtttccttataagaatgtatgtgtccaggcgcagtggctcatgcctgtaatcccagcactttgggaggctgaggcgagcagatcatgaggtcaggagattgagaccatcctggccaacatggtgaaaccccatctctactaagctgggcatggtggcgcacgcctatagtcccagctactcaggaggctgaggcaggagaattgcttgaacccgggaggcggaggttacggtgagccgagatggcaccactgcactccagcctggcgacagagcgagactccgtctcaaaaaaaaaaaaaaaaggaatgtatacatagatagttgtctaaagagactgatagtaaaatgttagccatgcttatctcaagtggtaggattttgattttttttttttaaatattttaatctgggttgtttttattttctaacgtgtcatttttgtaatcagaaaaagcaaaaactatacattgaatccaaagaagtccgatgaaagagtatttgaaggaaagttctgtgaccaagtcatattttctctgcagacacgtcaagttcttgaggagctgactgagttgcctgtgatggtggaactagcaagtgacttcctggacagaaacacaccagtctttcgagatgatgtttgctttttccttagtcaatcaggtgtgttaattttaaagacttaaaaggaaggaaagttattctttctaataattctagcatatcttggcaaaagctgatatttaaagataaactggcattgcagatgacttgacgaatacagatttattttaatgttacataattctttatgaattagtaaaaatgaacaccttttgtgttcaaagagctggattttcaatgacagagaaggaagagagatcctgacaagccatattacttaaagttttataaatttattaagtggatgttttgtattttatttaaaacaagtaatattgttgaaagtgtggtcaatttgtttttgctcctaagaaacagcatatgttaaaactgttctgtgtgttatggttggcctactttttacacaggtgagacagcagatactttgatgggtcttcgttactgtaaggagagaggagctttaactgtggggatcacaaacacagttggcagttccatatcacgggagacagattgtggagttcatattaatgctggtcctgagattggtgtggccagtacaaaggtaaattcttgactcatttctctgatgattatttaatcatagtgtcagtgaagcagactagtctgtagactagtctgtatcttatttttgttagcagttatagaactcacacattttatttttgttagcagttatagaactcacacattttactaatcattgtaattattgtaggactttagggtcagatagataaaagacttgtcattctctccctcttcctgatagagtttaaaagggacttatgtatataatgtaagtccattttgaaaaggtctctgctggctatccttgtctatcgcttactgccctcctgctaggcacagtaggatacataacaagtatataacatccccttcttttatgaagtatagtctggaatttgaaaagtaacaaattagaaacatccactttaaccatttttggaatttttatttacctatttatggtttctaataaataatgtaaaaatatacatactacctctgaaagtttgtaaggaggaatacacctttggtataaaatttggcaactgccaggcatggtggctcacgcctgtaatcccagcactttgggaggctgaggcgggcggatcatttgagctcaggagttcaagaccagcctggccaacatggtgaatcccgtctctactaaaaatacaaaaattagccaggtgtggtagcacgtgcctgtaatcccagcatacccgggaggctgaggcaagagaatcacttgaacctgggaggtggaggttgcagtgaagcgagattgtgccactgcactccagtctgggtgacagagcaagagtccatctaaaaaaaaaaaaaaaaaaaaaaatttaaaatttggcaattaaaaaaaattttttaatgagtattgtatgacaatatctttctctttagatattgctctggggaggtttaaaggtactgtcttgtgttttgaaggcctggtaagactactttgctctttggaattggaatatgcataaatttaggtggctaataaaaataggaaatcttagaaagttgtataaatacaagagatgttatccctccacaagtgtttttttggggttttaggtttgtttggttgttatttagagacagggtcttgttttgtcacccaggctggggctggagtgcagtgacaggaatcatagctccctgcagcctcagactcatgggctcaagtgatctctgcctcagcttcctgagtggctgggactgcagatgcaccaggctagttttttttttttttttaagatggggtctcactatgttgtccaatgtgttactttttatgatttcacatttttgttttctcaatatttttctacttaagtttgatatttcttgctgattatctaataagatgttgggatattggtggatttgagtttaattaaaggattgtgaaagacaatgttaatgtgtacataactgcatttgaattcttttccctcaaagattctcatagagaattttttgtagaaagtttgtgattcttatataaaaattcttcttttctttttctttttctttttttttttttttttggagacagactctcactctgttggccaggctggagtgcagtggcgtgatctcagctcactgcaacccccgcctcctgggttcaagcgattctcctgcctcagcctcccaggtagctgggattacaggcacctgccaccacgcctggctaatttttgtatttttgatagcaatggggtttcaccatgttggccaggcttgtcttgaactcctgacctcaagtgatctgcctgcctcaacctcccaaagtgctggaattacaggcatgagccacactgtacctggccccccacctttttttttttttttggagacagggtctctcctctttatcatccagagtacatagagtgcagtggtgctcatggcttactgcagcctggaccttcccaggctcaggtgatcctcccaccttagcctcctgagtagctgggactacaggtacaggccactacccatgcctggctaatttttgtatttttttgtagagacggagttttaccatgttgcctaggccagtctcgaactcttgggctcaaacgatctgcctgctttggcctcccaaagtgctggggttacaggcataaaaactcttgagtgagatttttatttcttgggtatttcgatattgctaacactataatttacagagtgctgaaacttgaattttctccatatggtaattaaaacgtgttacatgtttgtgcttgggtttccatcctgtggctgaataaatgaccagccacctttagtagcacttaaggatttgattgggggattggaatcccagaggctctttatttataacagattgtgaaacaagggctacaacgtggtgtatgtgggatatgggattgtttggatggatgccattgacttaatcttttcataaaatgtttctggaattgtgagctgccaagggaaatatatattttacatttctcattcctttgtttatgagaactttaatttgcctcaacattttatgatgatgattttcaaatatacagcagagttttaaaaattttacatacaggctgggtgcagtggctcacaactgttatcctggcactttgggaggctgaattgggaggatcacttgaggctaagagttcaagaccagccgaggcatcagagtgagaccttatctctataaaaaatacaaaaattagcggggcatggtggtgcgtgcgtgtagtcccagctactcaggaggctgaggcacgaggatcccttgagcctgagagtttgaggctgcagtgagccatgatcacaccactacactctagcttggatgatagagtgagaccctgtcttaaaaaaaaaaataaaaattttacattagcattggtatacccaccatctagcttctaccatagcatattcaccaattttaagtgtacagttttagtaaattcatttggctgtacaactgttatcacaatccagttttagaagatgatcacctgaaatattcctttgtgtttctttgtagtcaatccttactcctaccctccagcctcatactcaggaactactgttttctcttgctgtattatggcattttccagaaaatttttgtaaatggaattgtataacacgtcttgtgtgtctagcttctttcatttagcctgaagtttgttttttaaataaagccagttaaatttagcagtgaggtattgtataccaactttagtaacgctaatgttaatgagttctagtgacccactattggactaccctagcctgaagtttttgagatttgttcatgttgttatttgtatcattagttctttctttctgcaaatcttttttttaaatatttttattttgaaataactatataggaagttgcaaagatagtacagagaagtcttacatactttttacccattaccccagtggttaccacctatataagaaaaattagcatctttttagtacagactttaatttttttcaaaaataactcttaaaaaaattgagtaagtatggcaatttagtatttcatttttcttggattctaaagtaattttattcaaatgtcttagacattttgggcttagttacttacaataagttttgggttatttagtcacagaccattccaggtggcaaataagagtttttatgttaatgggtattgaaagaagtcgattattattactattattattattattttgagatggagttttgctcttgttgcccaggctggagtgcagtggtgtgatctctgctcactgtaacttccgccctccggtttcaagtgattctcctgcctcagcctctcaagtagctgggattacaggtaactgccaccacgcctggccaatttttgtatttttagtagagactgggtgtcaccttgttggccagtctggtctcgaactcctgaccacgtgatccacccgtcttggcctcccaaagtgctgggattacaggcgtaagccaccgcgcccagccaaaagttgattattgatcctaatccctgggcccagtgatggagcacatagaagaattctgtgatcttgcctgtaaattctcaactttgcctgaaaaactgtcaggattagagggatcttactgagtttctcatagtatcagaccatagacaagttgatactactggaggaattgatgggtataaatggtaggttcagcaatttttatatgttattgcaggtgtttagaatttcaccacagtgctgacttttgttgatttaaaaaaataaaaatgtaactttgtttttggctgaacaaaaagaaaaaccaagtttaaaatttcagagtcagcattttcctggtaaactctttcaaacctcggtagattctgaatgtagggtatagcttatttttcctcataattggtttcctggtatgtattgatgaaattaaaaatatgaaattcaaattagaaattaaactgtaatagcaatgcaatggaaaaacatggattaaagttgctccgtttaatatttgtacttaaaaactagtgttcagatggtttcagttcaaacaaataaacactagtttgtagaataacatttttagttatgggctacaggaactggaatactcattatctgatcagtttggattggaaacagtttaagtattccaggggtccaagatacctctggcctggtagtatgttttgtgattaattgattaattgaaaagtaaaccacagtaggaagaagtagactggaagagtctggaatttagaatatagatgtgctcattagtctcggaggcagaggactccaaattcactttagtgttatgggaaaagattccagtctgctggtggaatataataggtgtacagggaggcagttgtggaggaccatgtgagcagctggaggctgggaagtccagcaggaggaaacagggagtctcatttaactattgggatgttaaggagttaccagactgtgattttattatagagggagtctcatccacatcatgccaggaaatcactaatggagtaatcccttatcaagagaagagtaatagaaattcagcatataatccgcgcgcgcacacacacacccctcagcataaatttcctaaagctaaaattatatctaacactgtaactgacaacagcacaataacctactgaaagagatgtaaataaaagcctcaaatatctgaaacataaaaatgtttttcaaaataactattggattaaaaaaaatcagaactaccattaagaaagacttactagaggccgggcgtggtggctcatgcttgtaatcccagcactttgggcagatcacttgaggacaggagttcaagaccagcctggccaacatagtgaaaccccgtctctactaaaaaaacacgagaaaattagccgggcatggtggcgggcgcctgtaatcccagctacttggggtggctgaagcaggagaatcacgcgaacccaggaggctgaggttgcagtgagccaagatcatgccattgcaatccagcctgggcaacaagagcaaaactgtgtctcaaaaaaaaaaaaaaaagaaaagaaaagaaagactagaaaaaagtaaacaataaataataggggtaaaaatttagagtgtgtggccaaagtgataaatagagggaaatagcattaaattcctagcacaaattgatgaaaatgccatatttttaaatggaaagattgttttgtaaagaaatgacatatcttgggttagaattagtgttccttcaacttgcactaaaattaatttcaaacaggctaaaaaggaaaatgttaaaaaaataaaaaggaacagtgaaaacaaaagaagtaagaaaatttaataatacttagtttatgtaggatgtggaagagttatctgagtctaaaagtactacgtaaaagttaaaaaattatgtcagcaccaatataaaaggtcagtccacgatgagaaaaaatatttgagacataacaataactaccttcttttttttaattttagagaatagtattgtattgaatacgttttattcacagaaaaataaactttaatctacaatgaatgccagattatacagcagaaagcagttttcttagttttccacatagaaaggttcttactaagtgaaaaaaaccataaaattatattcagaaatatattactctgtctcaaaacatttcacatgattattcacaatactaatacaattagatcagtcattcagtcaggttaaaatataacagtaatgaaaaaaatgcaaaatctaacataaattatattaaaacccttgttacatcacaccaaaaatgcaaatttcttactaaatccagaaaaatggtaacatatatagtaatttaaggtattacattaatggtacagaataagaaagaagtggtaaactctgaaaatctgtaggcatatctgcaaacttcagacttcaaagtagaatctgaccacccaaacattaatgtagcatttgtctaatttttttgttttgaacaataactaccttcttaaaaccaatttgaataaagaaactcaagttgaaaaacaggtgaggaacaacaaagtcagttgtcaaaagagaaaatataaatggtcaacaaacatgaaaaaaaagcttagctttaggattcaagatatgtatgctaaaatagtagtgaaggttcattgtcccgcagtcaaaatggtaaaagtttgctaaagagataattctcagtatttcacagaacttgacaaaacaggcacatctcacagtcacataaagttagtaagaatgaaaatagtcttggcagtaggattgtgagttttgaaatacatacaattctgtatcctaagaaactaattgtcttttagttcaagctgtcatcaataaaatttatagtacgttttgagcctgtgtgtcagggattatacagaactgaatgcgttacatttgtctcatttaattgtcattataatcttgtaagtgtcatgtgcatttaacagatggggtatctgaggcctaaagagatgaaaactgctcaaggttataatgtaacttgacagagttcagttttaggattacacttgtactattatttaggagtgaaagcaagttataaaattgtacctgctaattaattttcttaactgtgtaaagaaaagaaaaacagtaaaaactttaaggcaatattcacaagtgttattaatagcatattattaatgtaattatttctaataacagatgagattaaatattatttctgtttacttttctacaactgtagttttccttttttttttttttaatgcaaacttaaaacataaaactgggattgaggaacaggcaataggcaaaggtggaaatcaaagagcaattaaaaaaaaaaatccagcaataccagtgcaagtaccccaaggagagtttatcaagcacttgccttttgacttacaccaaaaactaaatgtggttaggcacatgctgatttgctcatcttttccttcctttcttagggatattaggaattttataagcattcaatgggttataaggtgtttggcttttgtatctaagaaataaaggttgagtcatttgttcaagattcagaaaaggagaatagtgatagatttcccaagtactggttcagttcactgttactaagatagtttatttttgttttttggagacagggtctcactctgtcccaggctgcagtgctgtggtgcgatcctggttcactgcaacctctgcctcccgggctcaagtgatcctcctgagtagctgggaccacaggtgcacaccaccacacccagctaatttttgtattttttttagagacagggtttcgctatgttgcccaggctggtctcgaactcctaagctcaagcgatccccctgccctggccttccaaagtgctgagattacaggcatgagccaccatgcttggccctaacgtagttttaagagatagagaatatatactgtaaaaccaatgggaattttattttcagctttttaaaattaaaagttctaaattcttcagatgcagctgcaactaattgtcctgcttttttgtgatgtttcaggcttataccagccagtttgtatcccttgtgatgtttgcccttatgatgtgtgatgatcggatctccatgcaagaaagacgcaaagagatcatgcttggattgaaacggctgcctggtacaaagacactcatatattacacttttgttgtctaagggagtgggtaataggtaaaattctcttatccttgaagctgtggcttgtagctatttagtcaataagatctttctacgtttgctccgatgtattaaaaaaatacccatactgattgatagcacagaggaatagaaacactggtcttttgttatttgctgccaatatattgttattttatttgtttggtttattgtccttttttgctaatattacttcttagatttgattaaggaagtactgagcatggatgacgaaattcagaaactagcaacagaactttatcatcagaagtcagttctgataatgggacgaggctatcattatgctacttgtcttgaaggggcactggtaagttttctcagttctaattagtatcagtccattgacctgcagacctgacacatagtcatacttttacattaaatgaatgaaataggtagaacttttgaaagtgcttctgtatttatgcattgtggtttgtttactttgagaaagtgcaacagagaactctgttcagaagtgaaaatcaaaaagagtacattttaacatgataaacttggatttagcaagtaacttgggttaatttgttcaaatatgaataaagattaagttctctagataagaaatttaattgaggtcaagctgggcacagtggctcacgtctataatcccagcactttgggaggacatggcaggtagatcaaacttgaagtcagaagttcgagaccagcctggccaacgtggtgaaaccccatctctactaataatacaaaaacattagctggatgtggtaatgcatgactataatcccagctacttgggaggctaaggcgggaagatcacttgaacctaggaggtggaggtggcagtgagccgagatcacaccactgtactccagcctgggcgatcgaagaagactctgtcttaaaaaaaaaaaaaaaaagggttaaccagaaatatgaatatgtttgtgataatctaaaatctttaaaaagtccttgtggagctttaaaacttccaattacatgttgataatatagaaatagtgatctattaacttgttagatatatttatagatcagtggtcctttaatacttttggatagatagacagtggcttgacatatcagatgctttttataatatttacttaaacatggatttttgaaaagtggattgaagacaaatctggttctttcctattagaaaatcaaagaaattacttatatgcactctgaaggcatccttgctggtgaattgaaacatggccctctggctttggtggataaattgatgcctgtgatcatgatcatcatgagagatcacacttatgccaagtgtcagaatgctcttcagcaagtggttgctcggcaggtaagtcgggggactgtgagaacaccttggggatcaaagaggggagttacgctagcttatttgaatgacttacaaaacatgtttacacgtgttaactcatttactttggaatacagcctttgaggtttacatgtgaggaatcagatacttaagagtttttttttttttttttttttgagatggagtctctgtcacccaccctggagtgcagtggcacaatcttggctcactgcaacctctgcctcctgggttcaggcaattttcctgcctcagcctcccaagtagctgggattacaggcacactccaccacgcctggctaattttgtatttttggtagagatggggtttcatgttggccaggctggtgtcgaactcctgacctgaagtgatccacctgcctcaaccccccaaagttctgggattacaggcatgagccaccccgcctggcccagatacttagagctttaagaagaccaaggtcatagatctcatattgggcagaaccaagaccagaactgaggtcttggtctccacatcctgtcttcttttagttaacatatgctgttcctttttaatttaatacttctaaaacatttaaaaatgtattttaaaatatttttaaatatatatttcagctggttgcagtggcacatgactgtagtcccagctactctggggactgaggcaggaggatcacttgagtccaggagtttgaatacagcctgggtagcatagtgagaccctgtctctaaaacagtaaataaaataaattaaaaaaaattacacacacgcgatatatttcaggggaaatctaacatctaggttttattttaatattatataattgagttttcttcagatcagttggctttatatataaattccaaaagatattattccctaagcacaatgtggtggtaatgaacttgagctttgaagttaggcaaacctgcagtcaagtactaagcctggtatttcttagttgcatgagtttaaacaaattactggatcccataacgcttctgtttcctcgactataagtaataacaatcagatttactacacaggaatttaaagaagtctgtccgtgaggcttcatatggattatgcagtgcaatttttgcacattcgtaagctatagccctgcctttgcccaccagtgatgttgtgtatgtgtgtgattttctttcctaggggcggcctgtggtaatttgtgataaggaggatactgagaccattaagaacacaaaaagaacgatcaaggtgccccactcagtggactgcttgcagggcattctcagcgtgatccctttacagttgctggctttccaccttgctgtgctgagaggctatgatgtaagtcatctaccactgcagaaatcttgggatggttttttacctggatacattctgatttttttctcctaaatttttaacaatagtgtttgagaaatctatcaaatatatatctgtcacctgttatattttcatggcccaatttgtaggttacatcacaacatcttcttacccatagaacttgaaggaaccttggggttcacctccaagattgtgactcaccttgggtagtctccacctgttttcttaatataacctctatctcttaacagggcagctattggcatttggcaggacaattcttttttgtttggaactgtcccacacattgaagactttgtagcattcctggtttctcagccattgtggcaaccaaaacatagtgcttttgtttttagtgtcccctatgagggctactacttctgtagaggaccacagtagctctttctgtgtgaactggcacctttagaatgctttttcctaaccaatttcagtttttttcaggacacattatgtgattatattttctaatctaattctttgtagtctgtaataaagatggttaatgaatgtattgttttctgtttttataaacaaaaataatttgcttatagtaaccacccccttccccagtctatataatctctcaaatcttgctttttttttttttctttttgcaggttgatttcccacggaatcttgccaaatctgtgactgtagagtgaggaatatctatacaaaatgtacgaaactgtatgattaagcaacacaagacaccttttgtatttaaaaccttgatttaaaatatcaccccttgaagcctttttttagtaaatccttatttatatatcagttataattattccactcaatatgtgatttttgtgaagttacctcttacattttcccagtaatttgtggaggactttgaataatggaatctatattggaatctgtatcagaaagattctagctattattttctttaaagaatgctgggtgttgcatttctggaccctccacttcaatctgagaagacaatatgtttctaaaaattggtacttgtttcaccatacttcattcagaccagtgaaagagtagtgcatttaattggagtatctaaagccagtggcagtgtatgctcatacttggacagttagggaagggtttgccaagttttaagagaagatgtgatttattttgaaatttgtttctgttttgtttttaaatcaaactgtaaaacttaaaactgaaaaattttattggtaggatttatatctaagtttggttagccttagtttctcagacttgttgtctattatctgtaggtggaagaaatttaggaagcgaaatattacagtagtgcattggtgggtctcaatccttaacatatttgcacaattttatagcacaaactttaaattcaagctgctttggacaactgacaatatgattttaaatttgaagatgggatgtgtacatgttgggtatcctactactttgtgttttcatctcctaaaagtggtttttatttccttgtatctgtagtcttttattttttaaatgactgctgaatgacatattttatcttgttctttaaaatcacaacacagagctgctattaaattaatattgatatattc

SEQ ID NO: 36231 - DNA, 61985 bp, Homo sapiens; identical to SEQ ID NO: 36230

SEQ ID NO: 36232 - DNA, 452182 bp, Homo sapiens
atggcgggggcctggctcaggtgggggctcctgctctgggcagggctcctcgcgtcctcggcgcacggccggctgcggaggatcacctacgtggtgcacccgggccccggcctggcagccggcgccttgcccctgagcgggcccccgcgttcgcggacattcaacgtcgcgctcaacgccaggtacagccgcagctcggcggctgccggcgcccccagccgtgcctcccccggggtcccctcggagaggacccggcgcacgagcaagccgggcggcgcggccctgcaggggctcagaccgccgccgccgccgccgccggagcctgcgcgtcccgcggtccccggcgggcagctccaccccaatcccggcggccacccggcagccgccccgttcaccaaacaaggcaggcaagttgtgcgctccaaggtgccgcaggagacccagagcggcggaggctctaggctgcaggttcaccagaagcagcagctgcaggggtaagcccacacccccttccgcccgcccgcccgcctcgcgcgcaccgcccgcggagggacctgcggggtcagggccactcggagccccgcggtggccagggcggtcgcgcgcggtgggtcggctttctcctcccgcctccgcctgctctgggcgccgcgggaagaggggagtgcggggaagcccaggaacttttactgacgtgaaactccgagtgcattgttaccgagctgcgggtaaacacaaaaggcatttctgcctggggcgtaaccttctgcgcgcaaacccaactgcttctagaagatgggcgtaaacttgaggtcactacagtttaatccctcagcatcaattaaactctgcaactgagttttaattttggtctagctaatgaaaaaaatgtttcgagggcgggctagccgtaaagatccagctcctgttctgtggcctggaactttgcagcatcagagaaatcatgggcttggacttcgctgcacctgtggggtctgctttcctggggtggggtgtcttggtattgataaaagttttggttggaatgtttctgttactgggcgctcatagtgccttcccgttgtgggaattcatctcaggttggggtgtaggggaaaacttgttttgcttagttggcatgtttttttcaggggtgattccaggccatgtgccctcactcctttttggacagttctctctgaaactcatttccaatttaaaatgttggcccagataatagaaaaaataaatttggctctactgtaatttgggggtaagaaaaccatttgttgggccctgttctcccttcctgtatagccctaggtttatgcaggctttttggttctcccagcattccctgatatatgtatgggccttgcccctctgcttgggcagctttgggttgggcatccagggtacctgttaggactctctctcatccagagggttgcagaagctggaggctggcctttctggaacatgctggaagcttgggttcttgggaagggggtctttctgctgctggactcagcgatcttgctttgtttcagggtcaatgtctgtggagggcggtgctgtcatggctggagtaaggcccctggctcccagaggtgcaccaaacgtaagttgccatgttcacagtggccctgcacagtaggcaaagtggggggaggtgtccacatgggggcatctcacaagggccacttgaaagggctcgggggaagttgaagtctgaaatacaatccacccaggcttcattaccacctaggaagggctgggtcagggtaatgttagtatcaatgccagcagcaatacattgtacagaaccgtgctgtgcatccaagacttctctgaactcaacagagatattcatcattctggcacatctgtgaatcaggagctaggaaaaaaatttccatttgaggatatgccatatggcagaaccaatgtaattaatttgaacatgataccaacaaatgaaagacattctttacggtgatggcaggaggggcttggggagtagagggccctgttctggagtacaacatcaaagtttttatagcttcctgaaaacagcaaccagaatccttcatccttgaggcctgatggttttctagaatgcacttctctgctgctcttcagaactgatggatggggttctctgcagtgcttctgcagttcacatgcatgcccagcagtgttttttaaaaaatgtgttaatgatgcatacagatttcagaacactggaaaatttttctcctatgcattgtgaaattaaagatcagattaaaatgtattttgaggttcttcttgacgaattgatgctatcgggtgctcattggacataaaggagccttaccttccccctcagaaaaagtgaagcattcttagttgttctttgcatagagattgaggcattcccatgtggattggaattgtccaaaatttctgctgcttggattttaaaatacaggtggatgaattttaaaaattttggatacagtcaatctggtgaccttgtttgttgaaaatgtcttcaatcctgaaggaaacagaagggttttggcataatggccttacttttgtaaaaagggaaatgtccacaggttttatgatgtgttatgatcaagcagtaattgcagacatgaacagtcttctgactattgaactcaaaccactagatcagaaatgctcagggttctaggcattttagattaagtcataatttttcattttgtaacttcttaaattatacttgtcagaaatgtgttagcatttgtttagaatttagcattgctcaggccaaatgacatgtcccctctcccctcagtaactcattctgtccaaaacctgctatgatatggtttgcctgtaacatggagataactcgtctgttaacagcaccactgcaatgggatattgctgagtaaaggttaaaaatacggaatagggcctggtgcggtgactcatgcctgtaatcccagcactttgggaggccaaggtgggtggatcacttgaggccaggagttcgagaccagcctgggcagcatggcaaaaccccatctctactaaaaatacaaaaaaattagccaggtgtggtgttgtgtgcctgtaatcccagctactggggaggctaaggcaggagaattgcttgaacccaggaggtgaaggttgcagtgagccgagatcgctccactgcactccagcctgggtgacaatgactctgtctcaaaaaaaaaaaaaaaaaaaaattacccagacatggtggtgcatgcctgtaattgtaatcctggctactcaggagtctgagtcaagagaattgcctgtacctgggtaggggagattgcagtgagcagagattgtgctgggcgatgcagagagactccatctcaagaaaagaaaagaattcagagcaggattttacagataggcagaagctccttgatgcctgttggagagaatgctcaaaggctttaataagtttgcttggcaaatgatgcaattgagtgctgtctctgaaaagaggataggcccccattttcaggttgcttggggaattcggggatccaaagatgttctagaagatcccaagatgttccaaatcttggggaatctcttcatggcttcctgcttctgcaggcaagagaggcaaagaagtgggtgcctaggtttagctgggtttgccccctggtaatccagagagagatcacagaagactgctggtcagaaaaatcagtgttgaagttacttacagggctctagaggaagttgctatgttggtttaatcttacggtacctacaaccaatgcttccagcatttggcttaagttttcctgctggcttctaagaggtagcccttggacagtaccagcatctaagcaatgtgacatcactttccttttctgtggttttcagcattcagaagattaaccttcctgtacttcccagtttaacaaatgaatttaggtacaaatgctagaaacttaattcacagctctcttcagaaataattatgtttttaaaaggcatgctggggtaggtcagcgtgcgatccaaaataatgtatctctgaggtggatatttaaaagaggggacttactttgcatgtgtctgggagatccagggagctgagagagccttctaccttcagatgggaccactggggctcctgctgatgctataaaccttgtgtccatggctgagtagtgtgatgccaggaaagacccccggctttggggtcagaagacctaaattcaaatgctgcagccctcactagctgtgtggcctcagggagttcacttgacctgtctggcctgtattttcccactcagaaatgactgtgctaaaatcttgccttctttataggatggttgcaggtattaagatgaaaaaaaatgggtatgaaagccttggtgaaaccagaaagattaatattagagattagtattggatcaagccaagtaaattctatctcctttgtcgatgatttggttttcttctgtttgtggtttcctcctctcacttccttattatgcggagattgaacaattacacttgggtatggtttattacacataagaatacaaaaaccaatgatacgcccacatgaagttcccccttataatagtcatcataaaatatgcatggacatttaaatgtataacccaggatgtcttctaattgtcattacatgttgaagataatgaagaatttgagtttatataggtcatgtgcaattgatgcgaaaaaaatttctgtgtaagaggttggaagtgttcatgttgttcagtatttgcctaatccagtgaagaaaataaggtatccctttgagaaagcctggattgtttttagttgattgaaacctaatttaaatggaccatgatcaaatgcttctgaagactaaagatttagtgaaccttaaattgcaaatcagagagatgtgaacaagcaagcggcagactcacacaagggcaaagaatggatatgtgcactcaccaaagtggtcctctaggctgtagctgcccagtcacaatgtagagatgcctggttgcatgttaatgttccttttccagacaccatttgtatgtggatccctaggaatcgaaattatcgtgtgggatgtgtcattttagttaatattggatgactcttgatagccttacctgttttggacaaaagagatggagagatggaccacatttgtgctctttccaaggaattaacacttaaaggaatgttttgtgggttagggactttgtcttccaagtggggcattaaacccctgatgtgtaacatttttgcctcctatcatttttgtagttttttttttctgcgcccaaactgaacctccccccatgccctgcattggttctgccagtctttttgcccccgtctcagggtaagtgcaggccagacagagacattgccggtaggctcagctttaatgagaagactggacacgggaataggcaatacaaaagaatgaaagagaggagagtgaggctgggctggcagggttatggggtagagggaagagagatgatggcagatacgaatccaaagcgggtgcctggcacattgcaggccttccatacacgcatggatggttctttcatttactgtttagcttttaccatgtgccaggttctatgaatagaggagaaacacagccagctgtagggagtgcaggtctgtttttactcacttaactcgtggcacatcaaatgacttgttctctccttagaaagaaacagaaaatcgatattccattgcttttccattggcattcagcccatgctacttttggggaaaaaacccaactctagacattttccttaaattatatgcaaaggagacagagtcacatgcacccttggtgctcagagatgcagtggtggatggcatcatccaggagggtgtgatgtggctggagttcaggtgacctagagaacggtctcaggctgtcccccatccctcttggcttggcatcgtgcttgccaaacttgggagtcgagcccagagtgattatatatttttttgtatgcctgctatggccattggcagctgctttgccaatagatctgcagtgaggtttaccatgacaactgctaggagggccaccccggcccccatgtgggagggtcagctggagaatcttgtcatgtgacacagacaacctcggtgaagagagaggaacccagaggtcaagttcacactaggtcaaatatgtgttctcgagactagttaaaatccacatttaggaaccataacactgtaatagtgcttaaaccttcatgatgaagccctcctccggcccatgggcctgctgaggatgccgcccgccccctgcctgctctgctttatcgaagtttttgctgcccagtgaaccctgggcccttaggaagcctgacttgttgaaaagacctttgacaaccacagggttttgctgtttctgaccctgttatttgttgtcttggatatttcagacgtactcaaacatgttcgagagctcaaattaaattttcctaaagtgcagattttgcttcccagtccttcctagcaatgaacagaggcgacttggagtgtgagggctatgtcaccacccttttaatacggaccaaaatcaggtccagcagagaggagctgccgatggggtgggggtaacttgtgtggtgctgtggagcttacagagagcattttcttgatcttcacaccctgtagtgtcattgaggcagggatgctttattaaccctattccagacagtggggcagtgctcagatgccactgcagatcttgtggctcttcctactgccctgggcttcctggacatccagtgctgtgacattctttcttgaggtcttggtctgaaaactgtcctgacagtcctcagttatctggattggcttccactgcctaacttcacatcatgattttccaagctatgtgagttttctcgggcttctgtaacaagttccacaagctgggtgacttagaacgatagaaatgtattgtctcacagttctgcagtccagaagtccaatgtcaaggtgttgatagcgttacttccttctgaaggcagttctaggcctctctccttggcctgtagatggccgtctcttccctgtgtctttatacattgtcttgtgtgtgtgtctgtctctgtgtccaaatttcccctttttataaggacatcagtcatactgtattagggcctccactccccgcccccccccaccaatgatcccattttaccttgattacctctgtaaagaacctatctccaacagtggtcacattctgaggtacttggggttaggacttcaacactttgtttttttttttctagggggagtacaattcaattcatgatgtaagcctgcagatgccttgcacataggttggagagatgggctattcagagttggctcattcctggggcacttgggaaccctagcagctgacccaaggatgggtgggcggggctttgactgggcccctgccacacaatctgtgactgtggatctaatttggttacttttctactgcagcagctctggctgctccagggggtgttaggagagatgaggaattggccacaggtaattttggtgatgcctctggccatttttactggggctcttttaaagagattctaggttggtgtttcttacacatgaatgtccagcgggaccactggaagggtttgttaaaatgttgaaagttgttaaattcaacaaattgaatcaaaatctttggggtttttaacaagcatcccaaatcatgctgatggaggtggcccacagtttgagaaactgatctggaaggaactcagtcctgggcaatatttatgaccctttatgtgggaatttaaaggccaacctcaacgcttagcaatttagagaaacctctcaagcaaggcaggaaccctctaaacattgggatagctcggatttgaagaatgtatatacagtcaaagattgctgcacatgcagtttttacatccagtttttctttagttagttgaatgtttgaagtatatatgtgtatttttgggagagctggaaatttgcaaaattgttgctgcatcagtgattatgtagagtgccttttaaaaaagatttaaacactttggaacagttgggtgttttcttccactaattttttttaattacaaaatttttaaagttatatacatgtatatttttgcgagagctggaaatttgcaaaattgttgctgcatcagtgattacatagagtgccttttaaaaaagattttttggaacatttgggtgtttttttccacaaattttttttaattacaaaatttttaaagtacacacaaacatagaagctgcccatcagggtcatgtttttaaaagctccctgatgtggtagttaagtacaatgatttatacataaaggagaaactatggtcttatctttctgtaaatgcgtgttttactaatggtttcctgctttcttagtggagagaaaatattacataatttgttggtgtgacacaaattggttgttttcgtacttatggaaaaatacatcagggttgtatttgcaagcatacctcagatatggagggttcagttccagcaaatatctcaataaagtgagtcacaaattttttggtttcccagtacatgtaaaactcatgtttatatactatattgtagactattaagtgtacaataatagcattatgtctaaaaaggcaagtgtataccttaattaaaaatattttgttactaaaaaatggaatgatcaagtcagccttgagtgagtcattatctttttgctagtggaaggtcttgccttgatatggctggttgctgaaagttggggtggctgtgacactttctttaaaataagaaaatgatgaagtttgctgcactaattgactcttcctttcgtgaaagctttctctgtagcatacagtgctgtttgatagcatttgacctactgtataacttctttcaaaactggagtcggtcttctcaaacgctactgctgccttatcatctatgtttatataaaattataaattctttgttgtcatttcaacaatgctcacagcatcttcgccaggagtagattccatctcaagaaaccaccttctttgctcattcataagaagcagctcctcatctcttcaagttcgaacatgagattgcagcaattcagtcccatcttcaggctccacttttaattctcttgctatttccactacctctgcagtgacttcctccactgaagtcttgaactcctccaagtcatccatgagggctggaatcagcttcttccaaactcctgttaatgtggatactttaatctcctcccgtaaatcatgaatgttcttaatggcatctagaatggtgaatcctttccagaaggttttcgatttactttgcccaaatccatcagaggaatcactatctatgacagctatagccttatgaaatgtatttctcaaacaagaagacttgaaagttgaaattactctttgacccatggactacagaatggatgatattttagcaggcatgaaaatgacgttaatctccacgtacatctccatcacagcttacaggtgaccaggtgcatagtcagtgaggagtaatattttgaaaagaacctttctgagcaataggtctcaacagtggggttaaaacattcagttaaccatgctgtaaacacacagactgtcatccagtctttgttgttccatttacagagcacaggcgaagcagatttagcataattcttaagggccctgagatttttagattggtaaattagctttggcttcaacttaaagtcaccagctgtgttagctcctaaaaggagagtcagcccatcctttgaaacattgaggccaggaattgacttctcctcagttttcttcaagaactttttctttgcattcacaacttggctagctggtgtaagaggtctagctcttggcctatcttggctttctacatgccttcctcacttagctttttatttaaagtgagagatctgtgagtcttccgttcacttgagcccttagaggccattgtagggttattaattagcctgatttcaatattgttgtgtctcaggtaatagggaagcccagggaaagggagagagatgagggaacggctggtcggtggagcagtcagaacacacacaacatttctcagttaagttttctgtcttatattgggtatgatttgtggtgccccaaaacaattacaatggtaacatgaaagatcaccgatcacatatcactgtaacagacacattaataatgaaaaagtgtgaaatattacgagaatttccagaatgtgacacagagacagaaagtgagcacttgctgttgggaaaatattgccagtagacttgctgcatgcaaggttgttacaaaccttccatttgtaagaaacacagtgtttgtgaagtgcagtaaagtgaagcaaaataaaatgaggtctgcctgtacatgcatatactgatgtgtgtctgttaatttttcctgcctgttacggattgagcacgtcatgtagacacagtccattggatactgcaattctgtgcatacattgccatcgagaccccaagactgtgtggttataagaaggaagtgccactgcttactcctctcctctcccttctatcttacctgcttttgttgcctttctcctcttcctccccttacttggtctcagtttggtttgtcctgaatgacaggcagtatggctcagtggttggaagttcagtctttggaattagaatacggagctcctaattgaccttaatactttctcactgtgtaatctcggacagtcaagcttgagacctgaagcagggctaagttaactccattcacaaaataggaataatgatggtctctgtcatcatccaggggcttgctacggggctgcattaggtaatacattaaaaacgcatagagagcagggcccctgcacagtaattgacaaaaatgagctctcagcacctttcatttgtctgctcaggaccacttcctcctgggtaccactgcttcttccatgcccctcttctaagatccttgggggctgatcctgtttggtgctccctaagcagattctatttgatgctccctaagcactctgatttcactcttagttggctctgggtatggctgagccaggtagaagaggcatctgtcccttcatcagcgttgagctcctgggaagcaggtcccttgctttgccacagtacaagtgccacagtacaaatgctacctaggaatagaatggagttgagtcgaagtagcatttctgattttgcgatgttgctaatgctgtcctctaaatactatagaaagaattctttttcttttctttgtttactctcaccttttggcaataatttccacttgtttttctttcctgctttttctctctgtacttttccttgcccagcagacactgctgattgtgacagctttttcaagggcacaacaccttactctgtttcctcctgcctttgctctgtaaggctgctctggcatggcccaaactttgagatgacttttcctttctccttgccaattttagaatctttctgttcaacatcatcatctgatagagatttgggactaagtaaaatgaatgttgtatgattttccctgtaattttagatccccaaatactgctcttggccaactacactattccctgtggcttttttactccaccacatttgagtaatattgttggcatggacataagtaaacagtttgaaaatgttgtgttttgtaaactagaagatggatgggctggttttttaatgcatgctcttggttctgctgggccaaaggaaagatgaatttggtcagtggatgggaagatgaattggaggaaggtgttgctatccgaagttgatgtggccaactttactgaactgatgagatcagttatttagaggtgaaaaccgagtggctggaggcgactcttcggagggatttagataatgcagttagagggaatttttatagaggagatagcatgctaccagtaagaagccaccaatggaaaatatgataataaagtaaggaaaatagaaggataaggatcttttgtctttgtaaatttaaacatgtttttatttctttgtagaattaccagacaattccaatgtggcttttaatctttcatgaacttcattttattattgctgtatatatatgtgtgtgtgtgtgtgtgtgtgtatgtatatgtatatatatgtacgtgtatatatatatatatatatatatatttttttttttttttttgagatggagtcttgctttgtcgcccaggctctagtgcagtggcgtgatctcagctcacggcagcctccgcctcttgggttccagcgattcttctgcctcagccacccgagtagctgggattacaggcatctgccaccacacctggctaatttttatatttttagtagagatggggtttcaccactttggccaggctggtcttgaactcctgacctcaggtaatctacctgccttggtctcccagagtactgggattacaggtgtgagccactacacccaccctattattgctatttttaattaaaatgtagagtctccatcctcccatatgcatttcatgttcacaccatagcgagtagacagttaacacttagcatcttcaaaatatgattattgtaaaagctatttaaatgagccgagacttatcacttcaccttcataaatcatttactacaatgattcaagggtgaggatactcctgcctcttcattggctgtgaaacttcaagcagattaatgaactcctctgagacttttctcaaccttcagacgggaagagtaccctcatcacacaacttcattcatgttgttgtgaatgtcaggcatacacatcctctttgctctgaatgcttgtcacattgcatcacagacatttatgtattgtctggcattgctgcttgaatgtgagctctatgagggtagggattatactatagccatctttttgtcttcagtacctggtaagcatgtacacctttatggaatgaatgaatgaatgaatgaatgaatgaatgaatggattgatttgttgtactttcaccaagctcctatatagtaggttttggtacacggaaggtgttaagatgactttttctttctccctgccaattttagaatctttctgctcaatatcatcatctgatagagatttgggactaagtaaaatgaatgttgtatgattttttttccctctaattttagatccccaagtaccatgtacttgaaaaaactaaaacagggtcacaggctagagagtgacaggagctggaactggaggtggggagagggctaaaagaaagtctctataggaagtgacatgtgaggcctgtgtgatatgaaagggtctgagagaagagtattttaggccaacagaatggctagcacaaaggccttggagtggggataggcctggcttgttgtgggaacataggtcattatcgttgggttgtcagtgagggctgctgtaataggtgatataagatagggttggatcccaagtcaagtcttctaggctgtgtgaggccacagataagataacaagaggggactgtacaacacaagcacagtcaacacaagtactataaaacacgagtgcatgcaagtgtattttattactaagaaattaaagaaaataaaggatttagtattttttaaggcatggaaaaatatcttacgtagaaaattcattagatcactttgattgctattttttattgatgagaaaaactgcacgtggaacagtgaagtacccaagtccacacacaaattattctcatagcctgaccacctgcctggtgcccagattgccagaccagccttgtgctgactggacctccgggtctctgccgagctctcgtggaaaggcaagaccctcagcagggagctgcgaggctgcggtttaggatgaaagtgtgagggtgaagaaagccaagtcactggtcactattgtgttaaaagtcaaattaatggggatccttacatggtactaaatttaaaaaaatgttcaatcctttaaaaattgattaaaaattttattttgatgatcatagaaaatctacagagagctgataggatgtgttaaagtggaagttaaatatttttggaacatttgtatgctcttctgaggttttgttcatcccccccacctcaacatctaatttacacgttgaattagtcattgactccgcctgccattttgtggtaaagatcaagtcaaatgaggctcatcacagtgcttcacaaaaggggccgggtgtggtggctcatgcctgtaatcccagcactttgggaggctgaggctggcggatcacctgaggtcaggagttcgagaccagactggccaacatagtgaaaccccgtctctactaaaaatacaaaaattagccgggcgtggtggtgggcgccggtaatcccagatacttgggaggttgaggcaggggaatcacttgaaccaggaggtggaggttgcagtgaatcaagattgtgccattgcactccagcctgggcaacaatagtgaaactccgtctcaaaaaaaaaaaaaaaaatccttcaatgcttcacagaagggccatataaacataaggtgaccttattaataaggtttttatgaccagtttgtacactttttttaataatgtgttggtgcatttcttgtcttgaaaaatggaatgcataaaatgtacccattttcaatgagtttttggtaactaaagaattggtgtctctgatgtttatattgaccatcgagtttaccaacaatgtctctggtacacctcctagaagttggtttgaaaataaacaaaaacacctacatctccactttaattctaccctccctggaatttattttattctcctaaaagtagggttcgtgcaaagacaagaattctttcaagagagccctgtttcttttattttgagatagtgaaaaggttatgttaagttagtccaaaatttcatagtaattgaaggtgaaataatacagacaataagtaaattaaaggtagagactgtttttgttttactttttcatccatttaggagattggcctacacagcggttctctttatatacaatagaccctcagtaaggtttcttgattagtaagcattgcaagttacgtttgtttcgagtggaagaccagctgaaatccatttaaatcaatgaatactgagattatgttattaaatggttctttttgttttacgagaatgtatattacaacaaatgtccctgtgtaagtttggaatgctttgttttgagtgttaaaggctcttttctctggcaaaatttccccatttcttcctttaatacagagtgcttgaatggcacctcacagacacttagcctcgtggctctcaaagtatagaccctggaatggggcgtcagctccgcctgggaacttgttagaaatgcaaactctccagccctgttaaaccaggagctctgggatggggccagccatctgtgttttaaccaggcctcttggggatcctgatacagctgtggcttgagaaccactgctctagcagaacccatctcctcctccctttccacatccccccaccctactgtgatcacttgtggtgtgatgagggggacagggaaatcagctcttttgggctccaggccttgagagtagaggcttcatttaccctttcccccttcatttctgcctaaggatgagtttatatggtataaagcccagtggaatggatcattttccccagtttcagatgggaaccttgcaatcggataagatgtagctgtgtatgttgttactgttattattaattgttattcagagacaaggtctcactctgtaacccaggctggagagtagtggcgtgatcatagctcactgtgatcttgcactcctgggctcaagtgatcctcgtgcctcagccccccgagtagctaggactacagatgcatgccaccatgcccagctattttttttttttaacttttttgtagaggtgaggtctcgctgtgttgcccaggctggtcttgaactcctggcttcaagtgattctccaaccttggcctcccaaagtgctgggattacaggtgtgagccactgcacctgaccaccatgcacattaatacacattctatactgtatgctcactgaggagtggcaaagaaaccagttttcattcagtgaatatacctataaatgtgttttgtacctttaggtcttcctaattctgttctgttccttaacataaaagatgcctaaaccacacttcttcatattcttcaaagccacatttatcaaggtgtggttccaggacctcctacaacagaacccctgtgggatgcgtaacaaatgcaggttgtgggactttcccacacacctaccaaattggaacccctggtagtagaccccttggccctcattttcacaagcacccatctgactgatccacactgaagcttgagggccctgagtttaaagtacatatgctggaatacaagatatcaaaagcgaagaatgatgagaaagagattgcaaaattaataaaagtaacgaaggagcaacattttattttagaaataggtgccattacttgtttctaaaataatttgaaagtgaaatgaagaacaagctcttgtctagagcatactcttggaattggcagggattgtgcttcctcgcgtcaagatcaagaagctcagatgcagaggagacagggctgtgctgcccagttgttccttggggtcatgctgactccatcctggaagttgctggaggaatgcatcatatgtttggaaacagcccagttgagaatttcagcaatgatacactttttttattagatgtgtatttaggaaaggaattgcctattataagactagggccctttgtagaaggagctgaaaaaggagctggtttgcttgtcctgtgaaatagggactgttttccccattatgcatcttttcttttctttccacaaaataaataaatgcaaagacatgtcacttgaatgttgtataaaaatcaggtcttttaaaaattacttgtttctctccaagtagaaaggcattttttccccaagggaaacttattaaaatcatcagttattgtagtaatagctatgcctccttaaaagtaaatagatttttttttcttcccagtgccagtagcatgtagctatttccaaatatgttaacttttgatgaagcatccaaatgtttaaatatcttataaaggccacagttctaagaaatggtgttaaaattttgagaaaattcaaatttgaagaattacctaaatactaagtaaatcaaaaagtatttgtaacattaaaaaaaatttatgtcaaaaatattttttaatgtcaaaaatatttttcaatacttaaaaaactagcactttgggaggctgaggcgggcggatcatgaggtcaagagctcgagatcatctggccaacatggtgaaaccccgtctctactaaaaatataaaaattagctgggtgtggtggcgtgcacctgtagtcccagctactcgggaggctgaggcaggagaatcgcttgaaccagggaggtggaggttgcagtgagctgagatcgcgccattgcactccagcctggcgacagagcaagactatcttaataaaaaaaacaaaaaacaaaaacaaactttagtccttactccttcagtctcagttgggaaaaccatagaataatgaagacaaagttacagattaaagcaatagctccatggtcaaagtggacagtggagttattaaatagtgtatttaaatagacttttgagagaagttttaggttcagagcaaaattgaacagaaagtacaaaattcctatatacctttgaccccacatacacacaacctctcccaccatcaaaatcctgtccctgtcctgttacaatcgatgaacccctatattatcacccaatgtccatagtttatattagggttcactcttggtgttgtatattccttgggttttggcaaatatataataacatacatctacagtatcatagagaatagtttcactgccctaaaaatcctctgtgccctgcctactcatccctccttcctgtctaaaccctgacaaccactgatccttttactgtctccatagttttgcctcttccagaatgacaaatagttgagatcatactgtaggtagtcttttcagattggcttctttcacttagtaatagccacttaaagttcctccatgtcttttcatggcttgatagcacgtgtctttttaatactgaataatattccattgtctggatgtaccatagtttatttatccatcatctgctgaaggacatctttgtcacttccaagttctggcaattatgaatagagctgctgtaaacatttttgtacaggattttgtgtggacgtaagttttcaacacttttgtgtaaataccaaggagtgtgattcctgaactgtatagtaagagtatgtttagtttggtaagaagtggaaactgaaactgtcttccacaatggttatactattttgcagtcccaccagcaacaaatgagagttcctattgttccacttcctcatcagcatttattgttgtcatcagtgttttggattttggccattctaatagttatgtagtggttttaatcttgttgtaatttgcagttccctaataaataacatatgatgttgaacatctttttataagcctcagatacttgagctttttttggtaaggtatttgttcaggtcttttgcccattttttaatcaagttgtttgtttccttattgttgagttttaaggttctttgcatattttggataatggtcctttatcagacgtgtctcttgaaaatattttcttccactctgtgtcttttcattcttctcagtgtctttttcaggacagaagtttttttattttaatgaagtccagcttatcaattctttctttcatggattgtgcctttggtgttatatcttgttttattttattagctaggacttccagtactattgaaaaggagtgatgagagagaatattcttgccttattcatgatcttagcaggaaaactagttgctcaccattaagtatggtgttagctgtatgttttttatagatgttctttgtcaagttagggaaattcccttctattcctggtttactgagagttcttatcataagtgagtgttggattttgtgaaatgctttttctgtatctattgatatgatcatgtgatttttcttctttaggttgttgatgtgatggattatgttgatatttgaatgttagaccaaacttgcatacctgggataaatcccatttggttgtgtataattgtttttattcattgttgcattcaaatttgctaatattttgttgaggatttttgtatctgtgttcatgagagatacttgtctgtagtttcctgttcctgtaatgtctttgcctgattttggtattagggtgatgctggcctcagaatgagttaggaagtatattctcttcttctatcttctgagagagattttagagaattagtatactttctccctgaaatgtttcctagaattgaacccatcctggcttgctgttttctgttttgaaaggttatttattattgattcaatttctcggttttggcagattatgtcttttaaggaattgatccatttcatttagattattgaatttgtgggcatagaattcataatattcctttattattcctttaacgttcataggatctataatgatgttcctgctttcatttctgacattagtagtttgtgtcttctttttttcttagttagcctggttagaggcttatcaattatattgatgatttcaaagagctagcttttggtttcatttatttcttttgtttactttctattttcagtttcatcgatttctgctctaattttcattatttcttttccactgcttactttggatttaatttgctgctctttttctagtttcccatggtggaagcttagattattaattttagatctttcttatttttaaatatatgcattcattgttatgaatttccctctaaacactgctttcactgtatcctgcaaattccattaagctgtattttaattttcatttaggtctaaaatattttaaaatttctcttgagatttcctctttgacctatgctttgtttagaattatgttgctgtatctccaagtattttgggatttttccagttattgttataaatttctagtttaattccattgtgacctgagaatggatattatatgatttttactcttttaagtttgttaagatgtgttttatgacccagaatgtggtttgttttggtgaatgtgctacgtaatcatgagtaaaatgtatattctgctgtcgttggatgaagtagtaaatacatgtcagttattttcagctagttgatggttacgttgaattccaattatgtccttactgattttctgcatgctggatctgttcattttgtgataaaggagtattgaagtatccaacttcaatagatgaattatggattcatctattattccttgcatttctatcagtttgtttgtttgtttgtttgtttttgagacagggtggagtgcagtggtgcaatctctactcactgcaacctctgtctcctggtttcaggtgattcttgtgcctcagccttctgagtgctgggactacaggtagatgccaccatgcctgactaatttttgtattttttggtagaaatagagtttcaccatgttggccatactggtcttgagctccttatcaggtgatccgcctgccttggcctcccaaagtgtaaggattacaggcgtgagccaccatgcctgattatctatcggtttttgccttatgtatttggtgctctgtcattaggtgcgtacacattaaggattggttatgttttcttggagaattgacacttttattatatgtaatgctcccctttatgcctgataattttccttgctctgacgccagctctctgtgaaactaacatagctatttctgctttcttttggttagtgttagcatgatatttattttttcatcccttacttttcatttatatcaatctttatattgaaagtagctttttgtagacaacatattgttgggttttcttttttgatccactctgacagtctctgccttttaatgggtgtattgagaccattgatgtttaaagtgattattgatacagttggattaatagctactgtatttgttactgttttctattcattgcccttgttttttgttcctctttttgtcttctactcttttttcctgccttttttttttttttaagacagggtcttgctctgttgcccaggctggtgtgcagtggtgcagtctcatctcactgcaacctccacctcctgggctgaagtgatcctcccaactcagcctcccaagtagctgggactgtaggtgtgtgccaccacacctggctgatttttttctttagtgtgtgtgtgtgtattttttttttttttttgaggcggtgtctcgctctgtcacccaggctggagtgcagtgggcaatctcggctcactgcaacctctgcctcctgggctcaagcagggctcgagcaattcccctgcctcagcctcccaagtagctgggattacaggtgcccgccaccatgcctggctaatttttgtatttttagtagagatggggtttcaccatgttggccaggctggtctggaactcctgacctcaagtgatccacctgcatcggcctcccaaagtgctgagattacaggtgtgagccatggcacctggccaatttgtgtgtgtgtgtgtgtgtgtgtgtgtgtgtgtgtgtgtgtgttttaatttaaaaagttttattttcatttcaggggcacatgtgcaggtttgttatataggtaaattgtgtgttgtggtttgatgtgccagattatttcatcacctgaggaataagcacagtacctaataggtagttttttgatcctcacctttttcctatctccaccctcacgtaggcccagtttttgttctcttctttatgtccatgtgtacttgatgtttagctcccacttggaagtaagaacatgcagtatttggttttctgttactgtattagttcacttaggataatggccaccagctccatccatgttgttgcaaaggacatgatctcattcttttttaaggctgtgtaatattccatggtatatacataccacattttttcctatctaatctactgttgatggacatgtaggttggttccatgcatttgctatcgtgaatagtgctgtgatgaacatatgcatgcatgtgtctttatgttagaatgatatatattctgggtatatacccaataatgggattgctgggtgaaaaggtagctctgttttaagttctttgagagatcgccaactgatttccacagtggctgaactaatttacattcccacctacagtgtataaacattccctttttttctgcagcttcactggcatctgttattttttgactttaacaatagccattctgactggtgcaagatggtatcacattgtggttttgatttgtatttctctaatgattaatgatggtgagcatttttcatgattgttgctgcatttatatcttcttttaaaaaaatgtctgttcatttcctttgcccattctttaatgggattgtttgtgttttgcttgttaatttaagttccttgtaaattctggatactagacctttgtcagatgcatagtttgcaaatattttcttccattctgtgagttgtctgtttactgtgttgatagtttcctttgctgtgcagaagctctttagtttaattaggttccatttgtcattttttgtttttgttgcatttccctttggcatctttgtcatgaaatcttttccagggcctatgttatctttcagggttatcttccagggtttttatagttttaggttttatgtttaagtatttagtccatcttaagttgatttttttgtatatggtgtaaggaaggggttcagtttcaatcttctgcatgtggctagctagttacctcggcaccatttattgaataaggagtcttttctccattgcttgtttttgttgactttgttgaagatcagatggtggtcggtgtgtggctttatgtctgggttctctattctggtccattggtctatgtgtctttttataaaagtaccatgctattttggttactgtagccttgtagtgtagttccaagtcaggtgatgtgataccttcagctttgttctttttgattaggattgccttggttgtttgggctcttttttttttgttccatatgaactctaacatagttttttctaattctatgaagaatgtcattgttagttgataatagcattgaacctgtaaattgctttgggcagtatggtcattttaataatattgattcttcctgtccatgagcatggattttttttttccatttgtttgtgtcaattgttatttctttcagcagtgtttttcaattcttgttgtagagatcttttatctccctggttagctgtattcctaggtatttgtgtgtgtgtgtgtgtgtgtgtgtgtgtgtgtgtgtgtgtctgtctgtcttttgtaaatgggattgcattcttgatgtggcgctcagcttggatgttgttggtgtatagaaatgcttctgattgttatatattgatactgtatcctgaaacttcgttgaagttatttatcacatctaggagtttttgggcagaaactttggggttttctagatataaaatcatattgtctgcaaatagagagagtttgacttcccctcttccaatggaatgccttttatttctttctcttgcctgatttctctggctaagacttccagtaatatattgaataggagtgatgagagtgggcatccttgtcttgttctagttctcaagggtatgcttccagcttttgcccattcaggattatgttggctgtgggtttgtcgtagatggcccttattattttgaggaaaattattccatgcctagtttattgagggtttttttcaaacatgaaggatattgattgttatcaaaagccttttctgcatctattgagataatcatgtggtttttgtttttacccctctttttgtgatagatcacatttattgatgtgtgaatgtaagaccagccttacatcccagcgataaagcctacttgattgtggtagattaaatttttgatgtgctgctggatttagtttgctagtattttgttgaggattttgtatctgtgttcatcaaggatattggcctgaagctttttttgtttggtttctgtttgtgtgtctctgccaagttttgggatcagaatgatgctggcctcgtagaatgagttagggaggagttccttctcaattttttggaatagtttcagtaggaatggtacaacctcttctttatatgtctggtagaatttggctgtgaatctttctggtgttggactttttctggttgctagtctttttattactgattgaatttcagaactcgtttttggtctgttcagggttccagtttcttcctagttcaatcttaggaggttgtactttccaggaatgtatctatttcttgtaggttttctagtttgtgtgcatagaagtgtttgcaagagtctctgagttttttgtttttttttttctgtggattcagtggtaatatcttctttatcatttctgattgtattcatttggatcttctctttttttttcttagtctagcagtggcctatcaatctaatttattctttcatagaaccaacttctggtttcattgatcttttgtgttttttttccttctcggttatatttagttcagctctgattttggttatttcctgtcttctgctagctttggggttgatttgcttttgtttttctagttcttctaggtgtaatgttaggttgttaatttgagatctatttttttgatgtgggcagttagtgctataaactttcatcttaacactgctttagctatgccccagagattctggtatgttgtattaatttcttgatttctgacttaatttcatgtttatccagaagtcattcaggagcaggttatttaatttttatgtagttgtatggtgatatggtttagctctgtgtcctcagccaaatctcatcccaaattgtaatccccacatgtagagggagggacctggtgggaggtgactggatcatggggatggtttctcccatgctgttcttgtgatagtgagggagttctcatgagatctgatggttttaaaagtggcagtttcccctgcacactttctctcctgctgccatgtaagatgtgccttgcttccccttcactttctgtcataattgtaagtttcctgaggcctacccagtcatgtggagctataagtcaattaaacctcctttgtttatacgttacccagtctcaggtagtatcgttatagtggagtgagaacagactaatacaaatggttttgagtgatcttcttagtgttaatttctgtttttattgtgttgtgggtccaagggtggttggtattattttggtttttttgaatttgttgagaattgttttatggctgattgtgtggtcaattttagagtatgtgccatgtgaagatgaaaagaatgtctattctgttttttttgttgttgagacttctgtggatgtctgttaggtctacttgtccaagtgttgagttcagctcctgaatgtctttgttagttttttgccctgatgatctgtctaatactgtcagtgggtgttgaagtttcttgctattattgtgtcattatctaagtctctttgtaggtctccaataacttgttttatgaatctgggtgcttctttgttaggtgtatatatacttagtataattaaattttcttgttgaattaaaccctttaccagtatgtaatgctcttttgtgtccgttacataatgctcttgtctttttatatttttatttttaatttttgtgggtacacagtaggtatacatattcccagggcacataagatgccatgatataggcatgcaatgcctgtatcaaaaaagcacatcatggagattggggcatctttccctacaaggacccccttatctgcgttacaaacaatcttaactacattccttaagccatttaaaaatgtacaatcaggttatcatagaccaaaatcaccctattgtgctatcagacaataggtcttattcattctttctattttttttgtacccctgaaccatccccacttctcctccagcccctcactacccttctcagcctctggtgaccatccttctactctctatgtccatgagttcaattgttttaatttttagacaccacaaataactgagaacatgtgatatttgtctttttgtgcctggcttatttcatgtcacttaacatgatgacttccagttccatccttgtagttgcaaatgactggattttattcttttttatggctgaatagtactccattgtgtacacgtaccacattttctttatccattcatctgttgatggacacttatgttgcttccaaatgttagctattgtaaatagtgctgcttcaaacataggagtgcaaatatctctttggtatactgattttctttcttttgggtgtatacccagaaatgggattgctggatcatatggtagctcaatttttagttttttgaggaacctccaaactgttctccatagtgttgtgctaatttacattccatgaacagcgtatgaaggttcccttttctctacatccttgtcagcatttgttattgtctattttttcatataagccatttaactggggtgagatgatatctcattgtagttttgattagcatttctctgatgatcagtgatgttcatttgcctgttggaatttgtatgtcttcttttgagaaatgtctgttcaagtcttttgcccattttcgatgggattattagtattttttctatagagttgtttgagctccttacatagtcttgttattaatcacttatcagatgggtagcttgcaaatattttctcccattctgtgggttgtctcttcactgtttcctttgctgtgtggaagctttttaacttgatgtgatcccagttttccattttgctttggttgtttatgcttttagggtattgctctttgtcttttctgattgttgttggtttaaagtctgttttgtttaaaattagaatagcaatctctgcttctttttgttttgtgtttgcttagtagatttttctccatccctttacttttagtctacggatgtcattttatgtgaaatgggtaggtatcttgaagacggtatacagttggttcttacttctttatccgacttcgtactctgtgccttttaactgagacgtttaacccatttacattcaaggttaatactgacgtgtggatttgatcctgtcaccatgttgttagctggttattatgcagacttgattttgtagttgctttatagtgtcaatagtctgtgtacttaagtgtgtttttgttgtgaccagtaatggtttttcatttctgtatttagcactcccttaaggacctcttgtaaggctggtctggtggtaacaaattcctttagcatttgcttatttgaaaagggtcttatttcttctttgcgtatgatgcatagtttggctggatataaaactcttggttgaagtttcttttctttaagaatactatattttggcccccagtctcttctggcttagacagtatttgctgacaggtatgctgttagtctggtggagttccctttgtaggtgacctgccccttctctctggctgtctttaatattatttattttatgttgatctgggtgaatgtgatgactgtgtatcttggggatgattgtctcatatagtatctaacaggggttctatgtatttcctgaatttgaatgttggtctgtctagtgaggttagggaaatttttgtgaagtgaatgatatccttaaatatatttttcaaggtgtttactttctcactctttctttcagggatgcccatgagtcatagatttggtcccttcacataatcccatatttgttggaggtttcattcattctttgttttttttttttttttttttttttttttttttttttttgtctgactgggttaattcagagaatcagtgttcaggctctgagattctttcctcagcttggttaattctgctgttaatacttgttatgatatcgtgaaattcttgttgtgagttttttagctctatcagatgagtttggttatttcttaagatgaccattttatcctttggcttctgtgttattttattgtattcctcagattccattgattgagtttcaactttctcctgaatctccacgatctttgttcctatccattttcagaattctatgtctgtcatttcagccatttcatcctagttaaggaccattgctggggaacttgtgtggttgtttggaggtaagaagacactctagctttttgaactgccagagttcttgtgctgtttctttctcatctgtgtgggctgatattcctttaatctttgaaattgctgtcctctggatgagtttttttgcttttatcttctttgctgccattgggggtttgattgtggtctaaagtgggttcagttgactaggttcagttgactactatgctgtgtgctctaattctgtggggctggtatggggcccccagctttgttccttgacacctttgtgttaggaacctggtgtgctgaaggggccaaggtgttcccggtccactgacctcagtactctgatggggggtgccagccaacacctttcctcagggccgtggcagtgggatccatgctggcttgtgtgtgccagaagctgcagtggcgcagtggggtgcacatgtgttggttggggtggggtgccagtaggagcctttgcattaagttttcataggcactatatcctggcaaaatattttaccattgtattttgggctgtgagccagtaggcaccatttaagaatgttagccagcagataggctcttaccgtactgcaaagcttttttgttttagcacagtgggtaggagtgctctatgttgggggttagagagatgactcccttacctagtttgttccggtgccttggaggaggcccctccaatcactggctctgtgcttgcatttcttttgttaggagttctggttcatgaggatccctcaggcaggggccacggttggcacataggccatatccttgctgtttcctgtggagggaggcacactccggtcctccaccagcctgtgaacccaggcatcttctctcactgacctgaaagtgagggctcctccctgcttgggtacagcaaacaagcaagctctccttggctaggagccgtgagggtgagtgaggtcacctaatgttctgtctgggtgcttcctgggggaatatggggttgtgcctgcctgcagagttcagacagaagtgggaccattctgctggaagctctagcatgcctggcccctctgcctaccagtggtggaggtgggtggagatgcctgccctgctgtccgggtgttatcctggggcaaaaggatattgtgccccttggcagaattcagatagaagaaggaccagtggactggaagctctagcaggcatggcctgcctggctaccggctttgggggtgggtggagtggcctcccctgctgtccaggtgtttcccaggacaacaggaggttaagtctgcctgctgagttcaggcagaagcaggactgctgggttggaagctctagcaggcgtggcccacctggctatgagccgactgggagagtggagtcaccttccctgccgtctgggtgtttcccagtacagcaggaggctgtggctgctggctgacttcaggcagaaacaggaccactgggcgggaagttggcactgagccttgtctatcaagggcggggtgagggcggctggagcaatcttattgcttccaggcaccctgactgtggcctctactggggttatgtcactggtgccagttttttctggggtccaaggcttgtataggtgtccttggacttgagagttgcctctggaaaatctccaggtggctctctgcttcagtttagaagcatggttgggtgtgcaggggcctagaaggattctcccattcccagtcctgcacaggtccttgtggaaagtgtgaatcccctgaggggctctcactcaccactcccttgttggggagcttctcatgggtctgtgttgactccagataggctcctgcgcagcttcactcctctttgctctctgtgtccccttgctgccttgatggatcccggagtagtttcatggatgatcagcttgtaggatcagtgttcagtttgtttccctcttcagtttcttgcatcaatgttttgtagttttcattgtagagatctttcactgcttgggttaattcctaggtattttattttatttgtagctattgtaattgggattactttcttgatttctttttcaaattgttcactattagcatatagaaatgttactgatttccatatgttgatttttatatcctgcaactttactgaatttgttttattagttctaatagttttttggtggagtttttaggtttttccaaaaataagatcatatcatctgcaaacaaggataatttgacttcttccttttcaattcggatgccctttatttctttctcttgtctgattgctctagctagaactcccagtactatgttaaataacagtataaaagtgggcctccttgtcttgttccagatcttttccccattcatcatgatactagtgtgggtctatcatacagactttttggcttttattgtactcaggtatgtttttttctatacccagttgtttgagtgctttttttcatgaagggatgttgaattttatcaaatgttttttcagcaccaattgaaatgatcacatggtttttgtccttcattctgttgatatgatgtatcacattgatttgcatatgttgaaccatccttgcaaccccgggataagtcccacttggtcatgatgaatgatctttttaatgttttgttgaatttggtttgttagtattttgtctaggatttttgcattaatgtttattaaggatattggcctgtagtttttttttaattttttttttttttttgcatgtgtctttggttttggtatcatataccagcttcatagaacgagttttagaagtattccctcctcctctatcttttggaatagtttgagtaggattggtattagttcttctttaaatgtttggtaaaattcagcagtgaagccactgcgtcctgggcttttccttcctgggagactttttattacagcgttgatatcattactcagtctgttcaggttttgaatttcttcatgattcaatcttggtaggttgtatgtgtctgggagttgatccatttctcctaggttttctaatttattggcatatagttgctcatactagcctctaatcctttgaatttctgtgttatcaattgttatgtagtttttttcatctttgattttatttatttgggtctcctcttttttcttagtttggtcagagatttattgattttgtttatcttttcaagaaaccaacttttcatttcattgatcttttatatatatatttttttcatttaaatttcatttatttctgctctgatctttattatttcttttgttctactaattttgggtttagtttgctcttgctttctaggtctttatgatgcagcattaggttgtttatttaaagtttttctacttttttgatgtgctcatagctataaattttccttttagtactgcttttgctgtatcccataggtatagtatgttgtatttccattatcattgtttcaataatttaaaaaaattccttcttaacttattcattggccctctgatcgttcaggagcataatgtttaatttccatgtgtttgtatagtttccaaaattccttttgaattgatttctggttttattctattgtgttcagagaaaatacttaatataatttcagttttaagagttgttttgtggcataagatacggttcatccttgagaatggtccatgagctgaggagaagaatgtatattctgtagccactggatgaaatgttctgtaaatatccgttaggtccatttggtctattgtgtagattaagtccatgatttctttgttgatattctgtctggatgatgtgtctgttgctgaaagtgtgcagtgttaaagttttcagctattattttgttagggtctatctctctgtttagctctactaatatttgctttatatatctgggtgctccaaagttggatgcatatatgcttacaatcgttatattctcttgctttatatccctatataatgacttttcttttctctttttataatatttgtcttgaaatctattttgtctgatacaagtataactatttctcctctattttggtttccattggtatggaatatctttttccatctctttattttcagtctgtgtctttgtagatgaagtgtgtttcttataggcaacatactgttagtttttttaaatgcatttaaccactctttgtcttttgatggagagtttagtccatttacattcagtgttgttattgttaagtaaggacttactcttacaattttgttatttgttttctggccttctcttctttcttttctttctgttttcgttttagtgaaggcagttttctctgttggtatgttgtaatttctcactttttattttttgtgtatctgttgcatgtttttagatttgaggtaactatgaggcttgcagatactgtcttataaacattattttaaactgatgacaacctaacactgattgcataaagaaacttataccaacaaacaagtaaaaagaaaactaataactttaactttcaagcaagtaaaaagaaagctaataactttatctacctgctttttaactttttgtagtttctatttatatcttactgtactgtgtatttcttgaaaagttgtagttattatttttgactagttcatcttctttcttctgaaaatattagtagtttacataccacaattacagtgttataacattctatgtacttaatattactaatgagttttgtaccttcagatgatttcatattgctccttaatgtccttttctttcagattgaaggactccgttttagcacttcttacaggaccagtctggtgttgatgaaatcagcttttgtttttctgggaaagtctttatttctccttcatgtttgaaggatatttttgccatagatactcttctagggtaatagtgattttctttcaggactttaaatatgtccatgacactctctcctggcctgtaaggtttccagtgaaaagcctgctgccagatgtattgcgctccattgtatgttacttgtttcttttctcttgctgcttttaggatcttttctttatccttggtctttgggaatttgattattcaatgctttgaggtcatctttgggttaaatctgcttggtgttctgtaaccttcttgtacttgaatatggatatttttctctaggtttgggaaatttctctgttattattcctttgagtaaactttctaccccagtctctctctctacctcctctttaaggtcagtaactcttagatttgccccattgcggccattttctagatcttttaggtgtgcttcattctttaattgtgtatttttgttgtttagtataacttataatttttcttggtagctggatatgttgtacttggtattggttcccatgaaggtttctgctcaggtgtttctgttccagtaaattgtatttctatgtatttgcctgtctgtttgtccaattttggggcagctttgtgatctcacttttgctttgttacctcacttttctgatggatctatgcagagttgatgatttttcagtttgttcagctttttacttgttaagatggaatgatgacttccaagctccttacatgcaggactggaaagtagaagctcacattttatttttagaacaataaaactacaaacataagctctctgatatggtttggccatgtccccacccaaatctcaccttgaattgtagctctcataattcccatgtgtcatgagagggacctggtggaaggtagttgaatcatgggggcgagtttttcctgtgctgttctcatgatagtgaaaaagtctcacaagatctgatggttttagaaagggaagttcctctgcacatgctttcatgcctgctgccatgtaagacgtgcttttgctcctcctttgcctccccagtcatgtggaactgtgagtccattaaacctgttttataaattatccagtcttgagtatttcttaatagcagtatgaaaatggactaatacagtaaatcggtaccagtagagtggggtgctgctctaaagatacccgaaaatgtggaagcaactttggaattgggtaacaggcaaaggttggaacagtttggagggctcagaagacaggaaaatgtgggaaagtttggaacttcctagagacttgttgaatggctttgaccaaaatgctaatagtgatagagacaataaagtccaggctgaggtggtctcagatagagatgaggaacttgttgggagctggagcaaaggtgattcttgttacacttaaaaaagagactggtggcattttgcttttgccctagagatctgtggaactttgagcttgagagagatgatttggggtatctggtggaagaaacttctaagtggcaaactgttcaagaggaggcagaatataaaagtttggaaaatttgcagcctgatgatgaagtagaaaagaaaaaccaattttctggggagaaactcaagcctgctgcagaaatttgtgtaagtaacaaggagcccaagacagtgggcttaatcaccaagacagttaatcaccaagttaatcaccaagacagtggggaaaatgtctccaggacatgtcagagactttcatggcagctcctcccatcacaggtctggagggaaaaatggtttcttgggctaggtccaggactcccctgctgtatgcaggctaaggacttggtgccttgagctccagtgctccagctgtggctgaaaagggtcaagatacagctcgggccgtggcttcagagggtgcaagccccgagccttggcagcttccacatgatgttgagcctgtgggtgcacagaagtcaagaattgaggtttgggaacctccgcctagatttcaaaggatgtatggaaatgcctggatgtccaggaagaagtttgctgcaggggcagggccctcatggagaacctctgttacggcagtgcagaagggaaatgtggggttggagcccccacacagagtcaccactggggcattgcctagtggagctgtgagaagagggccactgttctccagaccccagaatggtagatccaccaacagcttgcaccatgtgcctggaaaagctgcagacactcaatgtcagctcatgaaagcagccaggagtggtgctctatcctgcaaagccacaggggtggagctgcccatggctgtgggagcccatctcttgtatcagtgtgacctggatgtgaaacagagtcaaaggagatcattttggaacttcaaggtttaaagactgtcctgttggatttcagacttgcatggagcattgtaggccctttgttttggctaatttctcccatttgaaatgggtgtatttacccaatgcctgtaccctcattgtatctaggaagtaactaatttgcttgtgattttacaggctcataggtagaagggacttgccttgtctcagatgagactttggactgtggacttttgagttaatgctgaaatgagttaagacttcgggggactgttgggaaggcatgattggctttgaaacatgaggacatgagatttgggaggggccaggggtggaatgatatggtttgtctgtgtccccacccaagtcgtatcttgaattgtaactcccaataatccccttgtgtcgtaggagggacctggtgggaagtaattgaatcacaggggcaggattttcctgtgctgttctcgtgatagtgaataagtctcaggagatctgatggttttataaagggcagttcccctgcacacactctcatgcctgacgccatgtaaaatgtgcctttgctcctcctttgccctctgccatgattgtgaggcctccccagccatgtggaactgtaagtcaattaaacctctttctctttatagatggcccagtcttgggtgtttcttcatagcagtatgaaaatggactaatacattctctaaagcatcctctgataatcctttcttttattcaagtcttaagttagatctttggaacataaagccagattgttaaaactgtactgcataattttcatctaagacacttgttttaaggcattttttcccattgggagggttttgagattatgaagatgacactgtacatttgtaatgttttcaactttttggagcactcaagggaggtcccccaagaacactctttaagaatgactttttttggaaattacctaccgtgtgataaggtgtcagggatagagtggctccacacacagcttagagttttgacagcacaagactgtctgtttccactttattgctagtgatcatctcattcgacttctgatactacaagtggttttggccaagtctctctttttttccatctgaataaatttctgcttttcctttcatctttccttctgatagttttcatcacccagcttgctagtaaaacacatggctttaaagggccatctgatcttgtgaaatctcctttcctgatggtttttcaaaaataggagagcaatctctctggcatgttttaactcagctgcacctgtagcagcagcttgacctggacctgtggggtcaggacgagagaactgaaactcagactcccattttatagaggagataagtaaagctcaaaagaaaagaagtgactttccagtttctgtgggctctgattgcccttttgtacaaaaagagtgaaaaacaattctgggccaggcgcggtggctcacgcctgtaatcccagcactttggaggccgaggcggatggatcacctgaggtcaggagttcgagaccagcctggccaacatggtgaaaccccatctctactaaaaatacaaaaaaaaaaaaaagttagctgggcgtggtggcgcacgcctgtaatcccagctacttagaaagctgaggcaggagaatcgcttgaacccaggaggcggaggtcgcagtgagctgagattgcgccactgaactccagcctgggcgagaagagtgagactctgtttcaaaaaaacaaaacaaaacaaaacaaaacaaaaccagttatggtcattttttctctagggcttgataacatgtaagacaaattttaaatttacttgaaagaaagtgctatgtagatattgactatcattagacttatattttggataaggtatctcattttaatattgctaaactaggatcgatataactactagtattaaaaacatagaaggtcaaatctgttttcccccggaacacaggagaacaccctacttttgaacaagtgatgtcccattagatctttatcaattggtgggttggaacatgggttttcctttgctgagtgacatggtactgtctactgagctcttgatgttgccaggctctgggctgacagctctacatggattacttcaggtaatcgctacagtaagcccatgattggctatcattttaacctccattttatcgatgaggaaactgaggtttagagaggataaattctcacagcaggagtcaggcccaaagacagcactcttctgtctcctagaggagctcagtacaaagcccacagatagtgcttgccctagtttagagcccagctaccaagcctggagatgtgtctaagggacaatgagccctctgacctggctgctgagagtctggatttcccagactacagatgaatcaaatgcagtcatctgtgtttacaaactcacctaattgatccaacagggttagaaatacatgagagattcatttgttcattgattcaaataatatttattgagtacctaccatgtagtaggtacatgtcaacatggaagatgttgaggggtggcagcgggcactctcagtgatggatggggccctgtgtaaccctccaggaagcttcttggttttacatttgctcctttttaaccccttcttttcttctggaaacctcagggaagatctgagtgttccttcaccccttctgtatctggcttctgattggcttctttcctcccttctcacacctataagcttctctgcctgtctgtttctgaaggaaggacatcgcttatttgagggtttctaagggtgtttttttcctatcaattgcaagtacaaaaaatgttccttttatctctcctgtgcctagtacatggtaagtattcaataaatatttctttgaatgaatgaacaaataaatctctcgtgtctttctgaccctgttggatcaattagatgagtgttgtaaacatagatgattacatttgattcatctttagtctgggaaatccgggctcttagcagccagggcagaggaccagtccaggactcctaggatgatgttggtgaggagatggatggactagaggtgaatgcagaggcagccggggctgaggggaatggatgtgtgcaaggtgtggtgggagagggcgtggtggacttagaggcagtggtgtgcaggcagatcctttggttgtaagtggatgatacacagactgacttaaataaaagaggttgtttattggcaggtaactgggaatcctaaggtttatgctgacattaagcctgattggctctccaggggttcaaatggtgataccgtgacctgaaccggctacatcatttgcagggctcagtgcacaaggaagatgtgggatctcttgtgaaaacaaaaacagaaacaaacaaatttcaagatgatgacagcagaaagttaaatcaagcacagggcccttctaagcacagcacctgtgggactgcacagattgcagtctcatgaagctggccctgatcaggatcctgtctctctcaacaagtctcagccctggtgatctccgtttgtcttcattctcagatggattttctccatgtgacatcaaaatgacaccaacaactccaaaccttcatcgtctttagatctaatgatctcagagtaaggcaaaattctgaacctgttttcagagctttagtgacagtcccagagagaactctgatgggtgattggccaagattgggtcatgttcccatccctgaaccaatcacctggccagtggtttgtgttgctctgattggctagggttgtggcgatgggggtgtgatgggaaggcagggctagccccatgtagctcttatggactgtgggtgcattgtggaatgggaggggaaggtcccccaaggaagggatgctggatggacagaaagttagatcagcatcagctatagctggggaggtaggagacggaaaagtagccccacatcacccatcttgtgatgagagcaagtgggtatgtgattggatggggtgggtatagttgcagaagatgtggtttctgacaacagatagttgaatgagtatagaaaaaggggaacggtgaagtggggatgatatcttagggtgggggcagatggagaggaaggaatagaagacccttgggacttctggcctataggttagggtggctgtccttgcttgctgttcatgtattgagggggttgcatcagctgggccagcctttagtcactctgggccaggttttaggaattctcgtagttagtgaggagatgagaagcaggaagctttccatcagtttcctgcctctgggaggtagaagtagctctggagccatttccctgccacccactttgtgatcttgggcaattatattacccaaaacttagcttcagttttgtcatctgtatgtgagaatcttataattccctaatagttagtgggaacttgtaagatgcttggtctaatatctaaagtaggtgcttaggaaatacacactgttgttattgttaatattggtttcagggctttcaggaaacaaaggtcactgctgtgccacatccatgcattacatactcctccagaatacctctagccatatttacaatggagaactagaataatggttccctgaaagataccagctcctaatgcctggagcctatgaatgataccttatggcacaaatactttgaagatgtgattaggttaaggatcctgagatgaggaggttttcctggattatccaggtagttttataaggcatccttttaagagagatagagatttgatgtacccacagaggtggtaaaggcattgtgaagatggaggcaaagattgaagtgtcacagccacaagccaaagaatgctggcagacacctatagtgtacctggaagaagcaaggaacagcttctccctagggatattcagagggattgtggccctggtgaaaccttgatttcatcccagtaatatggattttggacttctaagcctccagaactgcgagagaataagtttctgttgtttaaagccaatcagtttatcataaattcttaaaacagccacaggaaaattgtacactcttttgaggtggacctttgttatttgctttggttctcgtgtttagcatgatattgcacctgctacagttttctggtttaaactctggggagtcaggtgagactttcaagatggcagtagcccatgccatttctaccacactgagctcctaaagagccataggaaccctaggattcaggttatatggagccagctctttaattctgagataatcagctaatggtgcagttactacctgagatgatgtatttcattgggaaatctctagactaaatgaggcacgagtaatttttaagttttagaagaacaataatctattcttagagttcacacctcatggaaattgttggttgaatatgagtaacaagcacgagacttatttcctcaattccccagtatttagaagtgtgaacgcccttcaggatcagcctttcccaccttccacatgctgcagaggtccactaagcagaggtccacaccctcatctgagaatttactgaatgctgcagtgatgttaacattgtttgttctgcctttcttgataggaatgtaattatccatataggattaagaataaacaaaatggcacttgagtagttatatcctgtctttgttttgggtaatattgcataatttatcctaaatgcttagacctctttttttttctatttctcagaacagaatttaatatttttgtgccactatcaaactttgaattccaaaatgacggcacattttggaccaagattcagacgataagttcattccagaaaggtggtgtttggccttgaaatgatgacaacaaagcattggaacattgctataacggagtcccttattgaactctgatattcttctcagaaatccatgttagaagacaattttaaaataaggatataattatgactcagacagatataaaatgaacatgtgtgagattttaacttattaattaatgtgggaaccagtgaggtgtttcaacacattcaaaggaatgccgaaatgaatttataaatagatgcaaaatgggtttatccatagggcaataaccacattggattccaaagatacaattaatttccattttatagtcacaaatcatttgcataattatcagttttctacatcttacatggtgtatattactcaaaggtaatgaaaggcagaggtaacttggaagggtgagttagacctttttttgggtctgtttcaaagtgttttacagtttttccagtatatgctttactctgacccgtggatcaaattctacttggaatagcactgtggtaatgtggacaaggaaaagcccagggacagagtgtgccagtcatagaggtgtctggggaacaagtccctttctcctttcagtgcagggacttgtcagttgtatagattctgaggaaccagttgcattgtagacatgccatcatcaaggactgtgtgcttacctttgaaagatcaaatagtgtaatggtcaagggagcgaacttgggttcacattttagctctgccacttactagctatatgacctctctgtgccttagcatcctcattggtaaatgggggtaatatggtacctacggcaaaggtagtaggtaactaaatacattaatatctgtgaggcagtagaccagaatctggcatttacctagcactaggtagttgttagctattattaatttccaagcaaataatagcacctgtaatttcagctacttggaaggctgaggtgggaggaccgcttgagcccaggagtttgaggctgcagtgggctatggtcatgccactgtgctccagcctgggtgacagagcaagacccagtctttaaaaaaggaatagcggcaaccaagtgtaagtcctgcatttcaccatttcgggagctgctttatgatctgatgcttattgtactctatcgatattccatgcatacgcaattgacagaggcctctggccaataagctcgtaaactctcttgtctactggatatcgtcatggtctctgggcattttgcaggactggggcacttctagagctcacatttaattttcagatgtcaacatagtgatgactttatctcaaattacatggaagcaaagcgtagggtattaatttttttaatgtaatgttagttgcattaacttttctgtaaagtactaatggagttccatgtaaaatgcacttagaaacacactgggtgagtttcacaaaacttcagactgttgggttggagtcatattattctttagtatttacttacgttgtttacatgaaaactgatttcagagtgactgtacctgggtgattaaccacattttcataaatttggatgcttttcatatagtttctaatgaatgtttgataaactgttaaataaatgagtatgtgtgtgtgggagcaatcttcagattacctgttttgcacagtagtgcaaaacagctgtgtggggaaaagttatatgtgtcattagtaatttttatgactcagttcggtattatgagtctacctgtctgcacagcattttcatcttggtgggagaaaattgacacatcatggtggatgtaaaagttttccatgaagaaattactcagttcctttgactgtgtaggctgttggatgctgtcttttctctggacaagcatgtggcattggctctcagtggacagttcatctctcacagataaacagtttaccttccaagattataatagctactccccctggctcaaagtaggattacacagttaatagagagagctgtagcaaagtttggaaagtgtaatgacaacattatggcttgaggagaagaaagtgccgattttcctttgtttgagtttgttactcattttgctttttatctcatataactttttgcaaaaagttacgaaacagaagatatgatcttatatgtttctcttttaataaatatttgcccgcattaatacctgcaactacagaggattcaagccagtacattttaaaaatggatcttaggtggccagaattggattaatcatactttttggctcattacacactattgttcttacttgtaaataaactgtcatgattctaatgacttgaatactttttcttgaaatatagttgtttaacttttccctaaatttggcaaaataattgctgtctgaactatctaaatataaagctagctttggacaggtttggaacatgttttaaaaatcacacataggctttcatgataaaaataagggtttgagatcagaggatgaactcatggacttctttgaccttttattcttgcggaacttcacagttgagtgatacattgatgcttggttaagtgacatgggtaaagtttcggtcaactgttttcagttgttgtaacatgacagaacatgctagccatcttcagtgggcgtcctcaaaacagagagggatggctttagaattctgtttggaaatgacctaggaagtcagtcatctaatctagctcctccagccctgttgcaacccaggagtcctctgggtgcctctgccacaggcaacttagcctgcacttgaatctttgtagggacaaaaaactcactccctcatgaccaatccttttctttcagagacaactttaatgattaaaaatgaaattggttttgttgagcttaaatgtgattccttaacacttctactcatttgctggtattattggtctccacttgtagatgacacaaaaacagtcctcctgcttatagggaattctttgttgcatataaattctgacttttgtcagaatttgtgttttctcagtgtgcttctctccgataagatcttacgatatctgctcaattcaacaagttgagaatcagttacatgcaaggcactgtactgtcctcagtgcctgggtgggagaggtagggacacaagatgacttggttcctgccatccaaatgtatgctgccacgtgaaatgcattggaaaagcacacagattgatacaacagagaaacccaatgccattggggttcaaaggagaaagagtgatatcaaactcagctgtgctagaagagcttcagcatcaggagggaagggagataggcaggtaggatatttttgcaggttgagacgggagaagggcattccaggaagaaaccagtgtggacaaaagcccagggatgggaaacatgagtttgtccaaaagaaggggagtatcttatttgctcagcatgtaggatgcttgcagagaaatgaaggattagatggtaggttgatcccagagctcagacaggcttgatctctctgcctcagttatttgtgttttggtactaggattccattgcaggagcacagacctggatttggatccaagtattgccacagagcttcggcatcttagtctgaaaatggagatttgtgtccattctaaggattccaggacatgtaagggaagaatccagcactctgcctggtacacagcagaggagatcagtgacagttgttattgctgaatgtgataggcctcaggaggagatcctgcagggggttcagggtggcgcatggaggaagacctgtgagagatgctcctccagcgggaagggaaggtgtgcgtggcagtgctggagtgggagtagggagtgggaaacagggctggcatcagtggggaagctggagtcggcagaactggaagcagatttaatgtactgggcaggaggaagaggagaagtcaccccaagtttttgttggggaaggagggttaggcaagaatggtgagtttggtatcgggtgcgttgaggtgctggtgggcctgcagatggagagagcccacagcagctggcagcggggggatgctgggccttaggagtgagccagggaggtggaaaatgcagcatgaggagggtcaggatccaaacggtgtgctaggaatgcaggcacgtgcaagcaagggagggtccttgatcatgtagagcctgcactttggcgtgggtatgtggaaagcagccagcacccaaccagggctggcgtaaaagcaaagaaaggaaagaattcaagagacatggggaagggaaaattggtggagacagcctgacagatgattcccagtatcttagagttctcaggaaaaaacggaaaacaatcttcacattgtttttatacacacacatatgcacacacactctctctctctcatatatacaagttcaatccaaacaccatctattatttggtcctgttagtttcctcagaaagaccctcaggaaatccttgctctcccagagattgtgtctatgtttagaagacttttagaaaaagcctattgttaaattttagtttactgggtagtcactaggagaccatagaaatgtaacccacaggttggctgtattgagtgggcttttgttttactgaaggccgtgtggggaaaacaggactccgtctttggtgagtggctcttcctggtactgtgaacccagggaacccaagaagggaagcgctgggggtcagggatcacctggcctgacccccttgtgtaacagatgaggaaactgaggcctaggccattggaaccagctcagggtcacatggcacatggctcatttgaggcagagcctgtggcttgatgttgggcattcctgctacttgaagttacctgtttatcccaggccgggacctctgggctcatttacaagtggatggcccaaagaggggacttcagttaggggagtgtgtgtgtgtgtgtgtgtgtgtgtgtgtgtgtgtgtgttgggggttattcagggaccattcattacagagcttgactgtgggaaagagtagtcagatccaagtgattattgtagtgccctcgtcatttattagcagatctttctaagaagtgtcctacagaggagagtgctaaaacataaagggtgaaacccttgtcatcagaggtctttacgtagaacctaaatatccacccactcgagttagcaagagttaacattcactgaggactgatggtgtgcctggcactaagtgtgttttctatggaatgtgtctcatttcatcctcttagtgtctttatgagataggtactattattatgctaattttacagatcaggaaactgaggcaccaagggattaagtaacctgcccaaggtgacacagccagtaagtggtagaaccaagattataccatctgttaacctcagagtctgcacgcttatctaatattagtgagtcttttttttttttttgagatagagtttcgctcttgttgcccaggctggagtgcagtggtgcgatctcggctcacagcaacctctgcctctcaggttcaagcgattctcctgcctcagcctcccaagtagctgggattacaggcatgtgccaccatgcctggataatttttgtatttttaatagagacggggtttctccatgttgatcaggctgttctcgaactcctgacctcagatgatccacccacctcgccctcccaaagtgctgggattacaggcgtgagccaccgcgcctggccacattagtgattcttaaccttgctgcgtataagaatctcttgggaaaattaagaaaaattccagttctcaggctacatcccaaaccaattgaatgaaactcatgggagatcttgcattggtattttcttttaaagctcttcagctgggcttggtggcttatgcctataaccccaataactcaggaggctgaggtgggaagattgcttgaggtcagaagttcaagaccaacctggacaacgcagagaaaccccatcttttaaaaaatacttagctaggtgtggtagtacgtgcctgtagtctcagctgcttgggaggctaaggtaagaggatcacttgagctgagaagtttaaagctgcagtgagctatgatcacaccattgcactccagcctggcaacagtgtgagaccctgtctccaaaaaaaaaaaccgctcttcagatgactgttactcatagcgaggttgaaaaccaccagagtgctccacagccggtggagatgttatagggcagtgcctctcgaactaatgtgcataggaatctcctgggggtcaagtgcacattctgacctagaaaacctggggtggagcttagagtctgcatttctcacacgtgtccaggtgatgctgtgctactggtctttgacttttctgtcttggttgaaggctaatcattgtggttgtgtccaactccaggatttaatggctctagtgatacttataagaacacatgatttggccgggcgcggtggctcacgcctgtaatcccaagactttgggaggccgaggcaggcggatcacgaggtcaggagatcgagaccatcctagctaacatggtgaaaccccatctctactaaaaatacaaaaacaaaaaaaattagccgggcgtggtggcgggcacctgtagtcccagctactcaggaggctgaggtgggagaatggcgtgaatccaggaggccaagcctgcagtgagccaagattgcgccactgcactccagcctgggcaacagagcgagactctgtctcaaaacaaacaaacaaacaaaaacaccacatgattttactgtgtgtcagcctaagaacattacatacattatctcttgccctctcagcagcctctaaaggaggtatcattttccctgttttatagatgaggaaatcgaggtctattgagtttaaccctagtcctaacctgagtcttcgtaatcttacacctgtgggattaactaccatgctatgttgctttcctatacatatcgatatgtgtttcctatatacgtatcgatatagttaccaagaacatcttttatggccttgtctttgttttctaacttgatggattatgtttggaactctcttagtgtattcaggatgctataacaaaataccgtaaactgggtggcttataaacagcagaaatatttctcacagttttggaggctgggaagtcaagatcagggtgccagctgcttcagtgtctggtgaaggcctgcttcctagacggccatctttttgtttataacttcacgtggtggaaggggcaaggagtctctctaggacctcttttatgagggcactaactccattcataagggcttcatccttatgacctaatcaccctccaaaggccccaccttctaatattgtcgtattgggggttaggatttcaacatatgaattttgggagagtggatacaaacattcagcccatgacactgttcatttatttaataaatagttttttacgcctactgtgtactcagagctgtgctagatgctgggggtgcagtggtgataagaggagacatctactatgtacaaagtagagtggttgctgctgttgtctgcttggctactagaggcacgtggagcttcacaataatatctgcatggcacttcggagttttcaaggaacttgcacaacaaacccatgaagagttattatcacccacattacacagatcaggaaactgaggctccagaggtttatgtgtagtccaaggttgactgtctaacttgcaaggggcagagcagaaatgtacacccaggccagtctcgcgcagttcctactgtgccacactgcctcccgcactgcccaggggtggtatgggtggaacttttttttgttttgttttgttttgagacagagtctcgctctgtcgcccaggctggagtgctgtggcataatcttggctcactgcagtgtccgccttctgggtccaagcgattctcatgcctcagcctcccgagtagctgggattacaggtgcacaccaccatgcctggctaatttttgtatttttagtagagacagggtttcaccatgttgcccaggctggtctcgaattcctgacctcaagcgatccgcccacctcggcctcccaaggtgctgggattacaggtgtgagctactgcacccggcctggatggaacttaatctccatgctgatgccaatcaaaactcagtggccaggtgtgttggctcacttctgtaatctcaccgctttgggaggctgaggtgggaggattgcttgaggccaagagtttgagaccagctgggcaacaaaacaagatcctgtctctacaaaaaataaaaaaatttgcaaggcatagtagggcatgcctgtagtcctagcttcccaggaggctgaggcagaggatcacttaagcctgggagtttgaggctatagtgagctatgattatgccgttccagcctggccaacagagtgagaccctgtctttaaaaaacaaaacaaaagaaaaccacacacacatgctattcctgaatcaaatggagagcggcttcccctggggtgcctaaccaagctaaatgctcttgggatggtgggatggtcgggatcctgtgccttcattcccctgccttaccaggtgggttcagagggtatcaggagttgaagggccaggacaactccaaagctgtgacaccctcaggacgtagctggacccagcagatgtgcagaccagcttagctttgctctagttttacttgaatgaattgtggagaacacaattctagttgtggagaacacaaacatttcgaccatagcaggagccccacccagagaccatattccaggaacccagcagttactggcaacttttctggttccaagtgtccttgttcttgcctccttatgttggacctggtattgatttatgagaaagtgttgtaggtttctttgtgaagtatgtttatgatgttcagactgtttccagtaaagtttgttatcagtaccagaaaggcttattgcatttgcaggatataaattctagatttgagcatggttcctggattaatggaccatactagtaccttgaaaagcttattgaattataactcttggactcctccccagacctaataatcaaatggatcaggcctggcgacctctgtttttgaaagctccccaagccattttaatgtacactaatatttaaaaaccatggttgttggctgagcacggtggctcacgcctgtaatcccagcactctgggaggctgaggtgggcagatcatgaggtcaggagatcgagaccatcctggccaacatggtgaaaccctgtctctactaaaaatacaaaaattagctgggcatggtggcaggcgcctgtaatcccagctactcgggaggctgaggcaggagaatcgcttgaacccaggagtcggaggttgcaatgagccaagatcgccactgcactccagcctggcaacagagtgagactccatcttaaaaaaaaaaaaaaaaaaaaaaaaaaaaaaaaaaggttgttatgaactgaatgtttgtgttgcaaaaaacatataactgaatgttatgaactgcaaaatttctatgttgaaaccctacccatgtgatggtattaggaggtgggcctttgggagataattcacgttaggtgaggtactgcaggtggagccctcatgactgaaattgatggagagtcatacaagagcttgcctccccactctgttctctcccatgtgaggatacaaagtgatgttagcagtttgcaacccagaagggatccctcaccagaacctgactatgctggcaccctgccctcacatccacagtctccagatctgtaagcagtaaatttctgttattagccactcagttcctggtattttgttatagcagcctgggctaagaacatggtctggaccagtggttctaaaaggtagttcctggaccatcagcatcacctgagaacttgttagaaatacaccttatgaggccccacccagacttactagaaacttagggatgggtcctgcaaagttttaacaagcctccctgtgattctgttgcttcctaaagtttgagaaccactagatccttgtgattcaaaatgtgagctgtggaccagcatcatcagcagcatctgggggcttgttagaagtgcagggtttccggccccacctttaccaactgaatcagtatctgcattttagtgagatctgtgcatattcacatttgagaagctgcactctagatagtcgttttctttccgggatgtgcattttaacccgagatgccttaaaaagataccaaggccttgcctccatccaaggtgattaagacagaatctgtgaggttgggcgaggcctagacatggtgtgtggagaccccggtctaagagttggtgcctagattggagcccaattttcacacctaaaggataagactgtgaaaaggggtcaggactcccaacactgctttctccttcctcctctctgctcttccaccatcccagaatgtgaccccacacccaggctccaggagggaaggctcaagtctccctgcctcaaaaagatccagaggcggctgggcgcggtggctcacgcctgtaatcccagcactttgggaggccgaggtgggcggatcatgaggtcaggagttcaagaccagcctggccaatgtggtgaaacctggtctctactaaaaatacacaaattagctgggcatggtggcgccaagatcacaccactgcactctagcctgggcgacagagtgagactctgtctaaaaaaaaaagatccagagggaaaagttctctttatattttcagggttgtgtgtgtgtgagagatcgagggaggcacagacaacagcgttgtgtgtgttggagggatggaatgtggtatctggcaccaggccacagtgcttctcacacctgatgtatgtaagagtcagtcaccttcacaatgcagattcctgggctctactccagagagccagtatcagtagggcttgggaaggacccaggaatttgcattgttaacaagttctcccaaattcttcttatgtgaaagtctagggtcctgctctgagacaaacactactcaaaggctgtgatctggctgattctcagaattacttggagaaactaaaaagtacagggctccaggccttgccccagctcctctaattcagtaggactggcgaggcccaggaatcagaatgttgtagtgtaaacatatctgaaagcaataacttaagcctacccttagaatgaccctatatggcagatgcacctgaatgtgtataccgagctacggaatccaggattcattccttgtctgtgagggacatctgagccccacgctcatcctgtggagcatgagccgtgcatgggattgagacctttggttttgggttaaatggaggttgccaggtggaggtggaagttgttgggggaagggtgctaagtgaaaatgctatgtaaactgcatgctgtttgcaagtggtcgcaggtttcctgcccagcacactgccactgggcctccagcctctcccactggactgtgtgtaaggcggtctcctgtgcagcccgccgccactggactgtctcctgtctgtaagcgcccaataaaacctcatgcctcatttgctgcctccagatctcttcttgccatttctgttgaggttaataggggttcagtataatgcatgtttaataagtactctgggtttttcaaactgtgttctcagaaacccttaggattcccccaaagtatattggaggctaccaagggggagaggtaagaggagaaccaaggttgttgacaggagggggggttcaaacactcaacccgcttcatctgcttcatgtattaagcttcagtgtacaattgcatttgaaaagaggattttttttccaaattttgaaaacaagtcatagctgttcattgataagggcctctttaaagttggcagtgttctccttttgagccacagttcaggacagcctctcgcccttgtgaccacctgtccttcctgacacgctgacctttagtccctgagctgcctcatacctggcccatgatgctaactatccacaatgaccctgactccattcacattgtgggattgcctggctctgccatttgccccaattaccaaattcctttactactgaaagaatgctggtcacaccagaaatatgctttgtacaaatcatagtacctcaagacagtgagtctcaaatatggctgtggctttcaaatatttttctgcacgagaatcatctggagagcttgttaaagcacagattgctcagccccaaacccagagtttctgattccatgggtctgaggtgggacgtgagaacttgcatttctcgaaagattccaggtgggactgatgctgctggtctggtgaccacacctagaacaactgccttaagattaaataatgttggatacagcttgggtccaattctcctgttaggtgttttctcactgagtagttcctcctttggtgttaaaatatatgaggagaagaagtgctggaatgaagaaatcagtgtcagttgggattatggctcagtcctgctctgcactaattaggttttgctggactctcctgcccagctaacagccatttatgatattgtttctgcaggacagtgcattgcatagtatggtccccgtgctgctcatcgtataggccctgccagaatggttggcaatgacaaggatctgacagtagcttcttattgccagggcttgattagaatgtgacaagtcattgctgaacattggttaccataaaggcaaatattttgtcttccctgaaacaaatagtaagaggagaaagtgtcctgttgtagaaactcccatctttgtagagatttccatcctttcagtcttagacgcttgcagaaagctggcatggtggcaaggcagaggtgtcctgtcagtggccaagcaaacagcaaacacatgctcatggtcactgctgtctaggtcagaggccttcaaagctttgatcaaatacaacaccagtcactgttgggaaatcctcctggacatgtcccctcatttgttgaaatgttttgaccaggcaaatgactataattattgttatattaaaaaaatagcctttgagttttttaacctctgtaatggttcagctctgtggtggaaaatatttaacttcaattttcagaagtacacctgagtgactttattaactacccttgaacaaatgcaaggggtgagttaataaggtggttacatttgtgcaggtggtggagtgagcatctgtgagacggtggaaagaaaatgtttgtgttatgttgggtgggtaaggacaggtaaaaccaccttctccttttctgtgtgtgaggctggctggctgctttaggataaatacttccaggtgagtgtgagcacagatgctgctaggcattgtctgggagtaccctggaaggtcaggcccagcgtctcttctccacagtgctcttgtgggtggattttccagctctctttatcctgctgctgaaggaagtagcagacaatcaaaaacataaaaagaggtcctgggcatgatgccctgaaaaaacatttctagcactgggctgagcactttggtttttttgttttgttttgttttcttttttttttaaaaaaaggggtctcaccctgtcgcccaggctggagtgcagtggtgtgatcttggctcactgcaacctctggctccctggttcaaacgattctcatgcctcagtctcccaagtagctgggactacaggttcatgccactatgcctggctaatttttgtatttttagtacatgtggggtttcactgtgttggccaggctgatcttgaactcctgacctcaggtgatctgcctgcctcagcctcccaaaatgctgggattacaggcgtaagcgaccgtgcctggcctaggctgaccactttggaaacatcgcattcgatttggtccttcccttacaatacgtagaataataaaagctagcaatgttggcaggcttcctgagttccagactttgtactggttgcctgacgttgaggtgggttctgttaaaatggggtcgtatcatagaaacatcgaatgtgcttgaatgacgacatgtgcttggcagaggcaaagagattgtgtttaaacaaaacgacctgctcaaatgtagaaagacattttgagagccagtatgttggtcctactgagtagatttgcaagagtaattttgactgtaagtgattttcatcttaggaactaacttcactccctgctttgctccccctccaaatgaggcttctttcaaccatccccaatttatagatgttgcagttgaggcttaagagggttaaataacttgctaaaggtcatgcagccagttagtgatggaagtcagatttaaacctgtaaacctatgcattccaactctgaaggttacgcttgtcaccagtgctggggcatgctgtggtgtatgcagagctgtgcaaccaggtgacggcagaacttgaagcgctgtccacatgaggagtaactgcaggaatgggtatattgagtcagaagaaaagaagtcacaggcagggtggtagagcttccttccaaccttgtggaaaggggaggcaatgagtgtagctctgggcatccattttaacttggtaagaggcatgaaagttgtaagaatcagaatgtcacttgtgtcaaaaccctgacaaatagagctgggagaggccacgaaaagaaggttctcacacatatatgcctgataacaagaactgtcacaaaaacctctgcaaaaaccacaaccttgcacaaagcctgtggcagtcttacacacaaaaacatatttctgcaaggacatctgcccagcaactgcctgtccaacgttgggttgatgccaccattgttactgatacctgtacccaaggataattgtctcaaaacaacttatatagccatccttatttttccttgaaaagcccttgttttcctttatctccctgaatacactcacatggattcccattgcaatgcccattccttaataaatatcatttttttttttttaaagagagtctgcctcgctgattgttacttaggtttgataaggtaaagtcttttaaagatggagctgttccaacttcactgggctgtttgcaggtagagatccttgttggagctacttaacttgtgcagagagattgtagatgagttttaatcctagggtaaggtcctgcccatcctgacagtcagtgacttaagctttggccacactttggccagtttgtatttgtcctcacagagttctgtgggctttatgataagctgtttgatggaatccccttatatgggcatggcgatttttttttaaacagctttattgagatataatccacataccatacaattcccttaacgtatataagtcaatttttttgtatattattttaaaaattatggtaaaattggtcgggtgcggtggctcacacctataatctcagcactttgggaggctcaggtgggcagatctcttgaggtcaggagatggtgaaatcctgtctctactaaaaatacaaaaaattagccaggcttgttggtgcgtgactgtaatcccagctactcaggaggctgaggcaggagaatcacttgaatctgggaggtggaggttgcagtgagccaagattgtgccactgcacttcagcctgggtgacagagtgagcctcagtctcaaaaaaaaaggaatatatatatatatatatatatatatataaacataaaatttgtaaaatagtatttattgtggctagtattatcaaagatgagtatttttctgcacctggtaacttggccaggaaatcattggaaagctggctttgcatttgtatttgatagtatttagtgcttgaaaatgcatggatatggaggcctatgctgggtcttctccctgcatcacaggattcatgaagttattaatcatatctgtgctgatttttattttgacgacttgttcatacagccacagctgtgagagttaatgcagcaggctcagcatggtggaattagcagaagccctggaatgaagtgaagtgactctttgggaagattcagttattcctgcaagatgacaaaatacctaaaaccaacacaaccatttatttgcttatggttttgcaatttaaattggacagggctcagtagggacaacttgtctctgctccatgtatcagcgtggacggcttgactgagagcagaggatttacctccaaggtggcacactcatatcactggcaaggtggcactggctgctagttgggagcttagctggggttgttggctggggacctcagttttcttccaggtgcacctttccacatggttgcttgggcttctccattacatgatggctaggtcccaagaaggaagaagtgttgctgcctgaccttcctgatgcctgggctctcaggtcttagtatggcacttctgcatgtcactttcagaacagtgacaagtccagctcagattcaagagagagggaacataagctctaccttttttttttttttttttttgagacagtgtgtttctggctggagtgctgtggcacaatcttggctcactgcaacctccgcttcccaggctcaagcaattctcgtccctcagcctcccaggtagctgggcttacaggcgcccgccaacatgcctggctaatttttgtatttttagtagagatggagtttcaccatgttgggtaggctgctctcgaactcccgacctcaggtgatctgcctgccttgacctcccagactgttaggattacaggcgtgagccactgtgcccggccggctctgccttttgatgggagtagcagcataaagtggtagggaggggtagaatcatttgaggtcatctttagagactagctaccacgaagaaccacaatggtcttttttctctttcttcctcattctcactccacagaagcctgtccctaatcattgtgtgagccagtgatgacaaatactggcaagaaatctaagaaaaaatttaaaaatcagtactaggaatacatagtatttaagagatcgtggcttggtctcaaactccctacctcaagtgacctgctcatcttagcctcccagagtgctgagattacaggcgtgagccactgcacctggcctgctcttaatgattatttaaatttatatttgtttagtgattacacattatttgcttacttctgacatactctgagtctcactcagatcagagattataggagggggaatatatttactagaataatttctccattcagaatgtcagaaataagaaagccttttttttttttttttttttgagacagagtcttgctctatcacccaggctggagtgcagtggcgcaatcttggctcactgcaccctccgcctcccggttcaagtgattctcctgcttcagcctcccaagtagctgggagtacaggcacctagccaccacacccggctaatttttgtattttattagagacgggatttcaccatgttggccaggctggtctcaaactcctgacttcaagtgatctgcccatcttgatctcccaaagtgctgggattacaggtgtgaaccaccatgcctgacccgagaaaacctactgaacatttttaaattttatatgttactgcttggaaaacagagctttgcttgttcctttcagctattccctgatgagcccttaaagtccacaattctgtttcagcttaatttctgaaaatagttataccacattttcacagtaagagagctagtagccagatgcatcgtgtgttttgtttgcaaatgcatcatctgctgtctagcttccttccatggagaggaatggccttatatttcacagtgaggcttcaactgctgctcccttttggcatgtcaaagtctaattactgtggtctctgtagcaggggctgtatccacagcctgcgaatgtttgtgttctacgatgatacttgggcatcagtgacatttgaaaggggtggttttttgagacggagtctcactctgtcgcccaggctggagggcagtggcacgatcttggcttactgcaacctctgccttctgggttcaagtgattctcttgcctcagcctcccaagtaggtctcgaactcgtgacctcaagtgatccgcccgcctcggcttctcaaagtgctgggattacaggcgtgagccatcatgcccggccttgaaagggtttttattttagcatcaaaaatctatggcatggcttggattgcatttcttctaggctgttccatccttagtcacataatgctactaattcacctgaaggaatgctgtcaaaataaatcaaatggtaattttaaaagactctgtctcattcattgtagcttttactcagttaagaacagtttggaaatatgagccttgagcatgagaacactcacgtagcattttattttagcttaatgctgctggctgtcattttgccgctatcactgttttacgctgaatggttaaatgtgagaaagaaagaacaaaatggtagcatattgtgcttgactcattgagaaaggctgttttaggttaatgtagaattccaatagtagaaagaaaattctatcccatatacaaatgtgacttgcctctcaagagcttctttgaaggttattttggagcgtgtgggggatgaatttggtgcataggataataataattgacatctgtctggtgctactctgaaccaggaactgtccctaagtgctttgcatgtattaattaatctacatataagcgctctttgtattatttccatttacagatagaaaaattgagatgtaaaaagataatagaaacaaggccacacagctagtcagtgttgagctggggcttggttttgactgtctggcttcagtggactctggctttagccactatatgacactcgctaatcaaagtaagttatgttttcttagtcttttttttccctttatttgaaaccaagtttcagatgttgatttgcaagttggcagtcatttctgttttataaagcttattttttattgccccagttttcaaaaaagcttttcttgtttaacatttttgcctgatgaaaataaaagtcaacttttcaaacagattatacatgttgataatagtgctagtcatatgaaccactaatagtatgttaagaataagtttcaaagtaaaaataatgtaagttccaacatagtacatttatcatatagtcgagtgaatagtactctgtctcacatattgtttagattgtagaaattacagcccttaaaaatttaagtatgtttaaagtagcccttaagtgaattaacatttcttttttaaaaaaatattattgatttttgccaaacaataaaagtaataacagacttttagaaaatctggaaagtataatatggtataaacaaaaaattaacactgtgtgtaatttcaccacttataggtagatgattcattcatgttagcatttaagtctatttgccttccagccctcattcatgcatttactccttccacgattactaactgattatcttctaggcgcagggcaaaagcagcaactaaaatagtctttctccctgtggagcttatactttactggaagaagtggacaatgaccagataaatatgcaatatgatgtcaggtagggaaaagtgctttaaagaaaaacaaggcagggtaggaggatagaggcacaagggctgctgttttgggaagggcagccccagagaaggctgagtggttttaggaagggagcctgtgactgtctggtgaaggacatgacaggtggggacacagccagtgcaaggccctgtgatggaagcaggcttggtgtgtctggggaccagcaagcaagccagggtgaccggagtgtggcactcaagggagtgcaaggaaatgacatgggagagatggcagaggtttgcaggctgtaaaaataagggctttgcatttcactgagtgaggtggaagcctttggagggtttgaggcagaggagtaatgtcatctgggtttggttctaacagattccttctggttgctctggtgagaatagactgcaggggataaggtggctgggagaagggtttgcggggaggtggtgagaaaaatggtcagattcaggatgtctttaaagtagagctaacaggatttggagctggattggatgtgtgttatgatgaaaacagaagagtcacatatagtgataacttggtgttgtggtctgaaatattgcccttccctgattcacgtgaagtcctaacccccagtacctcagaatgtgagcttctttggacatagggtccttgcagatgtaattatttaagatgaggccattccagagagtgtgtatgtgtgacgtaatccagtggactgatgtctttatgaaaaggggatatttcagcataagcatataataagagggaagatgtgaagatatagcaataaggacatctgttaagccaaagaacgcttgaggctaccagaatctaggagagaaggatgaatagattatctttcagtcctcaggaggaaccagtcttactgacatcttgatttcagatttccagcctccagaactgagtggtagtaaatttctcattttgtgatacttcgttatggcagtcctagtaaactaatacacttggtgagcaaccttgtgaatggccgtcccttttaaggcagtgaatgccaggaaggagcaggtcttagagtttggggtggatggaggggacagaagacatgctaagtttgagaagcctgttagatacccacatggaggcatcgatgagaccgttggatgtggaaatctggagttccaataagaggacaaggccagacatctaagttcgggcactgaattagatcttcaggagaagggtccaaggatcaaggaggccctgggaaattttgacatttggagggtggggagagaaggaggagacaggagacagagcagaggatggcagtgaagtgggagaaggctggcagggcgtggtggctcagcagccatggggggacatggggaggaggagggaccaggcctctgtggccagcatggctgatggtcaggaatggagaggaccaagaactcccactggatttagcagcctggaggccactgatgacttggacaagaacagattccgtggaaaagcggaaaagtggatgcacaaggctgattgaagggagttcaagaggaagtggcattacatcataagcattatccagtgtcattaaaaatctttttcaatcagaggctggctaggaagagtgcatgggtgtgtgggggggatgaagagaaattggttaatgagcacaaacatacagttagatagaagaaagaaattctgagtttgatagcagagtaggtggctaaagttaacaacaatgtgttgtatatttcaaaatagctaggagagaggacttgaaatgttcccaacacatagaaatgataaatattcggggtgatggatgccctaaatatgctgacttgatcatcacacattctctgcaggtaacaagatatcacatggaccccataaacatgtacaaatattatgtatcaattaaaaaaagtttttgaacattgtttttgatgactgtatcacattctaggattttaatcctttttttttttttttttgagatggagtcttgctctgtcaccaagctggagtgcagtggcttgatcttgtctcactgcaacctctgcctcctgggttcaagtgattcttctgcctcagcctcccgagtagctgggactacaagtgcgtgccaccacacccagctaatttttgtatttttagtagagacggggtttcaccatgttggccaggatggtctcgatctcttgaccccgtgatctgcctgcctcgacctcccaaggtgctggaattacaggggtgagccaccaggcccggcctaatccattctttacttgttttatgggtaggatggttctaacttttaccactatattggttgtgatactgcagtggacatatttgcatacaaaattccctagattaggaatgacaagacacaacaggatgattatttttagggcttaatcctaaaatatggccagtcatttacagaaagtctgtaccagtgtacactcctcttggcatgtaggagtgggcttgtctcactgcacagctcccctccatgtatttttgaattgactagaacatccagaaaagcattgttacagaggtgatggtagggcttatgggctgaattttgtttccccaaaattcttctatagaagtcctaatccccagtatctcagaatgtgagtgtatttggaattagaatctttaaagaggtaattaagttaaagtgaggtcattagtgtgggccttaatccagtgtgactgatgttcttataagaagaggcaatttggacacagagacagacacagagggaagaccgagtgaagtcacagggagaagacggccatctacaagccagaatgaggccaactctgctgatgcattgaccttggacttttagctcccagaattgtgaaagaataaatctctgttatttaagcccctgactctgtggtactttgttatggcagcctggcaagctagtacagtgggcattagtgttttgttcctgatttacaggatgatgtctctggtgattatactaaatcatactggacctgcatactagacacatatatttaagaatatattataatttatcctcccaaacctgatcgcttatgaaacataaatcctgaatcagtggggtctattcccattttgctgctctgtggcagattttaacactgacatttggcctggtccgtgtgttatttatttctctccgatttcaggtctcctggttaaattcatggtctcagggaggtctttcctaactccctgacccccactgtgatcaccccccatcagacactcctcttctctttccgaaagactggtaatagttataattactttccctgtggggtctccctggctgggttgtgaatgccaaggggcagagatgatgtaaaaacatcatctctgtttccagttctagccacagggcgtatgacagtgcctggtgcaaaattgagcatagaattgtcactcagtattttgttgaatgaataaggcatgagtcaaacttggccacttgcccaagggcacagagctgggatggggtggggggggcttcacactcaaatctctgtgaccccagagcatagctccctcttgtacgtgtctgctcatcagtagatgagcttgggcaaggaggtgtgtagtcacattttttgattttctctcaggctcggtagtagctcctcaaggaaacaaaccatttctaagaattctttgtatcctttatggtcccttgaatataataactcacaaatatttgccaattgtccaattaaggccgccatgttcctctttctacacctttgttattatgacacgtagctgtatggtgattctttttctgtacttgtgtctttcctattggactctgatctacttgagagcaagaaatttgtctccatcttttgtctgcagttcttggcacaatgcaggcatttaagagggggctcaattggatgaataaagataacatggatgggattaaaacaaatttaaagattatttagaaaggtattgtcttcctttgaatgaactctaaagataacagttataacaatatatgtgcataatagtttacagtctgtaaaacccaagatttttcaaaatatgtactcatcatacatatatactagcatgaatgcacaaagtaaaattatactattagagaaggtgcttaaggagtgaatggcagtgaataatgaaataacgtgttttaattcactttatcaatgctttaaaagctggtagtatcactttatagttctaattttgaatggctgttaataccatattctactcaacctttatggttcttttaaattttttcttggcacaaatagcgctgctgtggacacctacatatatgtatgcccagttatttcctttttttgattattagaataaatttctaaaaatgaggctactgaaatatttgaaacatattgttaaactgctttctaaaaaggcttgtaccatattccttacctcctttgcagcacttagtactaatatttatattttctaaaaaattagccgtgatgtatctccttgttttagtgttcatctcttttgatgactttgttaatttggacattaccctataagtttctttactaatttcatttccctctgtctaaattatctatttctgttctttttttcattttttgattttggtcttcctttgttaaaggcaacttttattaattttttttatataatagcattttcagaaaaattttttttctgggttatttttttcccttttgctattttaattaatgttaaatgcttatatacactaaactgtagatagatattttaactttttcttttttttcattgaatgcctgtgattaaaaaaagttatacatggcagtgataagatcagaaacaatccaggaaaactgctggttgttttgtattacaggacttgtgatttaattacgttatattctgtgagtgcttttacaactattgacggtattgggaagagtgtgtttgggcccagctgaccacctattttaaattacatcacatggttaacaaccactcctgctgagcttaggtttagaaaacttcaagcttccagaacacagctcttggggagctgggaattctggggctgtgtacttgacataaaggcattaaactcctgaatgaaacatgagattctgtacccagcctttgtgacttgtagtccctttaatttttgctatgctcaactatctggttggtgaagttgttactcgtaagattagaaaggcaaatagggtaggaaaatagggtggaaagaatgcttgtgtgacttgacgatctgactcagagggaagagagagaacaatgaaagcaaacacccatccctcacaggtttcaaatagattttcataaggatgaaagacctgtaaagatttattaaatatattggtgattgatgggcatggtccacgtatttagaaaatttcattatgtggaattcttcattattccaggagactggatagaaaaggcattgggatgttatgctaatttttttttctctttagggattttggaggaggctaacccagagacatttacaacgaaacaacagcatttatttggatttggtacaaggagcaagcagacagagtagactaaaatgtgtgacctcatgctatatttcttgtgatctgatatcacttagtgttattgaatgacttcaaagggcagctgggaattactgtgaagacacacacagcaaagcaatttctcacctgctgtctctgatcacagaagacacagttagactcacatttctccccaggacacatgcggtagacatgctgcaacttgtttggagagaaaggcaaggggcagagagtcacactgtttgcactgtgtggactgagacaagttttaaatataactaagggttacttttttagaattaaaaacagtagaagctgagcttcagggcatgggttacttcctaaaaatacaatcactgaacttttaaagaactctaggatcagcttgtcaaactggagtagatacgaatgtgaaagacatctgagactctttagtacttggcgcacagattgagaattaactcaattttgactgtttcaaatgatgaaagtattttcagaagaccaacctggtagccaggatggtgtagggttttgttgcttaacctgctcacctagatcttgatgtcagtgggctttctgcaagcccactatctgagtttatcgctgtcttggtggcagttttggccacttttttttttttttaagagatggggtcttgctatgttgcacaggctggactcaatctcctaagtgcctacaataacctcctaaatgttatgccccttgtgatgttctcttctctttgaccttgaccagtttgcttcactgtcgctactcttcagagttcctctacaacacattggatctggtttctgaacctgtttctatctgtaactataacataaggttaaatgtcactgcagactttgtgtctttgcagagtttacttgaatttaattttgatggaaaaacatctgctttgaaggattggagactgcttgattgaataaatcgcaaatcaagtctgcaagtgtagatgttaccatgtaatgaattaagagaccattggccatctttcctttatagacgtccttaaatcccccagcatcatttggaaagtagtggctctatgtttatatcagtcagtcaaccaagtttaggctcctatcccaggctacagaaagttctgcataagtcacttaactgacctcacagcttataacctagttggcaaataggagagaactgtaagaagttgactagcatgtggaatgtgaatgatgacagtggacaagagccagatggtacaaaggtcgtgatagggctgggtgggtgggtctgttagtcacttctcacactgctataaagaaatgcctgagactgggcgatttataaagaaaagaggtttaactggctcatggttctgcaggctgtacaggaagcatagcagcttgtgcttctggggaggcctcgggaaacttccaatcatggcatgaggcaaatggggagcaaggcacaaaacatgaccagaggaggaggaagagagagagtggggaggtgccacacacttttgaacaaccagatctcagaatcacccactcactcactattgcaagaacggcatggatgggatggtgctaacccattaatgagaactctgccccatagtccagtcacctcccaccaggccccacctccaactctggggattataattcaacaggagatttggtaggactcataccaaaccctgtcagtggacatttgggagagacttcatacagaagggtgggagaagggtgggcttgaaggcattggaggttttaattgttctcattggattgaggggcctgtgctcctgcatagggctccctctgtgcagagacaaggaggtgggaatcccagaggttgggtgagcttctgcaggggtagaccagtgagaagtgagggtggaaaagggggtttgggttagatgtagatggccttaacatttacccttggtcagctaaaatgtgtggaaagtttttgaatgaaagggaaaaaaatgattcaaagagtagcgttttagaagactagtctgtccgcaagcctggattaggtttttgttcctaacccactacttttcagacttggctgtatatttcagtcacctggggagttaaaaaagtactgaagcctggagccctcccccgctagagattctgatttaatctgtttggagttaggcctgggtttggggagttttaaaagttccccaggtgattctaatgtacagccaagcctgagaaccaccgcccaatccactgataagatcttgatatagcctccactcagcctccactcatcgagctgaaccacagcacagtgctggccaggaaaaagcaatcaactgatgggaaaaaaaataaaattaaattaaaaagtacttctggctggctgggggcagtggctcatgcctgcaatcctagcactttgggaggctgaagtgggtggatcacctgaggtcaggagttcaaggccagcctggccaacatggcgaaaccctatctctactaaaaatacaaaaattagctgggcatgcatgcctgtaatcccagctacttgggaggctgaggcaggagaattgcttgaatctgagggacagaagttgcagtgagtcaagatcgtgccactgcactccagcctgggtgacagagtaagactatgtctcaaaaaataaataaataaaaataaaaggtacttctgtgacaatatttataatattccacatagtccaacaccttagttataataagttttcacgtaaatgctatgaatttttgcattggccatgaagtagatggggacaaatgtgtagacttttggcaatgtatagatatggaaaatgacatctaaaattgcaataaaaatggcaagataaaacacttttatcatagccaagaattcagtagcctaaaagcaattacagcatgaaagcttgcaagtataaaaatataagtcctcagaaacttgctgctggaagacctgtttccagatgttgtgtgtcagtgattctcaaacctgagtgtgcatcgacgtcgcttggagggcagtcactgattgctgggctccagtttcagatttagcaggcttggggtagcccaaggatatgtagtttcaaagttttcccggatgatactgccggcctgggcaccatactgtgagaaccactgatgcttgctgccatgtaagaactgctactgcatgggcccaaatattgtaggaaaaggggcttgataaatgtgatagaaggacatgagttgttttgttttgttttgttttgttttttgagatggagtcttgctctgtcgcccaggctggagtgcagtggcgctatctcggctcactgcaagctccgcctcctgggttcacgccattcttctgcctcagcctcccgagtagctgggactaaaggcacccaccagtacgcctggctaattttttgtatttttagtagagacggggtttcaccgtgttaaccaggatggtctcaatctcctgaccttgtgatccgcccacctcggcctcccaaagtacaagttttgctttttatgtcagatgacgggcttctcttgggagttagggaatctgtcctcctccagttcaatccagcccctcctcatctccgtgctctagggggcacctgtctgagtctaggtagggtaggtagaagagaaaattgtcttttcattctcctaattgtccttttaaaatgtactacaaagggaggtattatatacatagctgtaatattatataacacgttctttacttttcttccagtagaaaatatttgtaagttcaaagttttttttttttaacttttatgactgtctccccaccccccttaccctaccacatgaaaaatttgaagagttaaaaaaaaatgctaaccatccatgtcttccttaaaacaggttcttgcggctcattcttggtggtacattggaggatgtcagtccttggcctccccctaggtgccagcttttgcaccaaacagccttcctggtagaaaacacatttgcagtgtaccttgggcgggaggagaagcggaaatcattctcagatgttaaaaagaaacatgtttctaattgaaagcatgatgagaaggcacacatgaaagggcctgggtggtgagctcaggccaaggcacagctttgaaagcccagctcagtccttgctgtggccacttctgttctcttgggtggatcccattcccattcctgtgacattccagaaataaccatggctgagcagggacccaggacagcatctcagatatagcaacaaagtttgctcagttggtcaggaaactctgatagttagaattctgaattctagaaacacagagcttttgaactagaattctagaagcagagtgtgggaacagcctttattctcatattgtggagaccattttagaacaaatcgctgctgccctcctcataacccccaaacacacacaagtgcagaggccagggttaagtggcttactccaaggtcacctagggagctggctccatttttttttttcttttagagaatccttcccaactttctgaaaatttgtcagcttggtattctgacacccaagggccattttagaaaaatcattacttgctgtaacgaataggcatcatattgtaggaagatgggaaaattattttgtctcttttatagaaaatcaataggttttgaggcttttaggtcttggtcttttggatcttcataactgagtctcctgttgttcgttttgcttgtctattttgtaattgctttgtggactgaagcttgttttgaactttatgggagacttgatagtgtgatctgcctcaggaccaacagtttatgtaaaaggtgagctgacagcaacagggcagcatagtaaatgtatttgaacaaataaagaagggactgaaggaatcatggccataagcttatgacattacataataaaacttaagtcagtagcatgtacacttcttttttttttttttttttttttttttgagaccaagtttccctctgtcatccaggctgcaatgtgtggcaccatctcggctcactgtaacctctgtcctctgggttcaagtgattctcctacctcagccttccgagaactgggattacaggcccctgccaccacactcggctagtttttgtatttttagtagagatgaggtttcactattttgaccaggctggtctcgaactcctgacctcaagtgatccaccgggctccgtctcccaaagtgctaggattacaggcgtgagccactgtgcccagccagtagcatctaaacttctaagggaccttgcctatcataaaacctacttactctaccaatgacccacagccctgataacttctctttttaaatttttaattttgagattgggttacattctgttgcttaggctggagtgtagtgctgtgatcacggtcactgcagcctcgacctcctgagctcaagagcctcctgagtagctgggactacaggtgcgtgccaccatgcccagctaattaaatttttttttttttttttttggtagagacagggtcttactacgttgctgaggctaatctcaaactcctgggctcaagcgatcctcccaccatgacctcctaaagtgatgggcttacaggcgtgagccactgtgcctggactgataactttaaaactctgtttggtcaggagtgtggtgattcagagtacatacatccttgcaaataggagatgaagaagttgtttctttttggttgcctttcattattaaattcggaatggtgcctagcacactggatttttatacaaactagcaggtgtgttttgggcgactctcaacctttctgcccttggttttctcgttttctcgtatgtcaaagagtagattggactaaatttctgacacagtctctcgaagatctgatagcctatacaacatgaggtctataggagagcactttttggggttggggattggactgaacttttgttttttgccaagtcttggcaaaaaatttaggcttaaaaaattttaaattaaattttaagttaagcgtatatttaaatttaagccacagaacataactttaaaataatggcagagcattttcttacgatttttcctggattttctgatgcatttctgggaggcagatgcagtaaaatggttaagaatgatagctttggagctggctcacttggtttcaaatccgagctcttctactgagtaataattatataatgtttaacaaatcacttaatctctgtttctgttttttcatctgtaaagtgggcacaataaaatatctacaaaacacgttgctgggggattacatttgtttatatattttagaacagtgcctgtcacataggaagccattaatattagctctcttccccctcctccgcccaactgccccaccttcctccttatgagtatttgtgtggttttttattggagaacaaacaacctgatgctactgttaaccctttggaaaaattaggaagtctacaatgttgttcttcaaagctgtgccttctgttttctttctgcagctagctgtgttccgccatgtcagaatggagggatgtgtctccggccacaactctgtgtgtgtaaaccagggaccaagggcaaagcctgtgaaacaatagctgcccaggacacctcgtcaccagtctttggagggcagagtcctggggctgcttcctcgtggggccctcctgagcaagcagcaaagcatacttcatctaagaaggcagacactctaccaagagtcagccctgtggcccagatgaccttaaccctcaagccgaagccttcagtgggactcccccagcagatacattctcagtgagtgtttcgaactttcatttagctaaggatcatcttaattactctcttggatgccttgctttaaatcactgtccctttcctgcacaatttgcagaaatcacttggataataatgtttttctttcctttcttaaggctttacacgttaggctttacacatggaatctcttaaaaatatttggtgtgtgtatttagcctctgcaggaaattttaccataagtacaacccatggcaaccatgaggattatagggatcaagactggaagggaatgataaaaatagttatttttgataaagttgttagtttaaaaattctgtttttgaggggggagctgctttatagagttttgaaataataatttaaaaaaagaaacagtgttatttttaaagttatctggaaaaggtaagaactcagcttgcacagagaaactactcaaatgaaagggagtccttgcaaagagagaatttctcaacctcagtagcaggttaagtgtaccttctgttaacaccatgtttatctcccagttgccgtgtgggtccatttttggtgaatgagcttgttttctatttatgggaacaaggttttttttttcttagtgttaggaagtaagtgctattctgaacaaaatgagaactcagagaagaaagattaccccgttctctgagttgcattacaagcagccactcagctgcaccgggtccttaaacaaattgtctcctcttaatgagctattctgtatggataataagatgcagaatgtactgcaactatcacttgtcatttgtctaggaaggtaaaatacaggaagttcccaacttaaaaatgggcttgacgtagcagttcatttgtaagtcacttgcttggaatttagaatgcttcttccctctgcagagacagcttccatatggtgattagtatccagtcagcccacagaagttattcagtctgttgctatagatgaaattatccttatttttacttccccttcgaatagaccacctactgtttcttctgagtgtggtctttttcttttctcctattccctcctcaatcctcttttttttttttttttctgtttttcttcattattctctaatttcttcttgtctcataatacttcagttctattgtggtagctagatttagggactagtttgaaatgctactttgctgttggaaaacacattctgcagccctcaacaagaagcaaaggtaagataggtatagctaatacttagtaagggcttactatgtgccaggtactcttttaaacacttattgtgtattgttcacttacagctcacaaggatcctgtaaggaaggtaacattattaaacccattttacagatgagaagactgaggtacagagtggttaaatagtttgttcaaggtcccacagttactaagtgacagtattacaatttaaacagaggcagtcacgtttcagcatccatgccctgaaggaaggagttggcaaaaattttctgtaaagggacagatagtaaatatttttagctttgtgggacatacggtttctgttgcatctactcagttctgccatggtagcacaaaagcagccatagacagtgtatgaattaatgagtgtgactgtgttctaataaaactttatggacattgaaatttgaatttcatataaatttcacaggtcatgaagtattattcttttttaaatttttttctcaaccattaaaaaacataaaagttatccttaacttctgggccataggaaagcaggctgtgggctggatttggcccatgaactgtagtttgctaactttttctctaaaggatagtagtgctttttttgtgtgtgccagaacatgaatataactgtgtgtccttggaacggtataaagctttgattatatcatagctagacatctcccttccaacattgttttggatattaaaaacaaaaaacaattctgtgttgaactatgctttggcgatcaagagtcagattactgtgaattgcaattagttttttctagcattatgacttacataaactgtaaagtaatttacaagcaacattattcatcttcaatatcaccatccactgttagaatttgaccctctatgatgtatatatatggattgttagtaagaaccgtatgtcggatgtcagataaaggaacagtctattttttttccttccttttggtagccgcggtgtactttagacaagaatgttgtgagtcaaagaggaggctaaggtttcagctctgactcagctttggtaaaataaagtcattaggcagtttgctttggagacttcatctgctgaatgaagatgcttttttatggtagcattgttataggcatgtatatatgggtgtgcctactggtgcacttttaagtaaagagaagagatgagaagagatggccttgggtgccatcaatcctgatattaataaactatatagtttgccccattatctagtccctgcagagaagattaagatgtacaagatccagtcctgctcttaaggagattttgaaatgacaaatgagctatacaaaggaaactatacaaagctatagaattagccctttgattaatttaggttatgacataatcacagtgagtcatgtttaatcaaatggccaaggaatcacatgtgataggcccactttggctacttttgagaaatgttacaatccttaagttatctttcagattgcctattttaggatatttcaggttttgtgtttaaccagtaaaggaggagattgattaagcctccttaaagtattcaactatatacataaatatgtctaacatgccaaaatgtttagtgttacgttcattgtgtgtcacatgaagtgctatcatcttgatcacttattcaacaagtttttatggagcatattttatgtatgagggcacagttcagggagctaaggatagataacactaggcaactacataaaatgtctgctttcttggaacttacagtttagagagggagagacagttgataaatgacataattaaaatacacattagatattcataagtgctgtggagaaaataaaactgcattagcagataggacatgctgggttggtgtgtggtggggaagagtgaggggtgtggcagttttaaataggctgccagggaagaccctactgagaggcatttaagcaaaggcctgcgataagtgcatgaaccctgcagatatgtaggggtgaggcagaggctttgaggcaggagtgtgcctgagatgtttgaggaacagctagtttggtaaaattgtagtgttaaaagcacatattttaggcaggtggggattagatgaattggttttacctttggctgaattggttttaggcaacttgatttagaaccaaatacaaataaagttccttaggaaatcaaaggaaagagcagttgtttccagattttggagtgttagtgcagtggagtccagggatggctccttagagaaggtgtctgtgaaaagatggttggattcagatacatacaactggaggagaagggtgtatccaggggaggcaatgatgtgaggctaggtagcctggcatattagttttctttggctgtgtaacaaatcaccccaaaacttagcaacctaaaataacatgcatttattgactgacagtctgtgtcaggaatccaggggctgcagccaagcagtcagcaggggtggcagtcatctgaaggctcgactggggctggggaatccactgccaagatggctcactttcatggctgttggcaggaggccttagccctggcactggctgttggcagaaagcttcacttcctctctatgtggacctctctgtagagcagcctgagtgtcctcacaatgtggccataagcttctcccagagtgagtgatcctagattagggagagcgaggagaaggccacagtgcctttatggtcttggtcttaaggatgccacaccctcacgcttaccttattgtactgattagtagtgagttgctaagtctagtcctcactcagagggggtagaagtatgctgcactgcttaaatggagaaatatcaaagaattcgtggacatatttaaaaataaccatatttaggatatgatttaattagaacttgataaatatgaagattaacggtaatataaggtaatataaagctctaaaggttgcttgaaaaccaagctactgactaagatttcaacaaaacaattccaaaaagacacaaaatagagaaaaaagtaatggaaggacgcctcgtagcttaaacaaggcttaagaaacacattaaccaatcacagtattttgattatgtttctatcctgtttcaaacaaactgctaataaaagaaaaagataacaatgacgatttatagaacaatcatgaacatgctaacattggtaatttgatgatataaatgaatgattgttgattttgggagctgtgatgatggcattgtagttatgttcataaggaggagaatcatgttaaagtatttacagatgaaatgatatgatatatgagattttattcagaataatccagtgggttgaggtatagaggtaataagattggcttgaggtggtaattattgaagcttgatgatgggtacataggggtttcttacaaaattctttttatatttttgaaattttctgtaataaagagtaataaaaagatgaagtttcttatagtcctgagtgtggtcctgagtcttcaaaaacctaatgctatgatatctccaaggatggaagaacttctgggatattccttgaagtatgccacctcctaattgacaatagtaacaataaaacgtaagctcattctctttatttgtagtaaaggaaaaaaaatcccattataaagctatgccaatagttaaacactttggggaaagagttcaagcttgttgcagtactgatagttattactgggaccttgtctgaacttattaaaggatccaaggaattggtcagtagtcaaacggatgatttccttaaacgatctctcagactgtaggaggggaccttgctcaatattgaacccccacctcaaccccaccaactctctcccaggtttctcttgtgtgctttcctgtacttaacattgtcatgacacaacacagtctttgatctctttgtccacagaggtacacagaaaggctccaatcaatgtttgcttaatatatatatatttagagttttgcctagagaaaataagtgttaataatgtctaaatccttgtctatggattgtttcacgaatgcttatattgcaggacgtacccttctctcttggaataatagcatttgcctttgtaaagccctgaacattttgcagagtattttccattccttatggtatgtggtctgcccaacgagtctgtgaggtagttgaaggttttgatcctactttattatgtggaaaaaaaaggcattgaacgaaagttgaacaaaaggaactcactccaaggtgctcagtgctcaattcatgacacctggggaatgggatgagaactaaaaatttgaaccaatcactgattttatcgtgttatacatatttatttaaacttaaaaagatgttaaattgaaattacatacagaaaagtacaaaagtcaaaagtgtacagtctagtgatgatcccaaagtgacatattcatgtaagtgccatcaacattaaatagaacatttccagcaccacaaagccccttgttcttagactcagccatcttcctcctcaccggagggagctactctcttaacttccaatgccagagatcagttctgcctgtgtttgaactgtatgtaaataatacggtgtgttttttttcactcagtgttatgtctgagattcatctatgcagttgtgtgactatagcttgctcatttatattataccaccaatgcttaccacatcatgtgagtgtaccacaattcattatttattctgctcttgatggatgtttggatttttttcaatttttggctctttttatcccagattgactaaggtataattgacaaataaaaattgtatgtatttacagtatacatgatattttcaaatatgtacacattgtaaaacgattaccacaatcaagctaattaacatatctcttatcccacatagttaccatttttggtttgtggtgagaatgttgaaggtctactctcttagcaaattaccagtatacagtatacagtattatttactatagtcaccatgctctttgttagatctctgtaacttactcatcccacgtaactaacattttataccctttgaccattttttggttcttaatactgctgtataggtatgtatatgtgaaaattctagaagaaggccgggcgcagtagctcacacctgtaatcccagcacttttggaggcctaggcagctggatcatgaggtcaagagatcaagaccatctggccaagatggtgaaaccccttctctactaaaaaaaatacaaaaattagcggggcgtggtggcatgcgcctgtagtcccagctactcaggaggcagaggcaggagaatcgcttgaacccgggaggtggaggttgcagtgagctgagatcgcaccactgcactccagtctggcgacagagcaagactccatctcagaaaaaagaaaaagaaattctacaataagacctttttgaaataatcaccaagcccaactggatatagcagtatggtagtttgagaaggacttcctaatccatgaaaaccatgtaaagtttgatcatatcattagctattggtcagacctattttgttgtttgagaaaaacagacacatggggaaaatggtgaggtgaggtagtgtgttgaggagctggaagtgagcagctcttaattttttcctcctgagactgagttcggaagaagagtagaccatggcatggaggtgggagagacaaggacagagttggggaggtcactgcctcacacttctgctcacaccgctgggtctggtggaaactcaaagtttgtatctaaaaatgggaggtgttgggatagagtttgcttcctaatacaattgaaataaatcaggataatgttttggtgctatgtaataataatagttaatatgaccaattattctgtgccagacacaattctgagtactttttgagtgttgtctcatttaatctcttcaaaaccatgtgagaggcctagcgtggtggctcacacctgtaatccctgcactttgggaggctgaggtgggcagatcatgaggtcaggagttgaagaccagcctggtcaacatggtgaaaccctgtctctactaaaaatacaaaaattagctgggcatagtggcgagcgcctgtaatcccagctgtatctcaggaaaccaattcaaaaagtcactgattggaattagcaaaactttacttaatcatcctggtcaccatcccaggccagtaagtagttcagctattcaagtaccataaagtcccattctttacggtacttgtagcaaatgatgggacccacttcttgtatatctctggatgtcataagggttttcattgatcagaccatatttaattttctgtgtcttatgttcttgaccttgcagtgttgaatcttcttgctccttgcacttagaatggctgtgatagacataaggcatgttaacaaggaaaaggctgacggcaaagcccaggcagccagcctcttgggaaaattactgaaactggtactataaatccagtttatgggcttgaaatttcctagtactcatgaatattcaattaaatattgatatgaaccttgacacaagtttggctcaagtgctggtagaaagcaaacagggacattcagacaaactttaattatttttcacttagagatcatacagttctagagtagtgtgagtaattggagttagctctcaccaaaacacagaagaaatatttaatcaatattagtatctttgaatagaatttatcctgggcacttgctagttattatttgtccgggcgtgatggctcacacctgtcatcacagcactttgggaggctgaggcaggtggatcacctgaggtcaggagtgcaagaacagcctgcccaacatggtgaaaccccgtctctactaaaaatacaaaaattagttgggcgtggtgatgcgtgcctgtaatcccagctactcaggaggcagaggcaggggcatctcttgaacccgagaggtggaggttgcagtgggctgagattgcgccactgcgctccagcatgggcaacagagtgagactccatctcaaaagaagaaaaaaaaaagaaagttattatttgagcataatgaaaaagagaacaaaaattagggacaactttcccttccaactttccagaattttcaaccggtacaaaccataaagttttataactgcaagtgtctgaatgcctggcccacagtcactcagcagggctgcagcagagtcatgacttgaacccaggcttcctgaccttttgttccatgttctccttgcatcgtttacatgtcagtgtctgactccgcttaacaaaatagtggaaaaatactttgcacagtatttttgaagccccaaattcaaataaaaggcataaagaagtgaaaaattgtagttattttatgaattctcaagtaaaccactgttgtttgaccagaaattgtttattttcaaaacaataaagattcacctaaaacatattctgtttcatgaaggaaatgtgacaacctattcattacagtcagttaccaatatagagagctgttcccaaatgtttagaattagctggactgtctactgtagacacagaatttattttttaaaaaactctctttccgagagtttcagtgctttcagagcactgccttttgtttctttgcctgacgttggtgttttgccaagtgctggtatttggaggtttgatggacagcattcgaagtgaggcatcagtcttccttaatttgttcaaagcctctttatgcagcagctaatccttcctaattatatttctaggaaggatgttcttaactcagacgggaagaagacatagacattttgacattaggatgcacttcactccaagaaaagaaatttgaaaggaaacactctcccaattcccattccttaccccctgggcacaagcaaccattttcccctgccccatttatgaagctcttttctctccctctccattcctctttcattcctgtggctcctatttatctcctggcttaatgaagctattttgaaggagctaaaaaaaattcagaaaaaaccatttccgtgtagtgaggcaggcatttcacaccttaattgctttaacgtcttgaaaggtgaaaggtgacctgtgagtctaaacagttggaaaatttagtgtgcatatttgaaatgctttacataaagttgaaacacttcacagtctccttgattaatttctttgttgccgtgctgctttgtattaatttaatttagtgacttttatgtgaaagtaaatatgtaagtcagtggcattatgtttattagattattttcctttaatattttaagcagactaaatgcggcttctgtcaaatgagtctttaataaataaattgctgtctgtgaagtcttagtggctttgaatggtcttatgaagtgtgatcttatcaccttatgaagcaattttgtgtttcttagttttttttagtgaggttgaacattttccacatttttataagtccttcatattttttatgtggataactaacatcttcacacccttttctgttacatgtgcttataattttctttaatttctaagagctcttttcatattaaagattgtttttatcaaatatttaagaattctccaagggaaggtacttttatgcaaaaaatattattagtactctggttttttttatgctcaaatttggaagaaacgtcttaaattggattgtaaaaaatccccccttgtccatgaggacaagaatacaatctgttactcattgactgggtaatttatttcagaattctttggtcttctgagaggcttattgacttacacagacataaatcgtaatatactactgaaccatctataactttccaagttctctgtgcatttctaactggttgcgttatctctggttcaccatagtgaagatagaatctcagtcctcctggcccccagaacacagattctcaatagttgattcattcattccatcagcagatatttactgagtgccatccacataccaactactgttctaggtactccaattggagggatcaggctaatgtgtctgcaaaatactgaataacatagcataatacctaataagctgctaaactatgtggtgcatagtataaattctaatggcgagtaaggaagggggagattggcaggggctggaggactggactaaaggaacattgaccagagttggaaggacttggaaaagtgaaggagagtctggcctttaaataaataacaggtggacgatagggtgggaatgattctcctgttggggaattgatctctttgtggggattgaagaatagcaggaaatgagattgagtgggcaggtccaattatggaaagccttgacagtcagacagaggagctctgtgtagggctccgaggaatatgaagatggctctgatagtcactgaagaagtgtcaggctcaccctggaaagccaggtcaggtggggtgctaagagagtgtgagggaaggcctgggaggctggctgctgggcagatgagagagagggaggcctagaggagctggccctgtggagtgtctgtcttgcacagggacttgagaggagagggatctgattccctttaaaacaggaaggattcagactgccagtcaagaaaataattcctttggattcgggttaaggaattatgtgtagtctaatgttgatctctctctctacctatgttaaatggaatgatatgtaatcttatcctctttaggaacaggaaagtaggggatatcattgaaggcttcctgttccttattacactctatccctagactcaaattcatcaacccataatcaaaaccagatttgatttccttctgtgttgatcaaactaacacatcatgctctgtagaataatcaaggtcttttttcctgtttcaaatgttcaagagttttctacctttatctttgttggctttatagctttgccataactactttttgttatctctacccctatcgatatcaacttccgtgtatcttctctgtgtttttcttgctacactaggagtgatccactcacctatattcctcctcctttaggtgacagaagtcctacatcttgattatcctgtattggtgaactggaaaggaaccttgggtaatcacacacagatgtataataaccaacaggttgttaggctctaaatgtcttcctagctggactgcattctcattagttattatttaaaataatataaaataagtaacagtatgacacaaaaattgcatatgtatttgatactattaataaagcagtttttgtttcagacttatattcatttaatttagctattaaggtctaaagttgctaggaaagtttttgtgatttgctttgtgaagtagtgtagtaacatgctgcttgataaaaataatggtaattgcctttcacagaatcagaaatgcttttcatacctagtgaggaaatgctatacttcttttaaaaaacttacatatccatatcagctttatgttcagattaatttaggatgttcataaaaaacaaggatttgatcaagctcagctttatgttcaaataatttaggatgttcatgaaaaacaaggatttgatcaagctccattaggaagtctttgacaagaaaccaaaagaaatgattgggactttcaatttcacatgtatttgttgaatatttactgtgtgccaggcagtgtgctagcagccaaactaaatagtctttagtttcaatgaataattgataactggaatgtttcttccatcatttctagtgtaagtggttttttttttcatttttagtagagagctatattttcataggacaaaacatgtaatactgtcccctctgttgatattaagtcagatattttatctgttcagtcaaagcccagttctggtgttaatgggcctggatttaattaattaaaggattaacttactgtatcattacctgtgtgcaccaggcacccttctgaattgcagacagcatgtaggaagatctaactaaactttaaccttacaagtacaaaccacttctaggtgttctcaggtgtgaacaatcagatgcaagcgggaaagagatcagaaacactgacaataataatgcatgaaataatagctcctgtagagttttagaagaaagggttgagctgactatggtgggggaaaaaagggacttttttttttttttaatgtgtgtgatgttctacagaaacagcaatctgaaagctaactggctgcagctggatggactttcttttgtatggagacgctgcctctagtgtttaggaaaaaatgcacactagaaaatagtgcaacattatggtgccatctgtcttgaaaatgaattattttttattgtctgctttatagtagttcccagacaaaacttgaaaaaacttcaactagctttggtgctattttgcgtatggacagtttcagcaggcagaagcctttaaagttgtatttcaaagcgcctcaggagttatcgatgtgatgtgatgagactgtttgccatataagcctctcaagaggccacagccctaaccccctccccggctccctgggggacaggagagcagatggagtcgtgtttgcatcattcaccgtcctaattgggtttgtgactggctgttagggcatctttctctcagatggcattttcttctttaattcaaagtttcactttctccttagcagcgttctggattgtttttgagggaatgatggcatggatacgcaaatctacagagttagaagaaagagacgagacttgaaggattgttgttctaaaaaaaaaaaaaaggctaaaatgcatttatttctcagacttctttagaataagtgcaaatgaaaaagaatactgaaaacattttcagaacccatgaaaacacttgtcggtattaatataattaaggtatttaagtttaaatgtttaaagctgatctttgaggtgttttagctgggcttctacttgaaattttgtagtgtgaatgtatatcaactatttataaactagctgaagggagttaagctattaatgtttggattttaaaatctataaggatcagaaaatgggttttgtattccatatcatctagaatgatgacaggcctggaagcataggacagagctggcacattttcaaaggaattcttccctggtctggatactataatgagcacaactgcattttggtggatttattatatacagtacacaacatatataaccatttggaagttgggtttgctttctggttagaggtgcactggttatagctgattatgtatagggtttgaaatagcatctggttaaaaatttgaggggctgacatttcctctcagagactggtgaaaatgaataaatacgcaatatggaaatatccatgccaatcaattagtagaagggtttaaataaaaaaaaaaggatgcaatttgaacatttacgattatgccagtgggcagcaggtggcaagctttgcttttcaatgttcttcagttttatttttataccgcagaatgccaaaatttgaagaggggggtttaactccactggaatatgtcatttcttggcagtgcaacctcgaaccaccttctttgctcattgtgcataattgcctttctttggatgccgtagccgacccttggttccccttgttgccgatggataggaattaattcatatgagcaatgttctattctcttgtgattttagcaacacgttgctaatggagaaaataaattagaaacaaatgagtttcttaaagcagtccttgtatgatttataagagattttcttgtgtagttttacttagttctaaatgacacataaattgcttttaatttaaaaaattctaactggctatataccttgatatggagatgagaagtaagcaaaactgcgtagagttccatgaaagtgttttgaaaaattagagaggaaaaacacattttgagaccagaatagaagaccattatcttttcataggctaaactgtgtagtcaggatttgaattttaaatccggaaaagagagcaagcttgaaatgggagtgatggtgaggtggacaccaaattattttatagtctactgtatttcttcatactttctagataaaaaattctttttgggttgttttatgcattgtgagaaattcggaagaatggagaagaatgcaaaagcatatcaaatcactgtaaacatttaatagtctacaaatatttaacacttgctgtgtactcaattttttgtaggccgtttgttagaattgagttcacatggggtataattctacgttcacgacttgacattctcaacctcagttcagcattttttctttttagaaaagagatcgttcataatgattataatttacaacacacatattttaaaggatagtaataaaaaaacccaaactgttgtacccactacgtagctgaagaaataaaaacactgttgtcattatcttagaggctcttacgtggtccttgttaattcctttatccttttttcccagaaaataatttatatcagttatttcctgcttttctttatagtgttaccacatttttaggtatatctggatactgtgctgtttagtttttgacttttaaacaaatgtcatattgtttgtattcttctgagacttgcttttcttgctcaaggtgtttttgacattcttctgtaacagtggctctcaaactggagcatgaatcagaatcgccggtggagggcttgctagataaaatacggcttgttgggccccacctcagagtttccgatttggtgggtctggggaggggtggagaatttgggtggctgacaaactcgcaggtggtgccaatgctgaatgctgctggaggggtctgcactttgagaaccactgattaaagctggggattcttttactttttacagtagcccattatgtcagtatactacaatttatcatttctactgataatgaacactgggttgtttttagtgttttgctgttacaacagggtcatgatgaacgtttttttttttctttttttgagacggagtctcactctgtcacccaggctggagtgcagtggggcaatctcagctcactgcaacctccgcctcctgggttcaagctattctcctgccttagcctcccaagtagctgggattacaggtgtgtgccaccatgtctggctaagttttgtatttttagtagagacggggtttcaccatgttggccagtctggtcttgtactcctgacctcagttgatccacccaccttgtcttcccaaagtgctgggattacaggcgtgagacactgtgcccagcctcgtgatgaacatttttctacaagtcttctgttgcatagtttaaaaagcttttttagcatgcaatagaaaaatatcaaaatgcttccctcatattaagggtaggtgttgtttcatgaaacttttgtttttggaacacacactgctatgtaaaatggctttcttacagtgaactcgtcaaaaaatgcttaaaagcctcttgtccagagtagttacattgatcatgctttctttataaaatgggatccatttctatctcattgctatatttttctagattttcttctaaaagctttttctttcacatttcctgtaatgtacctggaaatgatttttgagtatgtgtgattttttttccatatggctaacttattgtcttagcactatttattgactaattctccccctgtccctctcataaaaaaaattataaaaaactaccatatcatatatgtttcattcaagtttctaaatatgtaagtctgtttctccatcctctatcctactgtgttggtcttttgagtatccttaagtcagtgccatgctactgaaagtgctgcaattgtgtagtaagtcttggaaggtgtaataatcatctgtgtctcttgtgctgggttctggctgatttcttctagtttattaatctgctattctgttatacccactgtcatcttttcaagtgttatttattttttaatctctgaaagttctatttgactcttttcaaatttccttagtgtatgttgtcttattatttagtcatatttttgacctctttctacatattaaatatacattgtgtatcttatagttgcagtcttaataatctacagttgttactggactgatttggcacttttatttttcctctgattctggcttgtttccttgttcattttgtgatttctgattgtgagtattcattggaattttatttctagaattcctgaagatatagtttttattttatttatttttttgagaaaaggcctcactctgtcgctcaggctagagtgccgtggcatgaccatggctcactgcagccttgacctgctgggcttaagcaattctcccacctcagccacccaagtaactggagttacaggtgtgtgccaccatagccagctaatttttaaaattttttggagagatgaggtgtcattatgttgcctaggttggtcttcaactcccgaactcaagcagtccccctgccttggcctcccaaggtgctgggcttacagggcatgagccaccgcacctagccaagatcctgttttaaggaggattcctacagaggagagcacttgtgtctgcttttaacaagtctcctagtggggtactacccattcaggttgcttttaattaaatgttggggttattattgttttgatcactcagatactttttaatttgaatgccaaaccaacataaaggcgaacttgtgggttaggaattctcacctgagatttatgctgttgcttgttttcgtgtttacccaaagcccaaactaagacagatgcgactcctcctgttctctcagcagtgcagtgtttggttttttggtttcccctgcagaaagttttaacacgagggtttctgatctaatcttttaccttatgcagcaccaagctttgtctctgtgccccatgaagcatgttaaaacctgtaatctaggcatccagaaatggcagatgcccctccagggaaaattcctgttctggagccaactcatttccctggattcatgctctctggtcgttcctggcctgtgaagatttctcttactttcttgacatctcagccatattttatattttgtccagcaatcttagttgttttatcctggcaaattttctctggacatcttatcctctgttttgccagaattagagatcctagttaatttattttaaagagttcgagttctgagaagtagaaaatatttggaggctagaccataaagtttcctgtgctgcaaggaacccatagcactgttgaatgactatacgcttgagtctttggaaagactcagatgttcttttccttgtcatttatgacatgagaagtcttaggaaaatgtctttttttttgccagagcctcatctaaccagtggccagtgagcctgggagatgtgtaggatcctctggggctgcttctcgcatctctgcctctgggtgcctgcctctgggcacctgcctgggacatctgcgctcagggctctgcctccagttcccgccctttgtctttttgtccccagcctagttgtgaaatctcatctcctggttcttcattttgctcagtagtttcatttgggcagtctctagctctcacaaacatgtactcgaagagtactgattagtgtgttcagaggttaaattggcctttgtgtgttataatcccactcttctctttgagggtttgatgagagaaaattgaagttctgttcattatcattctaggaagagtaaatggatagtaatttaggggtaggaaaggggcaaatgcatagttgttgcttttactccagtagcatctgacaggagaaaaaaaaaacaccaaaacccataattgttctttcggagagagaaaccccacctgtatatattttttaagctgtaaatactcctgaatgaattttggtagctttggtagctataaggggaaacagtattgtatccatcttgagtgtccttcttacctcttatactacatttatcatctttaattctgctttagactcatcccttgcagtggccacctgtaacttggcagcctgcagggcattgccaaatatatcgagacaccaagtaaaatatcttttgtaaccaaaattaaaatcaactatatttttggctgaccagttctaatcccagacttgtctaaatcattgagaaattatatgttgtgtttgtggggggccataataatataatcatagtcaattaaattaaattgagggagtgaatggaattaaacatttttttttaccctgtatttctttttcaggaatctgagttggaatttgataaccatcagtttattataacagggtcagtactggagtgataatgggttcggaaaggcaggttctgggcaagggaaagctgataatggttgcttacggttgaggttttagatgacgaagcttggttttgtgtgtgatttagattgggactgcaccaaaatgaggaaggagagtaggtgtaaaatctcgggagtgcaggggaggaatcaaggagcagccagaaaagagagatcgaatgggaccggttttggaatctgggagtggttggggaaggctaggtagagtagggcatggaggcccatagagatttcattccttggtatggaagaaaaatgagcaagagttacttgaagggtaagcagtggtttgagatcctgggtcttgattatgggaggcagtaatcagtagttagtgagatcctgaaagcaggagagggctgctcagagagaattcacagggcatccaactgtgagtgtagacccagatgcttggagcagtgggtatgagaaactcaagctcctgagagcgctgtctgccaacacacatgacgattagcagacccttcctggtggttaaggagctcacaggtcagtggaagacatacctgcattctgcgcatatgtgtacatgcatagaataatatttctttgtaataaaggtaatgagaggagctttgcagcaggtgatctgggagttccaagaagagggatgtgccttttcctactccacagaacctaaactcatttcaaagcccttggtaaacacgttcatctactgcctcctcaaccacatatgtcactgctctccaatccacgcctcactgtctcttccctcttcctgctccttttctgctccacactttgtgttcctgcctgtcatatcctcccttgaatggtaatgtcaggtattttgcatgcattacttgtgacaggagacattcagatgattgaactatttactggacagcacaggcatagagcagttggaacagagccggctgcagtgcagggtcacttgcttttctggaggttattcccttagtgcttgtgctgtgtggcggggaggtctgagggaggtttggtgggatgataatgacacctgggagactcaggatagcagctctttaccatttgctatggaagaagtctgacaattttacaatggtcacactgtgctggtacctaccagctgactgtcagactgcctcacaactaccccaccgttaataccttccttttatagatctggaaaattagttttctttagaagagtcaagtaacctgccaaaatgacagctagtaagtgagaattagacttgaacccaagcctgtgtgacctcaaagaatgattaagaggtctctaccaccataccacatagcccaccgagtagagtcttgtgttgctcactgtcttgtctgggtcaggcctctttattatttgtttatttattttttctagctagatggctatctaaagatacagactgtgtcttttctttttctttctttttttttcttttttgagacggagtctcgctgtgtcgcccaggctggagtgcagtggcatgatctcggctcactgcaacctccgccgcctgggttcaagcgattcttctgcctcagcctcccaagtagctgggactacaggtgcccgccaccatgcccagctaatttttgtatttcagtagagatagggtttcaccatattggccaggctgttctcgaactcctgaccttgtgatccacctgcctctgcatcccaaagtgctgggattataggcgtgagccaccgtgcctggcccagactgtgtcttttctgtattcccagtgcctaatctggaatggagcacatgataaatagcattcattcctttatttattctgcaaactcttaatgaacacctgctatgtgtcaacctttgtattagggcataaacagataaataaggcaggatagtcacccttaaataacccacagtttactggaagtctcagtctctccctctgtctctctcttgctcacacacatatataattataatgataaagatatgtaccagatgcatctagttgcatttatttgaagaggtgaggtagctgagagtgataatggtatgtgtatcctttacaggatactaccaaactgtttgctatagtgactataccattttgtttccttaccagccgtgtatgaaagttttagttgctccacatcctcatcagcacttagtattgtcagttttttctttgtgccattctaataggtgtatagtcgtagctcattgggcttttaatgtgaatttttctagtgatcaatcttttcacatgcttttgagtatctttgcatatgcgtacttgccatccatagatcttctttggtgaagtggacctttagcccatgtttttaattgtgctatttattttcttacttgttgatatgactaacttttaacagaactttcttttcaggaatttgttaattaggtttcaagtacatttgatataaacagtttataaaatgcttcaaacaacatgctctaggagtggttgccagggaaaactaaaatggactttgatcccgactggggcaagagtgatgaagatgaggttttttctgtgcttttcctcagtgtgattttgaaacaggaggacagagcaaagggagagaaataggagccaaaaagctcaggagggactttgatcttcagtctaaaagggaaaacagggattcttttggttgccagtggaagctggaaggattagacatgccaaagggatggtttactctgatgagaaaagcaactggacaacaacagcaaaaaacactgcaaggcccaattcccatccttttcagcccaaaattggaggaggccagaccaatgggaggtttctgtcactgaagatgaggtcacattattttgtcatccagactgatctaagcagatacttttaggaaaggtaagaatgccttgatctatgcctagatatttacaataggcggcaatttttgacatttatgttgttacgctaataaattggtattttttaaaaaaatatttggctgattatgtaaaaactgttttgggaaggagtctatataaagctaaaacactccctgcctcctgtctctgacttgcaggccttgtgccattgggaaaaaaaacagccaggcctatggtttaaggccttctgggcatctgactacctgcaccccagcactgtctacacagtttgtgtacatgagtatttttatggggaatggttacagagctcttctcagcctcagggaggcctataatccccaaacggctgtgaaccgctgttctagagggtgagattggcaaattcactacagtgatggcacagcaaatgttccatgtctcagcttgaaaacattatggcaggaagtcctgcgtcagatgaaattaggtatacattaaagtagtgggattgagcccagagccttttcaactcttgtatataacagctttgattctcttcctgacataatgagtctataataattggtcaagaattttttttttttacttattaaaagaaccacctcagataatatgttcctgattatgtaactataattataaaaaatcgtatattattgtgtttaataaaaaccaaaatttataggctgggtctaatatatgcatcttgccatgctatattttggagaagacagtagagtgtaagctatgatctttttgagaagacaggagccacgtgcgcagaccatgaagtccagaggagggtggtggagggagagagtgtttcaggctagaatggccggttttagctgtggatggaaaggtagtatttgatggaccaagaggagaggaaatctgtaagcaattgctcagaggaggaggaagtagaagaaggaatttggctgagcatgttttacatgaagtattcctattaggggagtagccataagtgagggtgagaatgcaacacaggtgaaataacattttgggaaatttatctggtggtggaggaccaggcggtggaggaccaggcatagagaagggaagagactaaaatgagagacggtgtttaaatagttaatgcaatcacatagtcatgaagagggagggcttaagcaaaaaggaagggatagctaggagagcccttgtagagggtggagaaggcaggctgtgccctattcaaggaaagggaggcagtgggtcaggtgattccactgactcttagactctatattcacagtatagatttctgttcgttttttttttttcttcaaaagcctttaaaaatgttcaaaaggaaagcatttagaccttttatgaaatagagttgttaaaggaaaaagtatttttttttttaattatactttaagttctgggatacatgtgcagaacatggcaggtatacacatgccatggtggtttgctgcacccatcaacctgtcatctacattaggtatttctcctaatgctatccctcccctagccccctacccactgacaggccctggtgtgtgatgttcccctccctgtgtccatgtgttctcattgttcaactcccacttacgagtgagaacatgtggtgtttggttttctgttcctgtgttagtttgctgagaatgatggtttctagcttcagccatgtccctgcaaaggacatgaactcatccttttttatggctgcatagcattccatggtgtatatgtgccacattttctttatccagtctatcattgatgagcatttgggttgattccaagtccttgctattgtgaacagtgctgcaataaacacgtgtgcatgtgtctttatagtagaatgatttataatcctttgggtatatacccagtaatgggattgctgggtcaaatggtaattctggttctagatccttgaggaattgtcacactgtcttccacaatcgtttaactaatttacattcccaccaacagtgtaaaaatgttcctatttctccacatcctctccagcacctgttgtttcctgagtttttaatgattgccattctaactgggatgagatggtatctcattgtggttttgatttgcatttctctaatggccagtgacgatgagctttttttcatgtgtgttggccgcatgaatgtcttctttagagaagtgtctgttcatatcctttgcccactttttgatggggttgtttggtttttttttcatgtaaatttgtttaagttctttgtaaattctggatattagcccttgtcagatggatagactgcaaaatttttctcccattctgtaggttgcctgttcactctgatgatagtttcttttgctgtgcagaagctctttagtttaattagatcccatttgtcaattttggcttctgttgccattgcttttggtgttttagtcacgaagtctttgcccatgcctatgtcctgaatggtattgcctaggttttcttctagggtttttatggttttaggtcttacatttaagtctttagtccatcttgagttaatttttgtataaggtgtaaggaaggggtccagtttccgttttctgcgtatggctagccagttttcccaacactatttattaaatagggaatcctttccccatgcttgtttttgtcagatttgtcaaagatcagatggttgtagatatgtggcattatttctgagacttttgttctgtgccattggtctgtatgtctgttttggtaccagtacaatgctgttttggttactgtagccttgtagtatagtttgaagtcaggtagcatgatgcctccagctttgttctttttgcttaggattgtcttgactatgtgggctcttttttgtttccatatgaaatttaaagtagttttttctaattctgtgaagaaagtcaatggtagcttgatggggatagcattgaatctataaattactttgggcagtatggccattttcacaatactgattcttcctatccatgagcatggaatgttttttccatttgtttgtgtcctgtcttatttccttgagcagcggtttgtagttctccttgaagaggtccttcacatcccttgtaagttgtattcctaggtattttattccctttgtagcaattttgaatgggagttcactcatgatttggctctctgtctgtctattattggtgtatagggatgcttgtgatttttgcacatcgaatttgtttcctgagaatttgctgaagttgcttatcagcttaaggagattttgggctgagacgatggggttttctaaatatacaatcatgtcatctgcaaatggagacaatttgacttctctcgtcctatttgaataccctttctttctttctcttgcctgatttcactggccagaacttccaatactatgttgaataggagtgatgagagagggcattcttgtcttgtgatggttttcaaagggaatgcttccagtttttgcccattcagtatgatattggctgtgggtttgtcataaatagctcttattatttggagatattttccatcaatacttagtttattgagagtttttagcatgaagaggtgttgaattttgtggaaggccttttctgcatctattgagataattatgtggtttttgtcgttggttctgtttatgtgatggattacgtttattgatttgcatatgttgaaccagccttgcctcccggggatgaagccgacttgatcgtggtggataagctttttgatgtgctgctggattcagtttgccagtattttatggaggatttttgcattgatgttcatcagggatattggcctgaaattttcttttttgtgtgtctctggcaggttttggtatcaggatgatgctggcctcataaaatgagttagggaggtgtccctctttttctactgtttggaatagtttcagaaggaatggtaccagctcctttttgtacctctggtagaatttagctgtgaatctgtctggtcctggacgttttttggttggtaggctattaattaccgcctcaatttcagaacttgttattggtctattcagggatttgacttcttcctggtttagtcttgggagggtgtatgtgtccaggaattcatatttcttctagattttctagtttatttgcatagaggaagtcaaatagtattctctgatggtagtttgtatttctttgggatcattggtgatatcccttttatcattttttattgtgtctatttgattcttctctcttttcttctttattagtgtggttagttgtatatctattttattaatcttttccaaaaaccagctcctggattcattgattttttgaagggttttttgtgtctctatctccttcagttctgctctgatcttaagttatttcttgtcttctgctagcttttgaatgtgtttgctcttgcttctccaattcttttaattgtgatgttagggtgttgattttagatctttcctgctttctcttgtgggcatttagtgctataaatttccctgtacacactgctttaaatgtgtcccagagattctggtacgttgtgtctttgttctcattggtttcaaagaacttacttctttctgccttaatttcgttatgtacccggtagtcaattcaggagcaggttgttcagtttccatgtagttgtgcggttttgagtgagtttcttaatcctgagttctaatttgattgcactgtggcctgagagactgtttgttatgatttctgttcttttgcatttgctgaggagtgttttacctccagttatgtggtcagttttagaataagtgcaatgtggtgctgagaagattgtatattctgttgatttggggtggagagttctgtagacgtctgttagatctgcttggtccagagctgagttcaagtcctgaatgtccttgttaattttctgtctcgttgatctgactaatattgacagtggggtgttaaagtctcccactattattgtgtgagagtctaagtctcttttaggtctctaagaacttgctttatgaatctgggtgctcctgtattgggtgcatatatatttaggttagttagctcttcttgttgcattgatccctttaccactatgtaatgcccttctttgtcttttttgatctttgttggcttaaagtctgttttatcagagactaggattgcaacctctgcttttttttttgttttctatttgcttggtaaatattcctccatccctttattttgagcctatgtgtgtctttgcatgtgagatggaaaaagtttttttttaaaccacaagggatgaaccttgcataaattaagagccgtagcattgttgcaggcattgtgttgttacctgacaccattttggagtggttgattcagagatctgttgtaaggataagaataaaacagacattcagaagcagaggaggatttcaggcagtgactggtcttcatggaaagagatgaagagcgcttatttagtacaaggagctgtgtgactgtaactgaacccattccttagagtactggctgagtgctagcaggaaagacatccagaaccttcagaggattctgggagtgcagtaaaaatccttcaaatttctcttggagaggaataatcctgttgtcttctaatagtagagaaaaacaggtgactggattagaagtggttattaaagttaaatgttgaccaggcacattgatgcctaatagcattgctttccacagcaaagtactcacactcagaggagcatgagacattccactaaggctgcaagaagaaaaaaaagaatagatgttgtacttatgtttacttctgtctaaaaatagaaatcaacctgtataatagtcgacatccagactgaccctggtccttcctgtggtccagatgccagaagatctgcagccttgctcacagctggacatttcgagggaagcgtgtgtgctccgttgacaggggctgactcttcagagaggattatctctacctgattaggtagacttacagatgataggatattaaatagccaaaaaatcttacagtatttaataatgagattgagaatgatgctgataatctctaataccacagatgctaatgagcagatatcttaaaggaactgttgaatgtgagttaagaatgttttttataaaagacaaacattttgaaattgctggccttctgcatgatatttagctatgagtggtcttgttgccctgcagataatttaaaagttaatactcataatctgtcctttcaaagtagaggtgatacattaacaatgaataagaaagtaacctttaaaaaaatctggtgatctggtgctacacagagagcacttgtaaaataaatgtacagaaatagttccattgtgacatgattttcattcctaaaaacaataggtgtgcgttacatgttaactcatatttgcatacttaaaaatattggaaacaaactaaaatcttccggagagtttaaaacccaataaaaatttgtcaaaatgtaacattttccaataagtttgtaagaccaatgaaatgacattggggaaaatggaaagttactaattttagccaaaaagcttttgagtagttagtgtatgagattgaaatatgagtgttatgactttgtaagtacatttcttccatttgcatcaatgtgtctttttcaaatatctcttttgagctaggccggacactaaaactaaatattaacatatactggacttaaaatgagacctctgaattgccatatcagtaagtgttaaaccaagattaaaaaaatgaaacccattcaatcatgccgcagtcactaagaaacatttttagtgataaaaagggttaataaaggaaaactacttaaaaaaatttaaatttcatttttatctcagccttccaaatttctatttttgagtatgttttgtgatgtacatattgtatagacagtgtagttttagaatatatactcaatcagaagtgttaacagcaaagctagaaggaactttgagattctctaatcctggtatagaacatgcatataatttgtaaataatgtatattttggaggttaggcttttttttttctttttttttgttttgaatgagacagagtcttgctttgttgctcagcctggagtgcagtggtgtgatcacagctcactgcagcctgggactcctgggctcaagcgatcctcccacctcatcctcctgagtagctggaactataggtgtgggccactgcgcccagccaatttttacaaattttgtgtagagccagcatcttgctttgttgcctaggttggtctcgaactcccggcctcaagcgatcttcctgccttggcctcccaaagtgctgggattataggcgtaagcatttttttttttttcttttcttttcttttttttttttttccctagaacggtgtatgatccaaataggtggccattggtctacagacaaaaacctgctgagaaccttttaataaaatcatcctggtttctgaggggttgaggaatgttctgtttccaagcccaggactcttagaaactatctgtagcacattcaggtgacaatatgggttgagatgtatctataggacctaacaggtagaggaacttctattctttgagtagatgtcaaaaggtaaaaagtaggatcggaatctttctccatgtggagaaatttcagattccaagaaagagtacacacaactcacctgtacattagacaccaaaaaaatgctcaaattaatgaactattatggagtatttaaaaacatagagaactctgctttaaaaaaaataggagaggatccttaagtttaaagcaaagtagtacttcaaaacttcattaattttgaagtattactctgctacagatagtgtctaagagtcctgggcctggaaacagaacatttgggttcaggtttcctctttattccattctggctttatgatcctggcaaattattgaaactctcttttttttttttttgagaccgagtctcgctctgttgcccaggctggagtgtaatggcatgatctcggctgactgcaacctccgcctcccgggttcaagcgattctcctgcctcagcctcctgagtagctgggattacaggcgggcatcaccatgcccagctaatttttatatttttagtagagacagggtttcgccagactggtctcgaactcctgaccttgtgatccacccaccttggcctcccaaagtgctgggattataggtgtgagccaccgcgcccggcctgaaactcttgaggtttcctcagccagaaaatgagcatggtaattcttcacaccatgattgtgaagctccatgagttggggcagaaggaagtgctgtaaaaactatagtccccgcccgttgtggtggcttgtgcctgtgatcacagcgctttaggaggctgaaggaagagaatcatttgaggccaagagttcgagaccagcctggtcaatgtaggcagacccagtctctacaaaaaatacaaaaattggctgggtgtggtggtgtgtgcctgttgttctagctacttgggagactgaagtggggggattacttgagtccaggagtttgaggctgcatgagctgtgattatgccactttaactccaacctgggtttcagagcaagatcgtgtttctaaaataagaaaaaaaacacacacacacacaaaactgtagtcctctgcaatattactgagtgaggattgcccgagacttgagaggcagttaggcagcccccttcattctgactgtggtggtcctctcctaattgagactgagaattctctagatgtgcctgttaaatatttgcatggccccggagtgccattcagagctggattttgtttctgatggctcagttgcccttgaggctgctcttgggttcccagtgcttgtgttgccaagttgtgtgaagtgtgcagagctgctctgggtttgcagagctggcttcatgtgttgtggagagggccctgagatgttggtgactcattcaaagccactttatgtctgcttctacatcttgctcaatctgctaggcttactaccatctaagtcctagaaggcctatcaactctccccaggaaatgtagaacccaaagacataggcacatactttcatttcctttttaaatgaatacagtctctttaaaagttttatttgaataccgatccatggtttgcacaagccatttgaattttaaacagatgtgtgtgcaaagctgggagtcagcattgcatgtctcagtcaagttttatagtcattgacttttagggttacagcctggtctcatagctgtgccttgggtggaaaggctggtaaggacttcgatgtactttcctgtccagagttttgagactttagccaggactagggcagctttctgggtgtccagtggagggccacgtcattcgaccgttgctatgggaaaaacccatgagctctctcattccaaagtttaccgattgccaaatacttgggtgtgtggtatttggaaaaaatatttagtgatgcagtgattctttgaagaggtgtcctctaatgtttactttttaaaatggtaaaccaattttaatattgttcatacctagctaagactgaattagattatttaaacatatttaaacatcatctctgtaagtgaatgggaaaataggaaccagaccaaacccctattattgaacgctaagagaaatggatttttttaaaaaccgaaataattaaaatctagtgttacatgtgagtctagggactggatttactatttggcaactacatattttgttggcaataaacttattgtctaaaagaaaatgcgtagagccaagatagaggcccaagtaaagaagaaagtgtgatcctaagggaaattggtttattgaggagaatgtatcttcatatactatttgtaagttttctgtatggaggatttctcccttttcacccttgtatttatttaatcgtttagttgtagtaccttagcctcatttgttttattcttcaggttatattattattttcttgctcaaattgttccatctttagtcattgtaagctctttcaggttgactcccggatcaaaatatagtttttaaaacaggcttttttttttttgagatggagtctcactcttgtcacccaggctggagtgcagtggtgtgatctcggctcactgcaacctctgccttctgggtgtaagcgattctcttgcgtcagcctcccgagtaggattacaggtgcataccaccacacccagctaatttttgcatttttaatcgagacggggtttcactatgttggtcaggctcgtcttgaactcctgacctcaagtgatctgcctgcctcagcctcccaaagtgctggaattacaggcgtaagccaccgcgcctggcctaaaagatttcagtttttaagggcagttttaggttcacagcaaaattggagaggaaggtccagacttcctatataccctggcccctgcaacccctctccccgtcccataggcatagcttctcccattgtcaacatctaccagagtggtacatttgctacaaatgatgaacctacattgacacatcattattccccaaagtcctagggttcacccttggttttgtacattctgtgggtttggacaaatgtataatgacatctatctatcattatagtatcataatgagtattattgaaaggtgacagcgtgctggcagccctcgcagccctcgctcgctctcggtgcttcctcggcctcggcgcccagtctactagatgagtatttgccgtctgggtttccttgattagaggggcctggctattttgctgtatccggggatccatagtcggcaaaagccagtaattccaaggaacccccacaaactgttttaatgtcttagggcaaggataagccagtataggctttattcattccttgctgagggccctggtccctctggctaagattaggcctagatatttgacctgctgtaggcaaagcagggccttcgacctagacaccttgtacccttgattagctagaaagttcaagagatctagagtagcctgctggcacgaggcttccaaactggtagccaaaattaaatcatccacatattgaaggaccagagtgcctggacttgagaagtggcctagatcttgggccagtgcctgaccaaataacaggtgagggctatccctaaacccctggggcaagaccatccacataagttgggacgtgtgatctgtgggatcctcaaaggcaaagaggaactgggagtcagagtgcaggacaatacagaagaaggatcctcgaagtccagaactgtgaaccattctgtttcctctggtatttgagagaccagggtataggggttgggtacaactggatatagaggaattactgcctcactgatgagtctaagatcttgcactagtctccactgaccgttcggtttttgtactcctagaattggggtgttgcagggactgctgcatttccttactcagccttgagctttcaaatgtttaataatattctgtaatcctttatgagcttcaggccttaagggatattgcctttgataaggaaaaatggtgggatcttttaacctgatttggactgggcgggcattttttagccttccaaattgtccttccaatgcccagacttcagggttgattccctcctcaagtaggggacaacaaatgggtaacttgttccccatattcatgtagataatagctccagccttggctaatatatccctccctaataaggtgtgggacttacaggcataacaagaaaggcatgtgaaaagagcaaagtctcccaattaaaactgaggaggtgtgagaaacacctggttacaggctgtcccaggattccttgggtggtaacggaccttgaggacagtcgtccaggacaggagattaacactgagaaggccgcaccagtgtccaggaggaagtcaatttcctggccctcagtagttaaatgtacccggggctcagtgagggtgatgacatgagccggtgtttgccccaggcaccctcagtcctgttgttggatcatctggttgggggcttctgacccagggaaccttcatcctctggagcagtgcaccttccagtgattgcctcggcatagtggacatggacgagggggcagctttttctcactggacagtcttttttaaggtgtcctagtaaaccacactgataacaagccccaccagatgattggcctgctccattttctgtcctctctgaaccaccaaggtttgtttgtctgagggccatgactaaggctgcagcctttctctgatctcgcttttccttttgggcctgttcctcttggtccttattatagaacaccgaggttgcaaggtttaacgatgcctctagattttgttcagggcccagggcttgcctttggagctttctcctgatatctgtggctgattgggtattaaacttatcttttagaatcaattgaccctcgagtgattcgggtgacaggggagtatgttttcttaaggcctcccatagccactcgaggaaggcagaagaattttcttcctttccctgagttatggtggacatcattgaataattcatgggctttttttctaattctccttagtccttctagaacacaggtcaacagatgtttacaactccagtccccatgatctgagtcaaggtcccagtggggatccatactggggatagcttgctgaccagtagggaatttgtccctttctttggctgtcattctatcatttacttgactaagataccaggtgtctccaaactcttgggctgcagctaaagccgcattcttttcgttaaaggccagggtttgatctaacagtagcatgacatctctccaagtgaggtcaaaggtttgccctagaccctgtaggacatctatgtacctatcaggatcatctgaaaacttccccaggtctgccttcatctgctttaaatcagagcaggagaaggggacatgtacctgggtagggccaaattcccctccccctacagcttgaaggggacataacccatagcccgtgggtttttgtggtcctttggagatttctttgcttatttccttctgggcaggggagatgagaggatgattatcattaataggaaggggagctatagggaggctaggatatgggggtaagctgagaggtcctcctgtgggatgtaacttgtaagctttgcatagttgtgtattctccctcaatgaaaagaaagcttggacataaggtatttcactccatttgccttccctcttacagaaaaagtcaagctgcaggatgatagtattgtaatttgtacttccctcaggtggccgtttttccccatcagagagagaatattggggccaagccgtagcgcagaaaaaaatgagccgcctctttttcagggtttgtgggtcgaattggtcccaatagcttaggatgcatttcaagggtgagcctgtgatgcctgagtgtttcccatctgaaagacaaaaccgcctgcagttttgttttgttttgtttgcatttatttgcttttggctttgtggctttcggttttctttggtaacagaatggcctggatgttaggcaaaatgccgccctgggcgatggtgactttgcccagcagcttgtttagttccctgttgttgcaaattgccagctggaggtgatgagggatgatgcgcgtcttcttcttgtcccttcgtggttgcaaaaatgtgtccagatttggcgggttcttggtctcactgacttcaagagtgaagccgcggaccctcgcagtgagtgttatagttcttaaaggtggcgtgtccggagtttgttccttctgatgttcagatgtgtttggagtttcttccttctgggtttgtggtctcgctggctcaggagtgaagatgcagaccttcgtggtgagtgttacagctcataaaggcagtgtggacccaaacagtgagcagcagcaagatttattgcaaagagcaaaagaacaaagcttccacagtgtggaaggggacccggacgggttgccactgctggctcaggcagcctccttttattctcttatccggccccacccacatcctgccgattggtccattttacagagagccagttggtctgttttacagagagccgattggtccgttttgacagggtgctgattggtgcgtttacaatccctgagctagacacaaaagttctccacgtccccactagattagctagatacagagtgtcgattggtatatttacaaaccatgagctagacacagagtgctgattggtgcatttacaaaccttgaactagagacagagtgctgattggtgtattcacaatcccttagctagacataatgatccaagtccccaccagattagctagatacagagtgccgattggtgcatccacaaatcctgagctagagacagggtgctaattggtgtgtttacaaaccttgagctagatacagagtgctcattggtgtatttacaatcccttactagacataaaggttctccaagtccccactagactcaggagcccagctggcttcacccagtgggtctcccactggggccgcaggtcgagctgcctgccagtcccgcgccatgcgcctgcactcctcagcccttgggcagtcgatgggactgggcgccgtggagcagggggcagctctcatcggggaggctcaggccgcacaggagcccacggtggggtgggggagactcaggcatggtgggctgcaggtaccgagccctgccccacagggaggcagctaaggcctggcgagaaatagagcacagagctggtgggccagcactgctgggggacctggcgcaccctctgcagctgctggcccaggtgctaagcccctcactgcccggggccggcacggctggccggcagctctgagtgcggggccgccaagcccacgctcaccgggaactctagctggcctgcaagcaccacgtgcagccccagttcccgcccatgcctctccctccacacctccccgcaagccgagggaggcggctccggcctcggccagcccagagaatggctcccatggtgcagcggcgggctgaagggctcctcaagcacggccagaatgggcgccaaggccgaggagacgccaagagcgagcgagggctgcgagggctgccagcacgctgtcacctctcaatatcactgtcttaaaaatcctctgtgctctacctcatcataaaagtaagaaacctaggagtgtttctctctttggtttccaattactttggcctgggataaactgggacttctcaattcattgcgggccatttaacagttaatgagaagcatttcatggtctttctaaaactcttgtagactaataatagctatgatgaagtatatagaaattcattaatatttataaaagtaataaacattgagtaatagaattatgttagcattaaaattcaattattaattacattattatttcaactaattttgcaaaagaccattgactataggttcttagaggctaaaagaaaattagaagtctaccaccccacctcctttgttttacagatgagaagctaaagcttccaatgtttaagtgatttgcctaatcgaagccaggaccaaaactcatctaataacgtctaaacgtagtaccttccactgaatcaaagagttgggtcttcctgttttccctttttctccccccttcttttcaagaattaatattctgaagtattttccagatatggaatcaccaatttataatgataaatatgcaagaagatcaagataaattttgtgtattatcttacatttgtgttttaaattgatagctgctatcaatggcatgttaaaaaatactttagtgaatttcatattttgatacagctttcagcacagatcagcaatttctctcaagttttttgattatacgtttgattccagaaattctgtttcactggtactaattcaatgtgtttactcttcttttgagaatggtaccttactataaatgtcgcaggagaaaaaacattgccatttaagctacagaagtgctgaatatgacctgcacgtgttgaaatggcagtgctgcgggagaggttggaaaatgtgtgatgctgtcttataattttagctcgggtttatgcaaatgtgggcatttatcttgttattttcacagccatacacatttactgccgcttgaagttatccttacaagtgatcttcattaaattaagtttgtcttacaggagcagaaggaaaaggatgatgtgaatttcacctttaaaaggcagcactaggcaatgcaacatttaagaagtgttttttgcctgtgcccataaaaagctataccactttgttgatggatttgctattttgtgtcctattaagtataaaatgtgaccatatattttggattccaaggtcttttctggtttgttgaacacattagtgcttatgatgatgatttaaattagttttaatgtacttgggtagtcaagcgtacagtgctttgaagccactaagggagaaaaagaagagatatttcagccttccccagtaatgagacccataaatcaaaagaacgaacatggaaacttcaagcaagcctagggatctaatttcaaacaccttaaaagagactccttttttggtttaggcttgccatgtccgtggtgcccagtggaagggctgagctgaaaaatttggataaaaaacagagaacctctataggattaaaacaatggagccagacgctctcagtgttagcctttggatttgagaggcttgtgtttaagaagtctgggcctgaagaggtggaaatacagggggtcagattcagttacagatacatacatgttcaaataccaaatacatgtcatttaagggaaccataagatgactttgcaagagggagacttttttccatgaaatagttatagtagacttttcaaactaactctgaagtgaaattttgagcataaaagcttttcagctgacaaagagaaatggcatgaatgtctgagaaaaaaaccagacacatccctaaaacaacagagaaatgccttctagactttagatacatctatggcaaataggaagacaagctatttctagacctctggcaagaagactggccttttactcagttcttaaagaaaatagctaagagaagtttggaataagaaatccaagttcttctacatgttgttggttcgggcaatgtcaaagatttttttcatagcttgtctcttggaggctgaccttggactgtgcacatggacctatttttaaactgtagactccatttcactcccacatattttacccttctactgttcaagtgctaaaaccagggattatttaagttagcttactctgttgcaggctgggatgagagtttaggattccaaaattgtgttagaagtgggttgagaggaaataaatgtggagaggctaaatgacagttgtgttatggatccttttccttttaatttccccctatttttaaaaaactcactggagtcctagaatacacacagataattgacgtatctctaggggtatttgcattcaaggtaagtttcttttgattttagtaacatgtggcttttgattattatggaggacaatttaagcccaaagtattattttgccatttaggtttgtatcttaatttgggctgtgctgaaatcatcttggggggtgtgtgtgtatgtatgtgtgtgtgtgtttgggggggatgtgtgtgtatgatatatgtgggtaggtgagatatggagggaggcagggagggaacttttaataccgttcgttgtactgaattttaaattcagatctgtgtgtgtgtgtgtgtgtgtgtgtgtgtaaagaaatgcatttgtcatggctaactgtggtctttaatagcaaagtgaccagagcatgaattattttcttattcaaagaaaaatgaggggatcagaagggccactggttttcaaacaaaaaatagtacaaggtttatgtttttaaaaaactcatgttatagtgattgaaattttcttgtttggcagccttttcaaaaattaaaaattatattactttttttttctgaaatagctcttgcaaacaattatatgaatcaaaactgaaaactaattgtaaccatgtatttgcttatatcagatcatagaccaataacaaggatgttttgcctggtactgaattgtagaaactggagttggtaggacacattcctttaactttgagggatgattatggataaggcaattgaagtatttatggaagataattcagtctatatttaggaaagacttcttttttctaaccaaatatggtgggttttaaaaatcttacatattacaagatggatggatgatactggtccatccattaatacaccctattttcttaatgcctttcagactaagatgcacacatcatgagtatatgtttacctataaacactttgtcatgcatgtcattaactagaggtcagtatttgcttatagtgttatttttaaggtaaaatttacagtgtactgaaatgtacaaatcttacatgcaccctttgaattttgagaaatgtgtacttatgtaatccaaaactctatcaaggtagaggacttggccagtatctaagttatctcatcagttttctcagtcctaccccagagacaaccactcttctgatttttttcaccatacttttcactattctagaaacttcatgtgagattatacaatgtgtacccttttgtagaaggctttttacttaccatactatttgtggaatgtgttaatactgtcgcgtgaataagcagttcattcctttttattgttaggtagtattccattgtataaatatatggcaatttgtttgtccagtcatctgttgatgaacacctgggttgtttctagtttggggctattataaataaagctgccatgatcattcttgtgagttttcctgtggacatatgctttcaattctgttgggtaagtacctaggagtagaatttctgtgtataaggtaggtatgtggttagctttataagaaactctcagatgttttttccaaagcggtttatcattttatctttctattaggagtggatgaaagttctggttgcaccacatctgggcttacagtatagaattgtcagtcttcttcatgttaatcattcttctgagtgtatagtggtatctcattatgtttttaatttgcatttccctgatgactaatgatatcgaatagcttttaatgtacatattaaccatctgtatattcccctttgtgaaatgtctattgaatatattgctcatttattaatcagcttttttttcttaatgagttggaattttttattagtatatatcctggatatcaatcttttatctctctgtctcatacacacacacacacacagcatttttttcctcttactgtgttagttttcttaacagtgtcttttggtgagcagtttttaattttgttgaggtctgattttgtatgattattgatttctgtgtgtcgctcaataaatctttgcctactctcaaattataaagatattttcctatgatttcttctagagctttgttgttttagcttctgtgtttaggtctaggattaactttgagttcacttgagtgtagtgtaaggtgagaatccaggatgcttcattttttttctttatactgatatctagttgttcaggatcatttgttgaaaagagtttcttttctccgttggaatgctttggcaccttttatcaaaaaatcagttgaccatatatatgtgagtctatttgggagtttccagctattctgttgatctgttgttgatccttatgctagtacagtaatcgcctctttatccatgagaggatatgttccaagacccccaatggatgcctgaaactgtggatagtacaaaaccctctatgctatgattttcgtatctgataaccaagatagctactaagtgacgaatgtgtgggtagtatgtgcagtgtggatatgctggaagaaggtgtgagtcatgtcccaggtgggacacagcaggacagatttcacactactcagaatttaaatcatgaattctttacttctggaatttaaaacttatgaattgtttaattctggaattttaaacttctgaattgtttatgtccatttaatgttatgagactgaaaccatgggtaactgaaacagcagaaagcaaaccacagataaggggggactcctgtcccacactgtcttgagtactgtagcttcaaaagtaagtcttcaaatcaagttgtgtaagccctcaattttgttctgcattttcaaaaccactttttgacatttgtaggctcttcatattgctgttcgaattatagaattagtttgtcagtttctttttttttttaagtctgatgtgattacaatttgcattgtcttgaatctggaacacctggtgaaaactattttcataataatacttagacattatttgctttcacactcattgtctcaggagtacagtggagttttccagagaatacataatgtgtgatcttgcagcagattgaatgcagaagcagataggcaatcaggctctcttcttttatggtaaacattaatggtatttgcaaaagtgtaaaacaatgcaaagcttaatacattttattttaggaaaaagaaaaattattttaacatttaatgggcttgttaattttaaatgaattaatattttaacattttttaattttaaattccttctctggtaaattttgatagctataaactacataaatattaaaagttttttgggatcctcagttgtttttgagagtttcaaggagtcctgagaatgaagggtttgaaaactgctgccatagctcaattttgggacaattgatgccttaacaatatttattttttcaatccatgaatatggtatatctctacatttatatatgttttatagttttcagtatagagatttctgaagatgttttgttaaatatatttctaagtattgtatattcttttttttttttctttttgagatggagtctcgctctgtcgctcaggctagagtgcaatggcatgaccttggctcactgcaacctctgcctcccaggttcaagtgactctcctgcctcagcctcctgagtagctgagactacaggcacccgccaccatgcctggctaatttttgtaattttagttgagacggggtttcaccatgttgggccaggctggtctcaaactcctgacctcatgatttacccgccttggcctcccaaagtgctaggattacaggcgtgagccactgcacccagcctctaagtattgtatattgtttacacttacataaatgtaatataactttaaattgagttttctgctaatatatagaaatacatttaatttatatttagtgaccttgcagcctccaaaatttcaaaattcacacattagtctggtaacctcaaactcatattgtcaagaactgtgaaaggtttgagattttatcttgcttgcaggctaaaaagttagcctcccacagtttcatggatgctgacagaagacaggagaatcctgggtaagagataaagaactttattactcatggcatagcaggcagcatgagcttcatgttcagattgggtctccacactccctaagcttcatggggtaatgcagagtagcccaggtcgatgttactcgtgtagtaggtttgtgtcgcagttgaggaaccctgagcttaggaaataccattctttaaaaggggctgctagccaactttgcctaatctttgtgccagatggagatgttattttcatttccctggatagcaaacaaatctttcctttgccacagaaggagatactatctgttttccaagactgtgtactatataaacattcttgaaaagacaggccagaagaaaagctgataaagatatgcagaaacacagaaggcacatgggtaattttttcccaacttgtattgttgggattttcttcttagtcatgtcatgtcaaatacagttagtattgtgtctttccagtatttatgcttctccccttttgctatattttactagccaggactgctagtgtaatgtagaacaggagtggtgacagtggtcatctttgccttttgttctaggttttagggtgaaagtatgttattttaccaatcagtataatacattaacaaaataatcattgtagaaacggggtctaaaatgaggaaattatcttatattactcatttgctgagtgtttccttttatcatgaaggcttgttgtatttgccagatgcattttctgtatgtagtgtgatcatcaataaaaatacgattattttttattcctttattctgtcagtatggttagttaaatcaattaagttttaaatgttaaaccaaccttgcattactaggataaattccacttgaggtgaggcatggtggttatacctgtaatcccagctttggaaggctgaggcaggaagatcacttgaggccattagtttgagaccatcctgggtaacacaatgagactccatctctacaaaaaataaaaatattagctgggtgtggtggtgcacgcctgtagcccaagctactcaggaggcagatgtcggaggattacttgagctcaggagtttgaggttacagtgatgatcatgtcactgctctacatcctgggtgacagagtaagaccttgtcaccctgtttctctacaggaaaaaaaaaaatcccactttgtcagggtgtattagcctttttctatattatgaattcgatttgtggaccctttttaaagaatttttccatatatgttgatgaggaatattggtctgtgagggtttggtatcatggttatgatggcctccaaaaacaggttgggaggtgtttcttcttcctgtatactttgaagagtttttataagatgggttttctatctttcttaaatatttgttagaattaactggtgaacatatggtcttggtcttttatttatgagaaagtttttgaaaaaattcacttcgctagatataggattatttatattttcactttcactctgtgtcgttctttttatcggtctgacagatgaaaataacctgttttaaataacagtgaggttaaatagtagtagtttatggctgtttgcatttttttcctcctattttccggccagttttctattagatcatgtatctttttcttgttgaactctttatataatactatgaactttctgatatctgtctatataccaacctataatcaatattttccctatttttcttttattctgtttatatgtatttgctatgcagaagattttaaattttatgtagtcttatctgttaattttttctatatggtttttggccctaacatcatacaattgtattgaatcacagccatactcacttgtttatatgttgtctatagctgctttcttcctgtaatggcagagttgagttgtgacggagactgcatgtagctctgtgatcacttttcactgctgcttggcaccccaaaaatcatagttaccacatttaattattttaaacttagaaattgtcagtgtttttagtggcatgtgtattaacttacagtgacttttttttattttttatcagtgtaaatccttgatgtcagaagagtagaaaagtagactctgaatgtcatactttaaaaggcatagtggagtatggattattttgttattaaattagatggcaaagcattgtgtttattatgtaatgagactgtaactgtgctaaaagaatatacggtatgctgacattaccagactaatcacttatcacaatattttcaactcacagaaatgctgtggtgaaaagttagaaaatttaaaatcaaatgtttcattatagcagaatttctttacacaaaaaagaacattcagctgcaaacaaggtaaatttgcaagtgactcctttgttatccaagccaggaaagccatttattgatggtgagttaattaaatcatgcttgattgcagcagctgaagaaatgtgttcagagaaaacaaaattgtttaagactcttctaagccttgagcactttgggaggctgagatgagaggattgcctgagtccaggagttcgagaccagcctgggcaaactagacagaacccatttctacaaaaaataaaacaatttaaaaaaagccaggcatggtggcatgcctgtagtcccagctactctagaggctgaggcaggaggattccttgagcccaggaggtccaggctgcagtgagctgtgatcatgccactgccctccaccctgggctacagaacgagaccctgtctgagggctaagatttatttttttctgaacaggataaattgactttagctactattgaagactgagtggctttggaaattagctttagctgcagagttgataatgaattcaacataaaactataaggcaaaacagtgcttatatgtgaaacttaatattgaagtaaagtcacttagatgccacctaacattgttttaatcactagtaatattaagatgctttatacacttcttatgctgtcaaaagtgaaaataagaaatgagatctctgtttgcataccagttgtagcagatacattttcttagctcaactaagtactgttgaccttccatatccatgagttctgcatctgtttttaaccagctttgaatcaaacatatctgggagaaacaaatggcatctgtactgaacattcacagacactttttgatcattattctctaaacaatacagtataacaactatttacatagcatttacattgtattaggtattatgagtaatctagagattatttaaaatatacaagaggatatgcatagattagaagcaaatactatgacattttatattagggactggaatatccacagtttttggaatctgagggaggtcctggaactaatctcccatggataccaggggacagctgtaccagcagtgcttttggaccacaatgcaagtagaaaggaaatttctataattcaaaatctatttaactgtgcagttgaagagcttccacttaactttaattgcaagtgaagaatctgaaatgtagcaacataccaaaaggaggatatcaacagaagaatataataaaaatttttaaatgccatccaagtaatgaatatgcttaaataaaatcatatgctcctggataacagtattttttccatacacaaataggtgtgtgaaaagacattttcagagatgaaatatgtaaaatctcattagagattagcattagcagagtaacatttgcgattctttttttgtggggtggggggagggtgtaaacatatgtttttatttctcttgaataaatgcccaggagtgcagttactaagtcatgtagtagttgcatgtttagtttttttttttaaacaataaacattatttttcgataatttttagattcacagccaaaatgaagggaaatagatatatagtccatatactccctgcccccaaatgtgcacagcttcttccattatctattaccactcccacaccagaggggtaatttgttataaatgatgaacctgcattgactcatcatcatcgtccagagtccatagtttatattgctgactcttgatgttgtacattctgtgggtttggaaaaatgaataatggcatgtatctgccattacagcatcctacagagtattttcactgctctaaaaatcctctatgctccacctattcattcttccttctcccctaatccttggcaaccactgatctttttattattttgataatatttgcagttgattttgatgataaggaatactaactttgagtcccaattaagcaaattgtcctccctctaccaaaagaatatcattcttcacattaggaggcttatatacaaataattatactttgttattaatattatgttttgaattttgtcaatgaaaaatgtgtgtgaaattgttttctctcattaagtaccctctatgataccctcaatattgccttttggcccacaactaaaatatatactatatgggtctttatggaaaaagtttgctaacccctgattcatatcaatgtttaactattctaaccatttagatcagagaatgaatgtttttgtgcctcaataaatgtcagtttcaaaaaccaacagcagtaaaggaaattttgtttggggctcaggatattttgctccggaagttaagcttacttaaagtttactcttgttctgaaattgtgttaagttgtctgggagagggttgagcacaatacatgactgttgattcctctctgtgtacttgttaggtatccctggtaccctgagatgatggccccactcaaagccagacttccgagagcctggactggggagaaagatgcccctggctctgtgcactgatgcctccctccccgccccactccattcatacccacaccctctccctctagtctgcacctcttcctcctgtgcatgggaatatctagtccctcagttcccaaatttctgcagatgaagcacccattcttgtcattcccacttatgatccattttgatctagaaggtagtgttgtctcctaggagggcaacaagcaagtctgagctgcctgccccagagtttttgctgtttgctaaggcatctctggggtgaacagagggcaggtcaatgttacctgctgaccttgaaacccttggtgtgtgtgcagcacagcctggaagttgtcagtcaagattattctcaagcctcatagactcaggttcctagtacagacatctgcatccagaccagttatctgctcacaaaacaaagttgaagagaacaagaatgaacatcatgcagttttgatttttgcctcttcattctccctttcccccattttcatccacaaatgcttactgtcttcaccattttgtgcaatattaatttctctgggttatttatagggagtgggtgggcacagtgcttatgacttagaatggaagacggtattccccgaagagctctcaacagctcacagtctgagggagaccctgtgggtacttggtctgttgatcctgttgaaaagtgagcatagcatgtgggaaagtgactcatggatgtgacttcaccattgccctccttttaaacttcttacagtgaaagcataacccagttctgacaaaggttttcagccagggctgggcctgcctttgactcagcgatgtgtcacattctctctgccggaaactctcattcttaacaccagtcatcatggtcctggcaacacactttttggagaggtgttggtatttggtggatttattttcttttccagctgcccacaaaaaaacaaactcagaaatatctatttgtttttcctttgaaaagtttgttggaatagtgtgtcatttctccatctggagccgttgttgctttgccaaggatagtttgcttagggccatggcaaggtgacggtggccctaagtgaagggtaaaataactggggcggcatgcccgtctgggatggcgaaacctctgagctgctgtcaggcggtgggtggctagccatggctggtggccacaggccatcacttcaactgtggctgggatttgcttaaagaagtcctttaagtttcttaagtaatgtctgcccagtcactcacctaagcggatacctctttactgttcggtgattttgtgccaagagaatgcctagacttgccagcccacattggaaacttcccagaagcccaagggccacacctaatttacaagaactggaacccctattccattctttgctgcttacagcttatgggagaggcatgttctaacgggcttctttccttctaatttgtagatcctgtgcaggcagctccttgaaggcagggctgtgcctttcttgtatgttttcttagagtgttgagctcagaggagaccccagtagagaaggcactgtggcgtgggggagtaacacctgtttagtagtcaggggaatagggtcaaaactccacgttggccacgggctatgagatcttggcccagtcagttcatttctctgggcatttcctcatcatccaattgctgggctgagtgattctctaaagcagtggttctcacccttgctagatgtatgagaaacacctgtggactttttattctttaatcatacatgatctggccacagccactcatagtgggttcagcaagtctgggtggagcttgcagagtaaagatttttccagagttctttatggccagggttgagggccactatgtgcagtccctgactagataagcaatgggaacaaagagtgagtcgttcaggccacttccaagcttactcacgtggctttgggtaggtcttggttcctcatggcttttggcggaaggcctcattcatacctcactacctgggcctctccataggacagctagcttgccttcctcacagtgaatgagaatgtggacaaagtagaagctacagtctttttgtaaacgcaatctcagaagtgatgtcccatcatgtttgtcatattttattcattagaaatgagtcccttgatctgccttatactctaggggagaggattctgcaagaatctggactaccaggcagtgggatcattgggtgccatcttagaggctgccttgcacagcatctaggaggtggctgcagaatggattttggagcaggaacagggggaagggaagcagggaatcagaagggtgtggtccacaagctaatggaaggaggatagaattcaagtataggctaggttatgatgtcgtaacaagtcataatctgaggggcttgaaataacaaagatttatttcttcctcatgcagatagtagttacaggctgttttgggctttgtgccatatcatcacacgtgggacatgttcatcacgggtcgtctggggattcttctttatgtcattttcactgtgggacctaagctgacaaagcagcttgaatgtggaaaaactccaactgtgcttcccccactatactctcacaaagcaaatctgacaccggatgtgtggggatttctgcccaccagcaagcaagcagtcagttctgcagtgcacaccaactgaatgtcctttaattgaattctgacactgtctacctggagacagcatcggatcccacaggttcagggctcagtcccacgagactgcccccgtttcagataccagttgcaagtctgagcctctggaacttctgaccaaccagtgtcaagttggggttcccatgatctgctgtttgggtttgactaatttgctagagcggctcacagaactcatggaaacacaggtttaccagtttattataaaggatattgcaaaggatacagacgaagaggtgcttagggagaggtttaggggaaggggcgcagatcttccatgtcctcccgggatgcaccaccctccaggcacctccacatgttcagctatctgaagctctctgaacccagtcctcttcggccttttatggagacttcattggataggcatgattgaagcatggagtggggaaacctaccaaggcctgtccagattctcagcctctctgtgcagcattccttcctccagggtctggggcagcacccctgaaacaggggccttaggacctgcaatcagacaaggaaggtcctcgcatttgttcacggtcagtttcaggacagaaaggcagggggatatctgagtatgtttttagtttctaaggccttccttggggagaaaaaagtgcaggtgaaaggaaggcagaaggtcagtgagagagagatttgttttttgaggactaaaagtgccccaacatgaggtgataaggactatgggagttacgagccagaaaccatggttgaaaaccggtatattaatatatatgtcatagtatcacgcaagtactctcagaaacattgctggttgccatggcagagggaaaaagttatggaaaagcatgtattagctcttaaaacttcagcctatgttatttccattcacgtttcattggccaaattatgtcttatggtctaccaccacttcagagggggcgaggatatgtactcctgtcatgtgtcccgagagtagaagtctggagatatttgattagcaccaatgacacccctggggggagtagtcagtagtgttgccctccacagagccgggcaacgtgaccactgaacatggtgtttcggttggcattcacgtggtcattgttaatcttaatcttggccagttcagtagttgtagaaaaatgatgtataacctgattgcatggtttgaggagtgaataggagatgagaaggtgcagagagctagaaggaaagaattgtagacattttttaccatgaaggaagtttgaattaccagcctttcctcattcttttgtatgtaatcacagaatgatgtcacagtgttttttttgtttttgtttttttattttaccatgtacatatcaacagatttttctttgactataaaggactctgtgctttgataataatccagaaatgaccagaggaagtttatcttgtgtgcactttcaatattgtatttaaataggaaatcacccctttttacagttttcatctcgagccaaacaaagtcaaggtattatgagaactgcaacgctttttgaagaaacctatcatacatttatttttcttagtttttctttcttcttccctttttaactggttttgaagtttggaaataattaaattttattcagtctccaaagttgctctgaaacatcagtttttcttctttctttcttttttttttggacagaatcttgctctgttgcctatcctggagggcagtgacacaatctcagctaactgtaacctccgcctcccaggttcaagcaattcttgtgcctcagcttcctgagtagctgggattacaggtgcctgtcaccatgcccggctaatttttgtatttttagtagagacagggtttcaccatgttggccaggctggtctcaaactcctgacctcaggtaacccacccgcctcggcctcccgaagtgctgggattgcaggtgtgagccactgtgagtttcccatttttgctgagttcagtattcaagcaggagatgtgaaactacttggcaaattgtaaggtgatatacaggtataagtcattttgccactttttccattagttttggttggccaagtagtagcattctgcacattttatttctgttgtgagctaatggtctgaagttgaagtgcagatcgtccgaaactgtataattgagatgttgattatatttggcttcacagaattctaaaaagtagatttaacgtatatgttgtcctgaactaaatataagctggcacttcattaacatttaagaattgatagaaaagagacgtagctgcaaaccggggctgatctgcccaaatgcagcagcaatgattattttgccaccattttcttctcatcagtctcccatctcttgtcatggcctttttcacttcttcctctagcagtttcaactgactcagttactttctctaggccctgtactagggtagagatactgaaagagctggtgatacctgccttaagaagggtcaaaaaaaggccgggcatggtggctcatgcctgtaaccccagcactttgggaggccaaggtgggtggatcacttgaggtcaagagttcgagaccagcctcgccaacgaaaaccctgtctctactaaaaatacaaaaattagggctgggcacagtggctcacgcctgtaattccagcactttgggaaggccgaggcaggcaaatcatgaggtcaggagatcgagaccatcctggctaacacggtgaaaccccgtctctactaaaaatacaaaaaattagccaggcatggtggcagtcgcctgtagtccctgctagtcgggaggctgaggcaggagaatggcgtgaaccgaggaggtggaggttgcagtcagccgagatcgcaccactgcactccatcctgggcaacagagcgagactccatctcaaaaaaaaaaaaaaaaaaaaaaaaaaagcacgttagatgggcatgatggcacctgcctgtaatcccagctacttgggaggctgaggcaggagaatcatttgaatctgggaggcggaggttgcagtgagctgagatcacaccactgcactccagcctgggtgacaaagtgagactccgtctcaaaaaacaaaacaaaacaaaacaaaaaatggataaaaaaaaaagatgttgtggtggtaaaatttcagataacagatagatggggctggagagagccaactgctgagcatctctaaaacctttcttagacacctgtaattctagctcctcaggaggctaactttatacacaatgacttaagatgtcaaggaaaaattagctttgattcaaatattgtgtatgatcctcacattgcaggttttcggtgacctgtggataattgaaagttgatacatgatttaaaaatattttttggggggcaacattttctaaaaggtaaaccttaggtatacattttgatttattactaacttgacattccaatatttaaacttcaaattttgaaatacaataaagttactcctattgtaatttaaaatatcttgagatagctgcaaaaaccatctatttgttggtcctatcaaagaaattgatattattcagctatgagagttatgctggaattatgtttgtaaaaaattccttcccactttcttggcaagatgcaagaatgatgggctgtaaaattgaaccgttaaaatggccttatgcgtgtttgaaccaacatctgattttgaagttacccaactgcctgttaccaatttacctactttactgggtgttatgtttttgtcaatgggggttattaaatttaatactctaagtaagtgatataatccacactttttagcacacgatgctattctgataaaagtcacttccaggtacttgtaagtgaaatgctttagcaggcaaattcttctaagggtgtttcttttcctaatcaatataaatgtgcttctttatttttctaggcattaggtcctcttttcaggctatgagatatatgttgttcagctattatttgcatgcaagagtagacaccaaaagtttctgatttcttagtaataaattaaacctctttgagctgttgaagttattattgcccatgtgcaacagtaaaaaggaatattaaggtatgtttggagttgtatgtgacaaccaaaatgagtgattgaggtataagtctcaaatcattgaggtttattgagcaggatcgggagctcaccagggaaaaatgtgacttacggaagaatctgtgactggttttttccaaagaggttcataggaggtttagtatttatacattttccttaaaaaagaaggtagggtatggcaatggggcaattgattatgtacttgtgagactttagttagatctacattttatgtgagagaaagtgaccatttgaagaagaagagaagagaggaaggagaggtctcaaggagaggtgaaggaaggattaatctcatcttgtctttgttctgtacctgggaagacaagctagtagtcttttggaaatgctggtttctgtttagcccttagggaagaaaacctaatgactgttagcgagggagggggtatcatgaattatgtcctaatttcccatccttttttttttttgagatggagtttcactcttgtcacccaggctggagtgcagtggcgtgatctcagctcactgcaacctctgcctcccgggttcaagtgattctactacctcagcctcccaagtagctgggattacaggcccgcaccaccacgccgagctagtttttgtatttttagtagagacagggtttcaccatgttggccaggatggtctcaatctcttgacctcgtgatccacccgtctcggcctcccaaagtactgggattacaggcatgagccaccgcgcccagaccctaatgtctcatctttttatggctgtgacttcaacttccaagagttctgtggcattcctttggccaagagggcatctgttcagtgaggcgaggggcttagaattttatttttatttctcatatgtgttttgactgtaagtggttaggaaagatgaattttcgtctctcctcctctgccagttgagatatacttctagggctagagaggtgatattgctgttttatagggaagacaagtcgtgaattctaaaagaggacactgtcagatgtgatagtgtaagagggccacacggctatggagaatgttccatataagcttcacacactgacaacctgggcagtgctatgctaatcaatgggaaggttgttgtattgctgctttaaaattatttccttgagtccagctataactgggattccaaggaattactaagggggatacaaagctttctccatttactgatttgcttttggaaaagcgtataagtccgttcttgccctgctataaataaataccagagactgggtaatttacaaagaaaagatatttaattggctcagggttctgcaggctgtacaggaagcacggcagcatctgcttctggggaggcctcaggagcttttactcgtggcagaaggcaaagtcagagcaagcatcttcacatggccagagcaggaggaagagagaggggggtgaggtgtcacatacttttaaacaaccagatcttgtgaaaactctgtcacaagacagcaccaaggggatggtgataaatcatttatgaagagtccacccccatgatccaggcacccccgaaccggccccacctccaatattggggattataattcgacgtgagatttgggtggggacacagatccaaaccgtatcaaaacgcattgttgttttttacttttatttacaaaccaagcccaaaactctcaaacattatattgttaaagaaaaatcctgttgaaattgtaataacaaaaattgtgttcgcttttgaacaagattacttttgcaacatcttggtgggtgtaaacattgaggtttaggcaaacaaaaggtcggcagcttgggtatcagtccactgaaagcaggatccgaacaggaggggaagtggtgaagcgggtgaactcacccttgtagattttgaggttgagtggcttacagcatgttcattcaggaagagaggccagtatgcagttgcaattgcttgcagcctggaggaaggtcacatctagatgcataaattttggagacaatttatttgtcactgatgcctttggagacggttgagacccttcattaatcatgaaatgtgataactgctgttgtaacagcatgaacttggtgttaatcacagagccaatattattaagtgatgttaagtgttgggaacacaaccagtattttctcttaaggaaatgggaaggctgtgtctctgacctcacaaataaatattctggagggtggagttgacagaattttagtgaagcaggtatccagttagcacaggcccacagtgccaaccaactatgaattttgaagcagttagaccttacctaaaattagctgtgctgttaaaagagtgaataataatgctaataatgtgaccagaaccactgatattaaagccaagcttatcttgattacctgtgtttttactgtgtgagaggaataattgtgggaataattatcaggaaaaagtttggggaacagtaaacattgtttatatggacgattatgtttaattcaaataagaagcatacaataggagtatttataatccaggcagattttatagtcacagtttaaccacaggtaagcttgagttaattttaatgaaattctttaatgtatatttgtctttaaaagtagaaatttaagagtggcatatcactaagctggagtctatattacatagtcagctcaataaggtgattacctttgccctcctgtgttattgggatagaataatttttcttttcttctcttctcttctgttttcttttcttttcttttctttttttttttttttgagacagagtctcgctctgttgccaggctggagtgcagtggcacgatctcggctcactgcaagctccgcctccctgcttcaagcgattctcctacctcagcctcccgagtagctgggattacaggcgcacaccaccacgcccagctaatttttgtattgttagtagagacggggtttcaccatgttggccaatatggtaatatttctttttatcctgttaattttattttctttgtattgccattcatatattccgaccagtgttgtaatactgtttatttaacaatattaatgaaacactttgcatcaggcacaggagatccaaagatgaataaatgaaggtcttagtcctcaaggatgaaacattctaatggagaaaacaaatgaataaggcagaatcgcaggacaggacagtacgtgctgtgatggagagtatcacagtgaaatgggaacacacacatggggatggaagaagctttctggatgtttccagctgtattgcactaaaacaacaccagcagatgggatatagcaattcatttattcaaactgatcatagagcttaaagagctaggcaatttggagaattaatacagaattaatattaggaaatccaatgttaatagaaagggtgtgtgtgagattagtggtggttattcaggcatttccatttttaccatatgataagatctgaaccttctgaaacttgtagtaatagaaggacccatttttccttctgtgaaggacccatttttctaaataaccagttgcaccctgctttctgtggcactgcagacttctcccagttctggtcctgcaccctctaaaggtgacaaggctgtcctggactgatggagccacctggggccatcagcctcccacctcctttctggcttcttaggaaacctgtctgtttttcttctgtttacacacttgcaacacagttaagtttccaacagattgccttttcttttcatatgtacatacgttcttcttaatccatatgcttctttactccttttgacttgctattctttctttctctgtgttccaaatgtagactaaaaaactttaactatgactagcagcaatgaaaagaatgtaaatgatattactgtgttaagaaggcagagaccacttttttgttttgttttgttttgtttttttgagacagagtccccctctgtcacccaggctggagtgcagtggtatgatctcggctcactgcaacctctgcctcccgagttcaagtgattctgctgcctcagcctcttgagtagctgggcttacaggtgtgtgccaccatgcctggctaatttttctatgtttagttgagatgggggtttcaccatgttggccaggctggtctcaaactcctgacctcaagtgatctgcctgccttggcttcccaaagtgctgagattacgggcatgagccaccacgcccatcccagaccacatgttttaaactagaaccaatgtccccatttgtttaagcccttgaaaaggccctggagtcctgcttaaatcttctatgtctttatctgtttgtctgttgtctacttaagtctaatgttcttctttttataatatctgtgttcaagataaagagaatctaatatttctatttgtcaaatctttaaaaaagtatgcattcatattattgtatattatattgtattttatagatagcactgtctctgtgaaagactgttctatttcaaataactgacatagcaatctttgaaagcagtttttttctttactgatttgttcatgtatttaatttttcccatttattccctgaatagttactgaggcactgtgtactgggatctcagctgaaaaagttatactggatgcacttaaagattttgttctgggataaatcttgcacatacatacactttcttcatgtactttcaatacacacatcaatgtatagtatatatcatgcgtatatacacacacatatatgcatatatggtagaggagaaagagtattttccttacccattgcaaggttcgtggctgaggcatctataataaaagacaggttaataagagaaaagcgtatagatttatttaatataagtttcatttgacatgggagctttcagaagtgaagacccaaagaaacagggaaacctctatattttatgcttagattagatgaagagtgaacttttgtgtggaagtatgattggacaaagggggtatgatctaatagtaatatactggggggaacttagcaaagcccctttgttcagttcttcttggtgtctcagtgtctttgaggatcagaatgtttctttcctctgggtatagggaggatgcctctggaatgaagattttaggaccggcttcaggggagaagggccagggaaggtgagagtgaccttcctgcttctgctgtttttttaaatgtcaaggtgccatattttggggtagcctgtcctaaactccatcaatacctatacacagatatacatatacacacatgtgcccacatgtatggacacacacgagcatacacacatgcacacacacatatgtaaagtggtatttgatctaggaattgaaggatgggtcagagtaattgggtagaaatgtgagaagggcagtagttgtggagggaattccgtgctcaatccatcagggtaggaaatctcgggctctgtaatgttgaaaggacctggatttgttagcacgttggttctaaacaggggagtagtaagagagaaggctgaaaaggtagtgctgtggtttaaatgtttgtcttctcccaaactcatggtgctgatattgtttggctgtgtccccacccaaatctcaccttgaattgcagtccccatagtccccatatgtcgtgggagggacccggtgggaggtaattgaatcatgggggcggttaccctcatgcttttcttatgatactgagttctcacaccatctgatggttttataaagggcttttcccctctgtgctcggtacttctcttcctgctgccatgtgaagaaggatgtttttgcttccccttccgccaccacgattgttaagtttcctgaggcctccccagccatgcggaacttgagtcaattaaactttttttcttttataaattacccagtcttgggtatgtctgtattagcagcatgagaacagactaatacaattgccactgcagcagtcttaagaggtgggatctttaagaggtgattaggccgtgagggtttcgtcctcatgaatggattaatgacactattgcaggagtgggttcctcttagaagaataagctcagcccccttttctctccctcttgccctctctttgcttttctgccatgagattgttgcagcaaaaaggcccttaccacatgtcagccccttgatcttggacttctcagcctccagaactgtgagccagtcaatttctgctcattataaattacctagtctgtagtattgttatagcagcacaaacagactaggacaggtagcatagtggggatgaatttcagtccacaaagttaaccgtggctaaagtatgactcacttttttttttttttttttttttttttttttttttgagaaggagtctcgctctgttgcccaggccagagtgcaggtgcgatctcggctcactgcaagctccgcctgcctcagcctcctgagtagctgggactacaggtgtccaccagcacgcctggctaattgttttatatttttagtagagatggggtttcaccacgttagccaggatggtctcaatctcctgacctcgtgatccgcctgccacagcctcccaaagtgccgggattacaggcgtgaaccaccacgctcagcctactcactttttgatcataactccgtttatatttcaggctcatttctgaccatgctgtaggaggcatctctttattcttcttttgaggtcatctcctctctgccttgtgtcctggtcctgggatcttgcctttgccggtcactgggtgggcatctggtcctcactgggtgggcatctggtcctcactggtggctaatgcaaggtactcctgagacagaaaacctcccagttctccaggcccttgggctctttgctgtgtgggaagctttgtgaggctgctgcctgccaagctccaccacaaaccacccttcccttgttggggtcttgtcccttccccagcagctctgcttgtgaacccagaaacccatctcttctccgtcctgcttgctgcaggtctctttctagtctggtggaacttggtagttctggtagcaggttacttgctctacacatgagaaccatttcccatctgtgcttaggcttagtcaggatcatttgtaggctagttctgctgctttcaggtcatacccgtctctcaagatcaatgaacataaggacctgttcctatcttgattgaggaggaaagaaggggaatgtaccagaaagaaaaaaaaattagatcatttctcaaaaaatgtgtcctccacaggatggatctcagttgaggcgggtcttagacatcaaaattgaggagtccaggcttcactgggaaggtaacaggaagccttgagtgaccctgagctggggagtgacatgtgatgagggttgtgtttctcctgtgtggcaatgggaggcaaacaggagaggggggaatctggattcagggagaccccaggggaggctcctagcatggtccctgcaggggtgatttctggtgctgcagtaggtccttaacttagagaacaatggttagtacagctcgtgccctgtggacctcacccaaggctttagttcatggaactcccaacaggaagccatattaccaaactcttacttatatgttaccttaaggcagagctgttctcattgcagaatgttaccatttgaatgggaagctctagaggtcgagaaacgatcagtgactgaaaaaggaagttacagaaggttattcacgaagggaacattctttcatttcatgaccacctgacgcactgtcaaattgaggaagccagcattcctaatgggttttttgacctggaaggacattggatactctgaaagaggaagctactctaataaggttggggcccccagactggtaataactggttaacttggggagaccttgccgagtgttaattaaatttgcattacaggtggaggaatctgatgtctggaaatactttcccattccatttaaagggtaagctgcagatctctaaggctctctttgtgacttttaagaaaatagcagacaaagaaggcttttgtgggataaaaaaaacacggaaagtttcttgctgaaacttgatgagtctgcatttgcagcacatacatgtatcagatttttttgtgtgtgcccagataggcatttttgcttttaaattttcagctgagtctgattacctaattagttcagattggccctttcttggggagacagggaggaaagaggctttgaagttgtgaaagggaccatgaagcagacagggttctgggggttgggaaggtgctgctggtgggaggcgtcctggaggcttctgtctttatcctcattgcgtctgtagcagttcatgcagaggaactcttagggatcccgggtgatagcagtcactgggctttagggaactctgttggagagcctgcaggcaagtggatcaaaaaatcaaactgttgagaggggtgtaacatacaaagcaaggttacatcccttacagtccgtctccttaccacatcccactctctggaaaccaccattgacaagagtttcctgtttattcttataaaaaactcctgtgcgcaaacaggcacacattgcttttaaacacacatgatttgtttgttctcattattcagattgtaccacctgacacccttgactctgctgttcccttttgccagtcagtccagctcggtccgtcccacagctgcggggtagagtccaccatgatccagtttgtttcaccaggtttctgtgagaaacagctggatgtttttggtttccagcctttgggggttgaatgataaccctcatcccccaaaaagatatgtccacatcttaatcctcgaacctgtgaatgagatcttattggaaaattaaggatctagagatgagatcatcctgatgtaaccatgtgggttctaaatccagtggcaagtgcccttagaagacacagaagagaagacacagggagaggagatcttgtgaggatagaggtagagattggagtaatgcagccacaagccgagaaatggctggagcccctagaagctggaagaggcaagggatgattctcttttagagctgccagagggagtgtggctctgctggtccctggatttcagacttctggtctccatacccgagagagaatacatttctgttgttttaagccacctagtttatggcaatttgttagagcagccctgggaagttaatacactgcccaaactctgatctaatgaacatttttcttattatgagaaataatggacaccttctctggacacatctgggcacatctgctcaagtttaccttcaggacaggtttccagaagtagaattttggttctaggtcctgaaatattttccccttcagatgtatttcatatcacatgcatccttgccttaggaataataatgcaagtaacagtagcaattactgtgtgttgagtgctttttgtgtgtcaagcattgtacctacattatcttattcatcctgacaataaccctatgacacatttattattatcctctttttatggatgcaacactgagatttagagtattgaagtcacttgcataagatcatatgcttacataagaggcaggggggccaggattcaacccaccctctaactccaaattctgtgttcttagctatgttgctgggttgggaagataaaccacattttagactttttggccctgtgttgtatggatgtggtttggcatgttctggccactgggtgtggtgggttctgggaggtgacagactcagttataattacaggaagaagtctggtctggcaggcagcatgtggaatcaatccatggtgcattgggagtctggtgaaatagcaccatgcagatggtccatcttggcgtaatgggatcccaacaggtggactgaacatccaggagttagaacatcagtgataatcacaaagctacagttattgttagctcttactacatgtcaggcattgctctaagtgctgtatgtgtattcacccactgtgaagtaggtaccgcattagcatggaagggaaccatcagtaagtcatgggacgcaactgcttggcattcaggtacagatcagctcctgagtgaggagacagcaagaacaaggctgaaaatggaggtaccaggtaagttcaagaaagagacctcagctcaggctaccgggtgggtacccagttaatagagttgcaagatgggaatacatctcaggagagaggcagaagtttagttaccggaacaggggtccttcatcagaggtcagcgtagcatgacttaacaccaattccagaatccatttggtgcctgctctaaggagtgtagcagcagcaggcccaggaggggaaataatggagcttgccattgacttcctcaggcttatgaccttgtggttatggcgacatacatgagacccgagactgcggtgaataagtccttgatactagtgtgtcgtgttctcatttatttctttattgcaactagtgaacacagggttcagctgtaagacttctgggcagcaccgcacggtaggctttctataagcttagtgatgtaatcctttaactatttttatctttaatacaattgttatctctactggctttgttggcaagttttaattcacaaggagcattaagaagcgtgatttctgttggctcagtaaagtgattttcacttccttgtctcgttgggccacctgccatctcttaacttttggcaaaggaaaataaactaacacattgtctttttatttatatatttatttattttttttggtggaagaatatccccatcttgtggatatttgcattgtgttttagcttccgtggttataaatacagattcacccagtgtgggcacttgatcacagagattattcttagagtcttctttggtgtccaatttcaccagcatttcggattctggacacagaagcaccaggctgtccctcctttatgcttttttttttttttttttttttttggagaaagggtctttctctgtcacctaggctggagtgcagtggcatgatcatggctcctgggctccagtgatcttcccacctcagcctcacgagtatctgggactacagttagtgcctggctactttaaaaaaatgttctgtagaggtgtgctctcactctgtctcccaggctaatcttgaactcctggcctcaaggaattcttctgcctccacctcccaaagtgttgggattacaggcatgagtcactgcacctagcctcacttatgttctatttacctttaccactgttgcactttcagcattttcaaagtcctctcaaaataatggtttcctttgcttctccaaacagacttaagtaataggttatacattctactttaagatgagagaattactttgttttaagatgggggaatttattgtgtaacagagaataaatcagtcttagacctgaggccagaaatctctgattttcttgacttcagatcacttaccactcccaccctctgtcctgcccccagcttcaatcatggaagaaacagaatgtaaatgatagctgtgtctcaaaccatctttcagaaagctgaccagaaatataagtcacattgtttataaagtgccgatggagtttatccaagcagaatttgctttcctttaattatttgttaagtgcatttctcgagttttcggaaatggaaatgagtttactttatgagccataccatcatgttctaattactattttaagaagttaaagacctccaaaaattggatttgacttaaacatacaatgtatggtgtcagagtaaagattagggcttggactgatgttgtctggtacacaggaaaaaattctattacgtatagttaaaatgaatttttaaaaatttggtgctgaaatagtaaacttcagtctttaggcattcactttggtaaaattcctggaaagcaccaggcatgtcaagtgctataatacaaagttttacaaatagggatttgaagtgattgcttttatggcatggaataatgccaaagaagtctcttgttaaatatggacagtgagccgggcgcggtggctcacgcctgtaatcccagcactttgggaggccaaggcgggtggatcacgaggttggaagttcgagaccagcttggccaacatggcgaaaccccatttctactaaagatacaaaaattagctaggcatggtggcgcgtgcctgtaatcccagctactctggaggctgaggcaggagaatcacttgaacccgggaggcggaggttgcggtgagccgagatcatgccactgcacttcagccttggcgacagggcgagactccatctcaaaaaaagaaaaaaaaaaggaccagtgtgttcttggagacagagtcttgaagtagaaaatgcttaggcacattcttgatttgcacatgctgacgcctgcatgtgttccgctctgtttggaaatgtatccctagactgtaagcttcatgagggtaaggtcttagtccatcttgtttttactggatcccttggcttagaacagtgtacagtagggacttaatatatatttgttgagtgaattaatgaacaggtacataaaggtagcaagaaatgaatgtagatctttattagtgacaaatgagtgaaactaaaattcaaaaattggggacttgtatgctatttgatcatggtcaagatgacaagaatatatcatttaaaatattatataatttaaaagtagttgtgcattgaaaatgcgtgacaggctgggtacaggggctcatgcttgtaatcccagcactttgggaggccgaggcgggcagatcacttgagatcaggagtttgagaccagcctggccaacatgttgaaaccctgtgtctactaaaaatacaaaaattagccaggtgtggtggcaggtgcctgtaatcccagctactcgggaggctgaggcaggagaatcgcttgaacccgggaggtaaaggttgcagtgagccaagatcgcaccactgcactccagcctgggtgatagagtaagactcagtctcaaaaaaaaaaaaaaaaagaaaaaaagaaaaagaaaagaagaaaagaaaatgtatgacaaagtgggaaaagcttggattttttcatagtggggacaaaatatgagattggagatgacatacctagcagagtccctggcacataaaagcagcatagaacatttattttccgttctcattagtgccttttagatcaaattgagaaggaaacactagagtcagcgatacttgagtagggtgatattgccctccacgtgacatgtggcaatgtctggagacatcattagttgtcatggcttgggggagggtcctactggcatctagtgggcagaggccaccaatgctgccaatgcatcctgcagtgcacaagatagccccctacaacagagaattacctggcactaagtgccaatagtgttgaggctgagaaaccctgtcctagtcactcataaagctatattaaaatattgagccagataaaaattgtgtcattatacacatctcatgttgaatcagatattactaactaaagtctattaatatgtagcacataagtgaattttcttatttctttatgctatggttcctgacgtaaattacttttgtttttaaaaactgatgatttctgtcaatatcagggacacttttcaccaatatgtttatatatttttaaaaagataacatttgcttttcaaacagtgcagtaaacgtataccaaatgaagcattgctgagctgagcaagccctattacttgataaagttacaacagccacacaagaatggaacaacttgtctatagtttgatcaaaatacacctgattaaaatacatttgatgagtttgctgatatttattgaaatgaaacctagttgatgttacgtgttttatatacatttaacccgcattttagacctactagacttttacatttaaaaagagtttctgttttctctggaagaatattattaatttctgcagcagaagagagttggaaaattagggtaattccactgtttcatttgctctgtctttcagacatggtgaaatgtttcatatttgagtaattggacggagtgggaaagactttgaagatattctttgtgtttattatcattggcttgaaagttggccctttttcctggacatttcatggcacatcagtaactcacttggtgggatcacaggtgttgcctttggtggactgatattctcataatggggatctgatgtatggtatgccgaatctgtcttcgcgcttgtgacattgctcttaactcttgagtgctatctcaagtgtagtttcttgtgaaaattgatgacatttactgaatgccgagtgtgtgttgggcacagtactaaatgctgttcgtgaattacccatttcattctcatcacaatgtcatgaggtagctactattatggttcccattttagagatagggaaacaggcttggaaagtttaagtgatttgtccgtggttgtgtaactagggggtagggaggctagaataggtcacgttaccctgttgatgatctttgctgtcttcaaaggaggggttgaggcggtggggtgcttttagtgagatagcatacagagagaattctgaccttaactctaaagtccaactataataaaatagcaatgaaatataactcaacgccatttcatatagctctgcaaggagagggaaggcacttgctggtacagttgggtttaaaaggattaccttgttgagtcagttttccctccccttggctagcagttggggcagaatgtggaaatacagatttgcagtaatgcatgacctgagaggatgctgcttgagtcaggcttggcttccatagtgtgcacagacttcttcatgccccatgctgctctaattgtacttaagaaccatctaggaatgctatgcctctgggtagcagcacttttgtggagcctccctgtccatgtccagaaagctgtatgaatggaggtttgcctggtacttaatgtgtgtctacgtgtgtgtatgtatgtgtgtgcatgcaatgtatgtttgcatgactctcattggtggtcgtggggagtgtgtcatctcctcccatggacacttcctatatttctggtagcctctggtcctgtggggctgtaagtagttaattgttcctagttctctctggtctatgagcagcttaagcatagatattgtgttaatactagtagtaacagagaccctttgagttctggtctctctctgttttaatgatgaagcaactaagccaaagatgggtaaatagtgcctgaggatactcagcccatgagtagaagagctgaggttcctacgtaaggcggtccaaggtcaacatctgtactctcttcactattctctgttctctcttttatctttgtatccttggcacatggtagttaatcagtaagtcttagctgaataaatgctgcttatgaacacttctaggtggaaattaagcattgcttttaccagagtataatgctgaattgtaatatactcaaggatggtggcaagaatcccctgtacttggtgccgaatcctctgactaatcgcccgaaggaagttctgtgttctcagagcatctgtcctatttgtgtctcttgggtctggatttcccagtctttagtccagtttcataatctgcctcctgagctcttccagggaaactttctgagcttttcttggtgctgtttggagttccactttcagagtgaattttcattctgatgttccctgattggggcctcccctgttgccctgggagggagtcctcacattacccccagctcaagagagagcactggccaggcgtggggcacctctagctgtgtgactgtggagagtagcctttttacatcttgagtttttcatctacaaattgtgagggaaattacctactacaaattgtagtagtaggtaatcttgttctatagttctttgccgttaaaaaaattatggacccctttaacaatctgccaaaaacacaccttgtgctgtgcgtgcacgtgcgcatgcacacacacacacacgcgcacacacacacacacacagtttgtcacagaattccaaggcacccagagaccctgctcactcagatcccgtccctttactagttatccatatgtaaaggatctgttctttattgagttctgtctgtctttgacagtctgtggcatgccatgataaagttctttttaaaataccaagtttattgaaaagatagtcttgtgttagaacttgtaaaactcacaaacctttcagcctgggctttgaagcaaaaaaggaaggtttagaattacaatatagactcccatcaaataggtgttgacaactccagacattaagccttctgggttattcctcactccctgccttctgatttttatcccattctctcatcatctgtattatatacaaacaatgggatgaatgttttttcttggaaggaataaatactggaaggatgtttcataggtggaatttttagtcttagagagaacatcagtaatttatcttcagttttagtttaaatggaaggagtatttgaggagctcctggatcccacagaagaacttgaaatcctctctccccattgctctcgaactctgcatacagcagctgcctccaaaaagtccccatttccatgaccctaaattctcaaattcttctgaccacctctcttccccaccctcccaacctacctggacctattttctgctagtatattttgttctttattatacaaatcccacctgccctcaaggaactgattcatagacctgcactccttccttttagggggaatgtttcagtcacttatagtttcataaattcctttcatttctgtcacaggtggaggggagggaacccagggagtaagagaccaccccacagagcatccactctattagaagaccatgtggcacccacacgaactccagcagacattttctgaagtggaacgtgtctttcaacaaactagcattttgttcataacattctaagcagtccctggtatatttgaatgaagcttttgtttcacttacatgtattttcaaggggaaataagtgagtaaaataaaatatttgatttacagcggttaagatggttaaatgcaaacgtctttggcttgcccctctttcccctccatattgttttcccctgctctccctcctattcagtgagatagcctgttgttcacggattctaatgggattttatttaccgcctggtggaaacagttgaaaaaaaattacacaattggaacaattcaagcattttgaaacattctcttggcagtttttttttcttttttttggcaactaggatacgcctgctcaaaacatttttaatgttttaccttcatgggctccgcatttgccagtgtaaatgtttccaaattgttctcttgatttcattcttaagaccctaggcaatgaatataacatatgtatatatgtacgcacatgtgtatatacatatatgagtgtatatataaagagaaattactcttgttctttggtttaaaaataacaatgatttcttgcaaagagaaatcataattgtgaagctacagttatcagaagccagctaattgaattccactgagaactattagagtcatatacagtaatgatgatgatgattatcatcatcatcatcatcatctcaaaacttgccttggcattcataagaaatctcatgatagcaatatattttagaaatgtggacataactagttctttttattttctttttaacatttcaacaaagtgggacttagaactcagcatctcctgggtcctacataagtaatttaatgtgaaacttaaagatgtaaaaagagagtttaacaggataaatgggttctggcaatacaaggtagtgggttagtaatgtaagttaatgatatataactttcaataaagcttttagagtttttcatatttgcagactatttacaatttttttattaatagttctgcaaaacaacttgtttggaataaatttattttgtatctcttcttcaatgacataagaaggttaaattagcccaatcatgcaaaacagtgagagagtcaaaatttaggggatttctgtttcagtttccttcttcccttaagatttttgtctctgatacttttttaaaaaaattttaaatttttgctgtatctaggagacctaatgtaagatattggaacaagcagttgtctctagacttgtttctgccattgttgacatttacttaattttttgatgttgcataagttatttaatttcttttgcaatcagtttcctcacctgtagaatgaggagactggactaggtgatttcctaagtcccttttagctgtctgaacactgcttttcatcggtgaagttacaactggcctccttcaagaatgtagagtactagaccattatcacatgagttacagataaggtctggggaattacataaagtcatttactgtaattggcttgcagtactctgtgagtaccacataataatgctattttattattcagtgtgttagaggttacagattccccagttgccagagatgtgatgaatccccttggccttggcaaacagactgctttcatgagttgcactgcacatggttataaacccaatggctttctgagctaatgtgcaaggtaatgccatcttccaaatgaaaaaaaagttgcatttacccattcctctaacgagaatatatttctcctcactttaaaaataactccattaccaaatgcaaatatgcataatgagatggaattatttccaaatttatacactatatagtttttctagtgtaagtaaactgttgctatgaaaccaaaaactaagaactttactgccccttttgtagtctaattacttaaaaatgaacaaagaatggttttattctgtgctttttttaaagcaagaaaatatatatcagtatataacaatagtgatcttgaataaaggaaatgtgtttttaagatatagatggggcaaatttttcttatcagactaatggcactacagatgacaattacaaactctgaacaaaatataaagtgaactatttgaaggcatttgagagcaataaaaagcagactgaaattggagggaagttaactaaagaaagaagggacccccaaacatctatatataaactcttcccaaatttcttggctgatcctggggagactccaaagttcctagtgaaaagcaacagctggaaagctgaaagaactgagctattgcacactatagaggaaagataatttggagtttgaatctagccaagtaactgcctgggcaacaaaataattaacattatttagagtaagatagagagtctccgcaaaataatattcatgaaatactgtacctaataataaccatgagaagaagaggaaatttgactcatagagaagagataaaacaatcagtagaaaacagctctaagatgactgaagatgttggaattagtgcacaagacttaaaaagcatatatatataaatatgcccaaggacttaaaatatgatcttaatgaaacaaaagatgggggaatttttaatagaaaaatagaaaacattaaaaaacaggtggaagtttgaaagggtaagtggccttgaagatagatcaatattaattatttaatctagaaaacaaagagaaaaattattaaagaaaaatgaataaaatctcagtgctgttggagtaatgtcatgtaatttaacatatatgtaattgtagtctcagaaggtaagaagagagcaaatgtaacaagaaaaatgtttaaagagatagtattagacagtcttgcagattaggtgaaaaacataaatttagagatcaaagaagctcagtaaaccccaggcaagattaataaaaaggaaaccacacctgggcactgcataataaaacaactgaaaaccaaagataaaggaaaatcttgagagcagccagagtcataagacatattacatagattggaacaatagtacaaatgatcacttctcatcaggtacaaagtaggtcataaaatggtggaatgacatttttaaagtgctagaaaataaactatctatactcagaattctgtatccaaagaaaaatcctccaaaaatgaaggtgaaataagatattttcataaaaatgaaaatggagacaatttgttgtagtacatctctacagcaagaatttctgaaggaatttctttaggcttaaggagaaggacactggatgggaactcaatataatagagtggtgtggggtttattacaaacatagatgtaatatatgtaaaaatgtaagatttttgcaacaaatgctattgggatctcaagaattgtgagttctgccaacctattatcctgacaagaacgacaacaggatcattggtggcaattttaatggtgctttgtagttttcagagtttttaaagtgtatgttggtttattcttagagtcattctcacaggattatttgggagaggaatttagcagatgatgttgtgaaaatccacttgtaagagaatggaaaggaattggtggtgatgggtgtaggtagatcacatatgagagtgacagaaagtagctgagcacaggaaagtgcatgattttagttctagctactcagaaggctgaggcaggaggataacttgaggccaggagttcaaggccagcctaggcaacgtagtgagaccctcatctctttaaaacaaatcaaaactaaaaaaagagaaagtgatagcaggtggtggtggtggttttctatctgagaagtcctgctctgataacttggtgactcttatagggtagaaggagtggggatggaagggagaggaagatactgataaacccaatcctagtagaaacaatggctctagtaattttttctatagaatcatatatgcctacaggttctatagaatcatatttgcctatagattctgtaatcaaaactttcttgaaggagtcttgatgttaaaaattattctgctttaatgtatccaccgtggtctctaaacttttaaattgtgtatgtttatcagctaaaatgtttcaatattaccctatatatgcatcttttaaggcaacatattaataatataaagcatcctaaaaatagttcaagtggatgaaataacataactacagataaaataaaagtcaatatgtaaagttctagtatttttctcttgtatcccagcattgtattttgtactgtttgggtatggtgcctagtttgaagacccctgcagtgacaatcaagcgggatcattggagttattttgtttctgatcatctgtttatgcatttatgtatgaaatacacatatcattttacgccactggaataccatgtttttaaaaaaatcatagacattgttaaaattcaactttattttgttttttagcttttcccactttataatggtaccactctccttcacaaataagtagtattaataatgtggtggataacctgtgtttttcttctgtctatataattatctttaacttttttagtgcttaataaacaataaggatatagtatgttaatgtttctacaccttgattttctcacttaaaatacagcatagaagttcctccctagcattgacaggattcatttttagtggttatatagcactccattttgtaaatgtgctgatttattgaatgaatcttctgttaatgaatatttagtttctggtagtttttctttttgctgttataaacagtcatttaataaccatgttaaatatatatccttacatactagactattatttcttaaagaatgtgattagtaggtcaatgagtacatcagtttttgatttaactttttacagattggtttccaaagtctgttacaattcttgtttctattagggattccagagtatacttctcccccgactttatatccccatgacaatagttcttttaagaaaaattatttgctaattaattagcaaggtgagtgcaaatgtaatctcattatgattgccttttcctcagtactggtgcgggtgggcattgtttcatatatcacagtcatttagatttatttagtgaattgcttattcatgtcctttgtccattttcctattgggctttgttttatttgcattgaatcaccaatttgtcttgttatcactttgtgggaaacttctgtatcttatgccctaatttttcatgtgcattgcagatatttttcaaatgtattatttaactattaactttatggtgtctttttatatataaatgatttttttctgagacagagtctcactctgttgcccaggctaagtgcagtggtgcgatctcggctcactgcaacttctgcctcctgagttctagtgattcccctgcctcagcctcctgagcagcttggactacaggcgcatgccaccacacccagtgaattttgtattttttttttttaagtagagacggtgtttcacctgttggccaggctggtctcgaactcctgacctcaggtaatccgcccaccttggccttccaaagtgctgagattacaggtgtgagccaccgcgcctggcccacaaatgatttttactttataaagtcaatatattttttccgaaagtcaaacttgcattatttgcttagaaattccaatgcaaagtagggcaactagcctcagagcaaggctctcctggtatatatgggaactgtagaggcactaccttcaccatgttctctgaacagacctaccaagttgaggcttaaattgggtacatacccaactgaagtttggctatgagtcctgttgttctagtataagaagatttacttgttcagattttgcagcttctcatataattttgtacttgtgctccagacatattgaaataagccatatatttttttctccagatatattggctttaggggaaaaaaaccctccaacattttcagcagtgttagaggatcttgcaggtcctgtagggcagtagatattttgtttcagctggatcaagccctaaaaggggattggaacagatgtttgaatttggttaaatgctttcaatatttattacttaggtgacctagtttagcagcaattgtaatagaaaaaaaacaaggccatttgagaaaaacagagtttcttgcattcaccttaaaaattgaaagaattttccctttttatttagtttattttatttagcttgaatgtgggaaaataaaaccctgagagattctcttcctaatttgaacagatatctacttgtatattacatttaaaaaattttcccgtatgaaatatttttttggtgtgactggagaacagttttggagctacagttcttgatgtgctagttgaactctgaaagctggaggactatagagatatctcatagagtcctgtacttcataaatgaagagactgagacttagaggaatttggtaacatttgagttagggctctcagagattcagcggcacgggcagatggatgatttgagtttcccagatcctgtgtagtactgtttattcttcccctgtgttgagcaccatgtgccacgtggatgcctgtcctggagaagtaggtgcttgggtcctcctacccattggatttatccttgactctgtgggtgcctctcatagtgctttagtgtcaggaaggtgctggctagtaagagggaaaattgtgaacgaacagcttctctgacatcttcccactaccttttccattcttctaggcttaaaggtcacaagggggaatagataaaattagcatccgaaaccaaaatccatgactgtctcttgcttccattagggtgcgaggtggagagttcaataaaacaatcatgtaaatcaaccactacagcaatgcagtgggagaataatctggggagtgagcaaaattaggcaggagagttctcccaggtaagtggataaaggttatgtctgacatctggcaaactggatgttaattcctcacaatgcgataagaggagcatcactggagagcataacgtgttccggctacagagactgacagctcatgctgtggttcatgggaacagctaagtgaagagtgcgagagtgcaggaggagtaaaaatgaagttgataacatgtgggatagaagtatatacctagctgctactccagaattggcatctcaaatggttacctaaaaggggataaagacatatttgaaattggctgagatgaacaagacttgacactgtgtcatccagaaatatgaaggatgggggcagggggggcaagaaacccagcttctttttccctcattcactgtggtacctgactttttttttttcaaggaatctagggtataattgccttttttatgtagttttaaaaaatttttgtaaagtatatgtaatgtaaaacttgccatcttaaccattttcattgtacagttcatggaagtacatgcaccgtgctgtgcaaccatcactactttctgtttccagaacttttcatcaccccaaggagaaactctacctattaaacagtaattctctctctctctcccccaacccctggtgataacctctactctattttctgtctataaatctgcctatttcagagacctcatagaagtggaatcaaatcatacagcatttgtccttttatgtctgtcttatttcacttagcatgatgttttcaaggttcatctgtgttgtagcctgtgttagagtttcatttctttttaggattagataatattccattgcatggacaaaccacattttgtttgttctttgtcccaggacatttgggttgtaggttctgcctttttgctgttatgaataatgctgcagtgaacagtggaacataagtatgtttgagaccctgctttcagtgcttaggagaagaattgccaaattatatggtaattctgtgcttaatagctttttgaagagctgcaaaactgatttttcacagtgcttgtagggctaggttccttgactcttacaaactcattaggtattaaggagtgtgaacagctgaccctaggattgctgaatggggctttgcaaattctgagctcattgtttacaaataacttcaaaaaaaattttaagtgaagcttatatttaatgaaactttagaaagtaagctttgcttttttcttaagtatacacttaggcagtctttgaatagaaatctaatattatcagagggatgaaattctgtttttgttttgtcgttattggaagaggagtgaaagaattgaatatcaggtattgtgctagatattttcacccatcataaaaagaaatcactcatccttatcgtttctgcattaactttgtgaggcgatgttattacccttatatcactatgaaggagttgaggtaattcttcccttccttcccatgataagtggtagagctcaggtttggttcttagaattcagttaaaaagtctcgtgattggcatttccccaataggctaggagccttaattactcaactgtttacattttgaatttttttttggattgtattagttaggttttctctggcccttgttagtttagataaataggagatggctacaatttctttttaatttggttttagataagctctcctcagtaaccaaatgtagtagctcgttttttgagaaactcaggagtttagttattaacaatatctctttcaatggttgcttgttaaataacttactcagttcaaggttttgatgatttcggtgtactgtgcttttcagaatttttgaacacagttacctcatcctttgcagataggatatctgctttttttagcacgtagctttgacaattaaacatagaagagaagaggatatgtcttgtgtccaggcaacttgagtatagggccacctctctggcctaatggggcatccagaggacacatttggaggttgtgcagttttgatctcctccttctccagggtcgaaatttctgtgtgcctggcctcatcatctctgtaaacctgtctgtcattggctcttcattcatatctgttgtaatagtttggtgatagtagcccacgtttagagcgctagttttcaaccatggaactattgatatattgggccaggtactttttctgttggggtggggggctgttctgtgcattataggatacttagtgtcatccctggctttttcccagtagatgccaggctgccatctccaagtcttgacacttaaaaatgtctccagacattgccaagtgtccctgagaagcaaatacagcccctggttaagaaccactggtaaaggaagatttggaattacttggttgtgttgatcatgtttcttaatgaccattactaaaaatcgcttattttctatattttttccctcaaatatctaccttctttcattttaatttctcaatcccttttgtctctttcatctcatttagtcgaagacaatttttattggtctttctcttatattttcatttctcccattttcctgactttgtgtttgctcctttcattttacttttgctgtgtttttctggcatactctggttttcccatattctttactggcagtctgtatatgctgtttgtatgcactgtccgtatgcacagtctgtatgctgaatgcacagtctatatgttgtatgcactgtctgtaagctgtacgcattgtctgtatgcagtctgtatgctgtatgcactgtctgtatgcacaatctgtaatgctctgtatgcactgtctgtatgctgtatgcactgtgtatgcacagtctgtatgctgtattcattgtcggcatagtctgtatgctgtatgcactgtctgtatgcacagtctctatgttgtatacacagtctgtatgctgtatgcattgtctgtatgcatagtctgtatgttgtatgcactgtctgtatgcataatctgtatgctgtatgcactgtttgtatgcagattctctatgctgtgtgcactgtctgtatgcacaatctctatgttgtatacacagtctgtatgcatagtctgtatgctgtatgcactgtctgtatgcagtctctatgttgtatatatagtctgctgtatgcgctgtctgtatgcagtctctatgttgtatacagtctgtatgctgtatgcactgtatgcacagtctctatgttgtatacacagtctttatgccgtatgcattgtctgtatgcatagcctgtatgccgtatacattgtctgtacgcatagtctgtatgctgtatgcattgtctgtatgcatagtttgtatgctgtatgcaccatgtgtgtagtctgtatgctgtttgcattgtctgcatgtgcttccctttagtctcttcatcagcagcctgttacctcctaattctgttttggtctgataggtaattccatatggatggggtcatggaccataaatccttgtctccgtttacgtgtgtgtgtgtgtgtgtgtgtgtgtgtgtgtgtgtgtgtgagtgttatgctgccatgtggcatcttcctaatggtttgcttattctttgccattccctatgtgcatattgcccttgagcactctccagggggaagagattttctgcatcaaatcatagctgacactttaatttacttgaatgcccatcctgcttgttgagtagcattcacccatccttctcaacaacttgaaggcaggcagggtgcaattgatcacttgaattttgtggagaagaactggccctggcagcctgaaggtgacccctgcactttcctcctgaatccctgtttcctcttctgctttttcttactcctgattataaaactaaggaccctcaacacaggggaacgggttagattgtgttggactggacttctgtgggaaactttttgtggcctattgggggttcctttctgtgaggtccaaagcccttttcttaactggaaagggccttgtgttctgccagatcctcccaccctctctgcaggtcaaataatggatttagtagaaatatggaaaagtttagtctgtctgtgcgccaaaaattgccactaggaaggcagcagtgtaaacagtgtgtgactaattctttcttttaaggaaagcagttttatgcgattgtttccctgctgctaacaaagatacagaggtttcctcagattcaagtctttagatggccagccacaccccagcctctggcctgtttctcttgttctttcttttctgtgtgtcactagtatctccccatcacataatatgcagtcatattttggctcctaccattcctaacaccacgctattgatttctctggcccttgttggtttagattagtgaccttcaaccaaacccagcggcctttcctaatttcttattcctttggttttctgcagtaatttgcaggtggtcctctcctgcttcctcctagaaactttcttccacttaccatttttgaactgactcgatccttgtttttctcctcttctgactttttggcctcctatattctctttatgtccctaccattaagtgtgagtatcctccaagactgtgtggctccctgttgtttttcctgaaacatttttgcatttgaagatgttggcctctcctagaatgtcactattcctaaactcagaggcttttccctaacctctccttagagatccaccctgcatttctgtttctaaactaacataatcattcttgccctctcgagaatagagtggccctttcttctgacagacatgactcagcacgcctcattgcacttacttttcccctcggctttgaaccaaaaatatccttccagtgggcttgaaaccttcaagttgctggaatccttccctggctgtccccacccctttgctgatttgatcctcaagtcctgttagttcttcttatagttacctccattatggccccttctcgatttattcactttagatgttttctaaaatgtcttgctctagtagatgaagacttagcttatttacttcaccccctgtccaccagccttcctcccaaagtcatcataggcacactgggaaatactgagggttcacatccagaccatcccaagaaagtgagtatcccagtaaagcaagtcacatgaatattttggtttccaagtacatgtaaaagttatgtttacactataccttagtctattaagtgtgtaatagcattatgtctaaaaaacaatgtacattaattgtttaaaaattaatttcaatttttaaattaaaatgtaaaaataccttactgctcgaaaatgctaatgatcatctgagacttcaaatcatatgtgatcttctgctttttttttttttgagacagagtctcactctgttgcccaggctggagtgcattggcatgatcttggctcattgcaacctccacctcctgggttgaagtgattctcgtgcctcaagctcccaagtagctggggttacagatggcaccacacctggctaatttttgtatttttagtaaagatggggttttatcatgttggctaggctggtcttgaacttgcgacctcaggtgatccacccgcttcggcctcgcaaagtgctgggactacagacttgagcccagccccataatctttttgctggtagagagtcttgccttgatgttggtgtctgctgagtgatcaaggtggtgggtgctgaaggttggggtgactttggcagttttgtaaaataagacaacaatgaagtttgccacatcaattgacttttcctttcatgaaagatttctctgtggcatgcagtgctgtttgatagcattttacgcacaatagaactgcttccaaaatgaaagtcagtcctctcaaatcctgctgctgctttatcaactaagtttatgtaatattagaaatccctggttgtcatttcaacaatgttcacagcatcttcagtaggagcagattccatctcaagaaaccatgtttctttgctcatctgtaagaagcagttcttcatcccttcaagtctgatcatgagattatagcagtccagtcacttcttcaggctccacttgtaactttcattctcttgctgctatttccaccacatctgcagtgacttccactgaagtcttgaacttttgacctttgggtcatccatgagagttggaatcatcttcttacaaattcttattaatgttgatatttggacctcctcccatgaatcacaaatgttctaatggcatatagaatggcaaatcctttccagatgttttccaatttactttgcccagatccatcagaggaatcactatctatggcagctggagccttaagcaatgcatttcttagataggaagacttgaaagtcaaaatcactgctttatttatgggctacagaatggatgttgtgttagcaggcaccaaaaaagttaacttttttatacatctcattcagagctcttgggtgaccaggtggattgtcaatgagcagtactattttgaaaggaaatctttttcttttttttttttccctgaaaagtaggtcttaacagtagggttaaaatatttagtaaaccatgctgcaaacgcatgtgctgtcatccaggctatgttgttgtagagcacaggcagagtagatttagcataattctcaagagccctaggatttttggaatggtaaatgagcattggcttcaacttaaagtcatcagccaccaacgaaagtcagcctgtcctttgaagctttgaagtcaggcattgacttcttctcccttgcttgagttggggaaaacagttgtcttcatatataggctttcaattgagataacactgttcagccctacttctcattttcaccctttactttacttggcttaagtattccgaacctttgtgtggtcccctgtgacaactgcttcctctgtgtctgtactctttcagagtgactcctgaccagtgtacttgaactaccgggttgtaacccattagagaactcatgaagtcatgaaatacatgtagtggcttaagattatatgaaaagaatagcttagaagagaacacgtcagggtgccctgcacatcgtaagggtaaacactgtcttgtaaaatttgttttagttataccaaaacacagacatatatgtagatatgtattcgatctccatgtaaaatgtactttttactgtgggttgaggtgaaagaagttagaaaaatattttttaagaccatggcttgcttcaccctgttacaacagtcagggtttctcggtgcactttgaatctctttacagatttgttgaaatgtctcttgtgtgtttattaatggatgatatgaaacatatttattaagctgtgtagaacaggtctggatcaatcagaagggatgctggagcagagaccctgagttctccagctttgtcaaatgttaactctttataggattgaggagatgtcttagggggcccagtggatgggacagggagatccaccagtggaggggcactttgggcattgggatagtagctcttcatcagtacagagtatttaaatattttaaaccaccagtgtggctgtacgattgcataacagctagatatgaaccctggatttatatctttttaatttcttacctgtaactttaagggtatctttggaggaaggggaaatatatgggtgcccccgccaaccactttgaaccagaatccctgcagtttgtaatctaattttctcttcaaaagtttagtcccccactttgaaaaattacggttacattgctgtgactaatttgatgttcactggtgatagtaaagcttttttttctgagaggagggaagggaggaggaaatcccaatttaaatggagagagactttttcctgaaatactcggggtaacagaaggaaaggaagaagtaaagaggatatgtatttgtaagactgcaacgtggtctgaagtggaaataactgtgaataatgaaattagaggaaacagtggacaccaaccacgaaggagaaagtgaggaagagagtgtaggatagtgatttcatataatgcttgtaggatgagtaatgggacagtttcctctacttgcctcagcaggggtcctgtccgtggccttgcttctgtctctggggggctgtggggcagaggggcatcagcctgtggggtacctgtgcacgcacctcatggggggaagcgggagaaggtaagggagtgggggcagctgtgtgtagctccatatttgcaatgtgtttgtaacttgaggaatatgtagacagtggtggcacttaactactgatttccttaagttagtgatggctgagggctgttaacttaagttctagacctagtacagcttggttttacctagtttattacatttctgttacattcagggaaaaagggcccgtccacatgtatgctttcagctcgtttcttgtcctccgcttcctcaattcagaggggggacaagagacaacctcaagtagaaggcaaaccccatactcttacttttctggctgtggttggggcacgaattaggtgcagtagcccaaggtctcctggaaaactgggttttcctttcctgaataggagctagcctgtacatctctcagcgggtcagagtagcatggtgacagggtggcagcatggccggagggcaaattgcttccgagatgcggaggattcctctttccaagaggctgatagaagagacttgtggttcttatcagtcactaccagatgtgtccagctgtttcacttgctgctctatcccaaccaaacacacttaatgtcaaaacaacacttacatcatcaaaacaaaagtgttcacaatgttaagcctcaggcttttagtaatttagtcattagtctggtgacaaagggagtgcccttgtgtggtattgcatctgggaaaatccaggcccaaaatagattttccaggctttcctgagaccacagggtttaaaggggtagacccagattactgactaagagggaagcagcctaattctagcctcttctattcctttatctctcatgaatgccttttcccacagaatagctcatttaccagctccaatgagaatgaatctgatagagtgagactattcaagtttcttttactgcttttgatatgagacattgtacggtggtgttttgggtggcttgacaatttgccttttgcactgactgccatggcgtcatttcttccccttgttcagatagtcagtccctccttaggatcggtattttgggtcagattacattagagagcatgttcccttctaaaagctcagcttgctgcaaaactgcactgtcctaacaatttcagtagcaattttgcatattctggaattagttggtatatcttctttatatttttcattcctcttcctcagggaataactgaatctgggcagaggcttattttaaaatatgaattagatgcagtggaagagaattgtcacagaaaacaagggttgggccaggagggttagcacatagtaatcatgttcagaagttcccagaagtcttgactcgtgctattaaaaagataatgagagtataattataaaacatttaactcaaatagtacaatttatattattatgagacacagcataaaaaattgtttccctaaagcggcatcgtaatttatatttcaaaaggaaattaacattattatgtttttagtttgcatttgttcagatttttacagccacttttttctcagctcagtgtcgcagagattctgcagtacagattaggtaactgaggcttaaagagattaaccagctaacctttagcattaggcagcgttagaaggtcccactgtatcatacagctttaattgtttatgattgcttttgcttaactaatacaacatggggatttcttgcataattcccttcctgtactttcttcgctatttccccccttcccatttccagtgctgcacgcttactaaatatatacctgtctgtgtaaacatctttgtctttattccctttttagagatggggtctcactcttgtcatccaggccggagtacagtggtgcagtcatagttcactccagcctcaaactcctgggctcaagcgatcctcccatctcagcctcctgagtagctaggactacagtcatgcaccatcattttcttaaatataaatgccatgtttttgtgtgaaggcttatggcagttgtgctctgaatcctctgataaagttacctgtgatgacctatttatcatcacgcttcttaactagacaggcaggatctttttcgtgaaggacgcttctgagcgtaagccatcatttacctccttctatgtcatgagtggtcagcgacagtatttgaaggaaaaaaaatgagccttgcttggaattgatgctcctttctacatttaactcgttgcttaccctttccttattagctgacttttaaaagcccattatttaattccttctctttattttgtttcttcccagagtgactcctctttcttcccagagtgtggtgattcaccatggccagacccaggaatacgtgctcaagcccaagtactttccagcccagaaggggatttcaggagagcagtccactgaaggttctttccctttaagatatgtgcaggatcaagttgcggcaccttttcagcgtgagtatagtcttatcaaccattttcccaagttatggtatcagagattggaaacactttgttcagtgtagacggctttaatgtgtcacagtaaataaaattcaagagtcattaaaaaatccacattggttcctgaagcaaccagacagcagaaatttagcatggtttccttattctgaggaaaagcagtttttcctgggttttggaaatgaatccgaagtgacctgcctgtcattctgtttctgcaatatggcttcatgtctaagacatatttgctctaactttgggtccagtcatatgtctgacatgtttacattgatgcaatattttctttagtaagctagccaggactcatgccttgtgaaacgtctgaaatgtcctgcatagctctctgaggttctcctacagtggatatttttacattataagactcacctagtttttagtgtatcaagcagctggcgtggcagatttctctgaatttgtaaagcgctattgtatcagtggccagcttggttaatatctcgctatgtgggaagctcaaggacaaggcctggctcaaagggtggggaatgtgatgatttgtggtttaggtattacagagtgtctgccggcagcatctggagaaaacgttctggagtaaggcgcagcccatccaaaggcgagagctagacacacgctctcgttccagcagcttcctgccctgtcacatgttgactgattgcctgcaccataggtaatgaaagagaatgccagttgtgaggtgggaaaaggaccatctttcaccactgggaatagtatgaagagttgagatacagtttttactactgtttggcactagtgaagtccacatttgttgtggctttggttccctacacccactccacctccccgtttctgtactgaatctaaagtgattgactcttccctcagaattggtcatttaacaaaaagagtatctaacagcaggtttgtccatccactttttgtcttttgagaaagtcctgctcagtgaccggtggctagaccccagaacaatagtttggtatggtttattgggatgttgaggaaagtgagccctggggatcttagggaagaatacagaaaccatttagatcattaggaaaaaatcacttccaagtcatttgcaaaagaatagatgcatctatttgattcttaaaaatcctttgatattcgtacttaaagagccgtttctcttaagtgaatatttcttgagtatatgtgtaatatttttctaatactaattttaaaaattaaggaaaagatgtacttcttatttccttggggttttatacagatgacaatttttttaaaagatctcccaaatcagagtgtgatgggaagagagattttaaagtttatgattatactgataagagaagagaattctgaattatctggaggtatcaggaaaagatggttagagaacactggtattaagactagagactagactgtggttttgatttgttttctgtgatttgttattggaatgaaaattcccactgtgtgtgtatttccaccctcgtgtgtatatatgtattttaaactctcaaatcttggttgaactgtgttctgaaagatgaaattatatcttagaagaatgtgaagataagtttcttatctgttctgtccatatctttcccgctcatcctgtttaaatatattttctacatagtaaggagctagtaaaagaatgtagactaatatacattatcacagtggtggtgttctctgctcaaaccccctaaaagatggctgttgttcagaaagaagctcaggaattaactgaaagagttacgcatgtaggaaagacaagaagggagatgtggctatttttgctgaggccagagctctactgagagctggagggctagttggaaagtttttaaaagagataatttggcaggaccatgaaggatactgaaatggcaaaatggagtaagaaccacaaaagatgattaaaactggaaaggaggtacaggtagtaggagggacctaaacatactgtctctgcatactcctgttctgtggtaggtaaaagaggaggctccaaagaagccttacatggaacagaaaggaaggaacagttagtcagagaagtctgaggaaaagcagaagcttttatagcatcttcatttttatatttacagaagagatcaaatgcaaacattaattttttattgtgctgaaagatttgaaggtcaaacagaagctgatagctctgattctttagaaaaatagaagatactaagatcatttgagcatgatgtatcttggagtgaaattgaagaagtgaggtatgtcattgtagtccactgccattacttttgagaagctatgggaactagagaagcggttgaaaactagaggttggcaataacaagtgttatcttctccctttaaaagtgattaaaaagggggtctacagtaatgaccagttggtatgtttaatattgatatattacaagagcaataataataatgcataccttgagctctaagcactgtgcaactcttagctcataataggagacagtagtctacaagcccaagggaataaggatttgctctcgacacttggtaagagaaaaagaacaattgttttgaataagcaggaaagagatgaggatggaggtgatggatttagtagagtaaaatacattaatgtgtcaaacgcagcactctccagataaaacattgtagatagagagaaactaaccaagttgctagtgaggtgctttcttttgggagggatgactattttatgggattttcccacagttttgataatacaattcaccatccctgtccaatgtgtacacactacttttcctaatttgattctgtatatttaccagtcttcttagtcactttctaggtaacttgacatcctatgttgggtgttctctggtcattggtaaaggatatctcttttttttcccagcttcttttcaaagttcatccgtgttgtagcatgtatcagtatcttattcctttttatggctgagtaatactcccacattgtatagagatatgtatctcagtttgtttatccattcatcagttgatggacatttggggttgttcccactctcttggctattatgaataatggagtgcagtggcatgatctcagctcaccacaacctctgcctcccaggctcaagtgattctcctgcctcagccttctgggtagctgggattacaggtgtgtgccactactgcccagctagtttttgtatttttagtagagatagggtttcaccatgttggccaggctagtctcgaactcctgacctcaagtgatccgcccactttggccttgccaagtgctgggattacaggtgtgagccaccatgcccagccggtaaaggatatctctagtgataaattaataacttgtggtgttctgctttatttgttggccttaaaagaatttaatttgcatccgtatcatctagagtagggattggcaaacttttagggagtactttagactttgttagccaataggcaaatcaaggatcttaggtagatatttatatagctatttaacatgtatctattaaacgtgtaaatatccttcttacctctcaggttgtagatcaggtggctggatttggctcatgggctatagtttgccaattcttgatctagagactcacagtctctcaatccactgaaaacatctagatatcggacctgattgtttggtgcctggaacgtgacaaaagcagcccaagaggccctgcttctagcagctgtccttcattctcagtgtccccaccaacccaccctccagagcatgacaattctcggatacatttccacttagtttgaaggcacccagaaaagcatgaactaccaggaagctgcttgtgttagataagtctagtttcttttaattttagaataatgggccacacagcaattgggaaaggaatgggatgttactcctggttgcttatagaaaaccttttgatattggtggaaatatttttatgggatgaagcagtcccagccatatcacaacacagtatcacattaagatactgcatgagtttctcaaaaaagttaaatatagagttatcatataacccagcaattccacacctagctatatatccaaaagaattgaaaacatatgtttgcacaaaaacttgtacatgaatgttcatagcaacattatttgtaatagccaagagagtgggaacaaccccaaatgtccatcaactgatgaagggataaacaaacagatatatacacacacacacacacacacacacacacacacacacgtatacacaaatatatatacacacatatatgtacacacacacacacatatatatacacacacacacacaatgtaggagtattactcagccataaaaaggaataagattgatacatgctacaacatggatgaactgtgaaaacaagccaagtgaaagattccagacacaaaagaatccagactacatgctatatgagtccatttctataagatgtccagagtaggcaaatccacagacacggaaagaagattagcggttgccagggacaggggagagtgggaatagggaatagttatttataggtaagaggtttcttttggggtgatgaaaatgttctggaattaggtggtcatgctggttgcacaacctgaaaacactaaaaataaaaaaactgaattatacacttaagggtgaattctgtggcatgtgaatcatatctcaatttaaaataacaaatatttatgaaaaattattgccaagtaggtagttatgagactcagtttcagctccaaggaattgagctcataagctctcagaagtctagggatggtgtggggtaggggtgggggtctgctttatacagtgttttcattggtgacttgtaggaaagaattcagcatgtaaaccaaattctattgtgtttagtttagtaattttttttaacccagaggaagaaaatggaaatgacataacatttggaagaccatcttataaaaatggtcagtcaagattagaatagcacatgttcaggagcaaacccaagtaactcagacaaaaagagattagtttgacataacctgctagaaaaagtccttgagggtataataagtgtctacatcatactatgtgctgacgtagtaaaaatgatatggaatgctttataatattaaagccagcaaataatattttaagtacagtctatggtggaaagaggtgtatttatcatcagggttataagacaccaaaggacttactaagatagattgtagagctacttataaaggagatctttaggatgagcagcaatggccatgtaactgacatggttccctagacgactggtttccagactgtgcaaagaagaactaaaagattagcgaagctccaatttaagcatttgcctccttagtccctttttctactacataactttaatatttggaacgatttagaaatctgaacttctctaaattggatttctcattgctaattccagttgtcgttctctcaagatgggcttaggttttaaataggttacttatatttcaaagtcatctaaagttttagttctttaaattcaacaaggcagaaattttacgttttaggcatggcagatgtcatgttttatacagtaacttcttaaaggtctttaaacagatatagctctggctcttaaaaaaatgtaccaatttatctcctgatgtgctaacgtgggggagaaagagagagagaaatgactggcatttgcaaacacataatactgttaaattgcaaaaaaagaaaagtaaggacaagcccactgtttacttaaagtgtaaacaatttcaggaaaggcagatgtcatgttttatatggtaacttcttaaaaatctttaaacagatataactcaggctcttaaaaaaattgtctagttgtcatctgatgtactaacatgggggagagagagagagaaatgactggcatttccaaacacacagtaccattaaattgcaaaaaaaaaaaaggaaaggaaaagtgaggtcaagcccactttttacttaaagtgttaaacctaaccttttttgtttaaataagcaaccgtagaagtgaagaagcacgcacagggtccctattaagtgacttctgacagaagaaaatgtaattcccacctgcagtggcaccacaggagacatcttagccctgagttctggtctgtgctgccctctctcagtctttgcaacaggctggggcagcttgactcccagccatcaatcacgggctgactgaaatctggcacctccatttgcagatagaacagctccccaggtctcctgagctctggtctgagacagatgtagagtctgttgttttcatagtagcagctttgtggcctgaactcctgaatcccagttctggcctgatcgcagtccatagttccacactaagagaagtacggctgctttggacacacgaggcctcttctttctaacttttattaatactatggttgaatgtcttgcttgtagcgttagccttcaggcttcagttcaggctgacatcgagaagcacggcaagtcacggaaacatctcagggtttgatggtaaatgcttatgtctccccttgaaaaaggaagttcacatgtctggagcgaagagtctttacggttgcagtctgataccacaaagaggttacccgtaagattgtctgggtcttcctggttgccctgagtgagagagcagagtgctttggcagagacttacaagagacattcaagatttttgctctgtcaaaacaaagctgaatgttaggagataggcaatatttaacacggacaggtctgcttatgccagccacttcagggaggtgggcaagaacgttgcttaaaggctctggatgcctagtgccagttacagaatgctcatgggaggtgtccctggcgtagttgagagcacccattatgggatggatgctgcaaaagacgggaaaatccttggggtggcaactggataaaggcagatatagtaagtgtagatgaggggaattggagcaacattcttacacatgggatgaattgcaatctggagatcttcagaggaggagccatttgaaaatgctgttgaggaagagtctggtcctgagaactgttgtggccttaatgtcgatgttgaagtttaggatatggatggtatcacactcatgtgaagagagaacagaagcagcagcaggagaaatccagggtttgggcagctctgctcctctgagacatcctcgctgataggtcctgacagattgggagccttacagggcagagctttgcagatggaccaagtgggtccatgggagagaagacttccagagaacatgtttgcagcattgaaagccctccctacatggagactacctttaacttgtgtgcaaaaaaaaaaaaacaaaaaaaaaacaacaaaaaaaactgtctttgggattggcttacaccaacccagtgggtactaaaaggcagtggaagttggaccagccatgaatgaccttacaagagctgatgaaaaccagcaaaaactgcttaagcatttaagaggaatattaggtgtgaaaacaaactgttttaaagaaggaataatgataaagctttgtgctttttccttgcaaaatcagcgagttccttaagctccttgtcccatgctcaattctgtatgggaatcgggaaccttgagccagtttcccaactgtatgatcatgtggatgttagtactaaagattcctgaaagaaaggcgtctgcttttcaatgatttctggcaaagtttttggtttgaaagcctagacagtaaaactacattataaccatgtacagactgacacctgagaaggcattctggtgaatgtggatgaacagggttctgctgagctggtatccttgggaatccagatttcattcaaggacaggatatgatctattgcaaagaaaagttcatgagcagtcttgccatgcacgttatcctgggttagggcgtggaggggaggatggtatatctgagagctatttgataacattccagttcagggaagccgtacgaacatgattattctctttgccccctgataggccacacgaagtttaagatagctgtgaaacagtagatatggattggttataaatatttccaagaaacttacccagcaatatgaaaacagcaaagaagaaaaaccttctagggtgaaggatcatgtagtttaaattcctcgatgagcagccttcactaccagataaaggttttagttataagggcccaagagtttataagaaacaagcaaattcaaggacatttctgggtgttgagactgattttaagaaatcaatactgtatggctccagaatattctggagtcagactgattttttttttccctagggaaaggtaatacaaatgaatttattgtttgcatgtggggaaactgtaaagcaaagaaaaagaaaagagatggtgcctcctcagccttaggatacctttgccagaaattgagggttttagttgattttacttctggattgggaaagaattttgaggaaattaatcattattagaacagaaatggtagctttgattcaaaataaaataggcccacgcaaaatactgctcatgagatgtttcccagggacttaaagtagaatgctttgtcttctcatgaattagattccttatagaagagtccccttaatgttgaaaatgactgcattggagtaagtccatccccactttgacataaggatccataaatacctttctttctttcttttatttttgagatggagtctcgcactgtcacccaggctggagtggagtggtgcgatcttggcttactgcaagctccgcctcccgggttcatgccattcttctgcctcagcttcccgagtaggctgggactacaggcgcctgccaccacgcctggctaatttttttgtatttttagtagaggcggggtttcaccatattagccaggatggtcttgatctcccgacctcgtgatcctcccgccttggcctcccaaagtgctgggattatagacgagagcactgcgcctggcctgtaaatacctttcttatattttatatgtgacatttcttaaaaagggctttgtgttattttctgtgattttagttctgcattgtttgtttttgaatatctcctgaatattaaccctactctggctgccctaatttcttttcattcccatacaaaggaagtagaagttaatacatgactggagaacaactttctttcctaagaggtagttgcagtatggttatattaattcttctgacaagcaaactttaaatcaagaaatacgtacatgtatatatgtatgatggctgtgtgtatatatacacacatatattcaatcaagtatatatgtgtgtatttttttaacttttaggtttaggggtacatgtgaaagtttgttacataggtaaacacgtgtcacggggtttcgttgtacagattatttcatcacccaggtattaagcccagtaccgtagttatcttttctgcccttctccctccttttaccctcccacttaaagtagaccccagggtctgttgttcccttctttgtgttcataagttcttatcatttagctcccacttacaagtgtgagaacatgtggtattcggttttctgttcctgcatagtttgctaaggataatagcctccagctccatatatgtttctgcagaagacatgatctcattcttttttatggctgcatagtatttcatggcatatatgtaccatattttctttatccagtctgttattgatgagcatttagggtgattccatgtctttgctatcgtgaatagtgctgcaatgaacattcattcacgtgcatgtgtctttaaggtagaacgatttatattcctctgggtatatatccagtaatgggattgctgggttgaatggtagttctgcttttagctctttgaggaattgccaaactgctttccacaatgattgaactaatttatactcccaccagcagtgttgtatgtgtattttttaaagtaatttttttcgcaattaaacatcatctttattaagcaaagtactatgctattaaaagactacaaaacttcattagtacgtggttgactactcagacttacatgcagtttcttaatatttagcatggtatgcaagtcaggaaaaataattcccaaatctctccctgagtaaatataattcgcatggagctaactttggtgattatcatcgttatttctcattagatccactttctgaccacttaaatacattttcctttagttctgttggaaaactttctaattagtctgattttcttcagtggaaataaattttgtaaagtcttttttttttttttttttttttttagtttcttacattatccatacaggaagatccattaagaaaaagtcttgtagcccaaactgcacttcacaagtttgcttttccaaggttctagctttttttcttactgaatgaaaatattttaaatatgcagtgttttgtgaaaaacatcataattacttgtaagtccttgtatcctataaacagatttagaaagctttggcgagagaaagaaaagcatccggagagcaggtgaaagggcggtggtcgttcctgtgttgatggtatctgggcttcttgtgtgggattgagtgctcttccctaacgaggcctggaagcacaggcacccaccagctgggctccttgtttaaccaacaccccttaatggctacaggtgcatctcatgagtgcaactgcttcactcagatccagcagaaaccaagagctcttcctcccacgctttcagcttacattccatggaggagctggctggagcgcgcatctgctttactttagaaggttacggcgtaatcctcccccaaacaaaatcttttgatttatatttttgcctttattcgtcagtcaaaaatactgtactgaccttttgtgattcggttaggtacatgctttctggtccaaagagtttttttttgttgttgttttggttttggtaactgtagaaatttaatgaaaagcactttcgttagtctttataggagagagaaggtggtggatatagttttgttaagaatgattctctcaccaatttgactttctcccctaacattttattcatccgagaataaataataaacatggtaaatcgtataatatatgcatagttctttctagttcttccccccaccctgcccccctccacacacacatcttgtcatggcttcctgtgggtatagtggattttgcgtgtccccttgactctgggcttggccatgtgacttgctttgaccaatcgagtgtgggtggaacgagtctatgggttcggagcgggagcttcgttcgagaggaattgcgtatttcctctcttccttcttctaccatgaaaaaggcaatgcctctggtctgctgacctgccaactcccttgaaatgtgttgtttttcctagattaccatttcagcagggcagatttactttttaaaacaatctggacaaatcaatcattagtcttagaacagatgataactattgtaatcagacaggttaccttttggtaaaagtgatactatgggtgacctcaccttctggccacagtggactggaaagcgggtgggcagttgactcaaaaccaatctgaggctggccagctgcctgtaaggtggcctggcagaggcactttcccaaacagggatgatgttgacgaaattagattaatcagaatctctcttaaggaattcctaagttagaattgaacagtaagtatctggaacagacgtataataccaaaaagaaacagaagtagccaatcctaccacgttaatgttgggtacaagaatgaagttcaacagcatttctgaaggggagtagggatggggcagcatatagtggggttgctacaagtgctgtggattctgaacatcttttcagttactgaactgtgtcttagcctccatgaggtttggcttatatggccagctggttctgcgttctgggttctcttgagacgtctatctccttcttgctgtacacaaccgcagttgaacatcctgttgcttgagataatgtgcacccccttgttttgtaggcaagagacctcagctaatacaagttctatttctactctgctctctaacagctgcatgtcctgattacacaaagcaccaaagcttgacttctagagagggaaaacccagctgctcaacttttcctcactctctttatagcttttcctcactccctttatagctcttagtcctgtccacattccctctttccacatagaaagaggagtgggtgggtcagttccatcagttccctgagacccctgcaacacttggagaattgttctgcctggcctgcgggttactaggacctgatggtattgctgtattcatgtctaagcttccactggaatttttaacagaaacattctcaggtctgggggattcttgcccacatggaatggagaatgttcaccttcagtcagtgagtgtggattgggaaaccttttcagtaagattcctggaatcctatcatgcctcctgttcattcatcttttttttttttggtatgggttttctggcaaccacaatgcagtatgtgtgtaagtacatagcaggcatgctctgccatgtcttgaacatggaaatctagcaaaattagatgcctctctttgaaagggtttttcaaagactattaatggagaaagtgattcatggtgtttcttgtcagagatcccagtttccaaaccacatcttaatataccttaagaacatatactctgagcaagaaaatacaaacagatgtgctgaaggcattgtgaattgtattcttgttatcaaagatcaggtagttaggaaatttggacataggcttctttgtcccagcaaagacatgaggtaagttccaccctcctcctcctcatctatttagcactttctgcatgccaaccatggtactaagcactttatatgcattaattaagtatgttacattataatacttgtatattacttgattactacttaaaatgcattccttaagttaggaaccaaaaattgaatttaaaattacagaaatcaatcttattcattgaaaaaaagtaccactttagctctttgtgtaagttatctttaggcaagtgcaaagtcaagatttgactatattttagatattttaaaattgtattatattttagacttttaacacaataacatgttttaaaaatttgttatgtgactatagagctgctaacaagaggtgtttagcttaacaaaaattactcaaatgcggccaggtacggtggctcacgcctgtaatccaggcactttaggaggccaaggcgggcagatcacttcaggtcaggagttcaagaccagcctggctgacatggtgaaacccccgtctctactaaaaatacaaaaattagccgggcatggtgctacatgtctgtaatcccagctacttgggaggctgaggcaggagaatcacttgaacccagaaggcggaggttgcagtgagccaagattgtgccactgcactccagcttgggtgatagaacaagactccgtctcaaaaaaaaaaaaattattcaaatgcagagtaaacctttctaatcagtgggttcctacagctggttgatgttcattatgatacctgtcaaacaaagtcaaacaatcaggttgtatgtggaaattatggtggaaccaaagtccacagtagaatcttgctttattctagagtctttaataatagttatgatctgaaagcaaacatcttaagatgagaattttcctagatttagaagtggttatagattttgctgtgtagtatatcatggtttaaatgtcactactggtttgagcttttctaacagttgctccagttaaaactgaccatgtgtaagtattttttctttgatttgcatagagttttacagcctataaattatatccatacaaattatttcacatggcccctgccacagtcttgtgaggtagataggttggatggcgttattctgagtgtgtttttaggcgctctggatttcaacatcctaaagggtagaacctgtgggtggttttgtattctttccctttgaacttcttattatcagtttctttgtcttccagataaagatcttaagacttgttctgtaggagtgttgtgagaatgaagtgagatgaagtctatataagatatctcgcatactgcagaacacatcacataggtgctcaatctatgcttgtttctctctccctcatcctaatttcccaagcgtatagcattcacattcctaagtgtcatatatttttcatagtaatgctcattacaagtgtaggagaggcattggggcgtatcgaggaaagaaagaacaagggcttgcattaaaatcccagcttcactgttccctagcagaatgaccgtggtcaagcttctggtgaacatctctggtttccttgctggcagaatggatatgactgcagcttacatgattgtcatgtgtatttgctctctgcagcctagtaggcactcagtccttgtctctcgagtctgccattcatgtatacggtgcttttgtgcatttagtatcgtccataatttctgttgttctcagaatttgggccaaaaaaaagcagaagggaagaagaacatgttatgtgtgtgtatgtttatgttagttatcagttgctgcataaaaaattactccaaactggccgggcacggtggctcacgcttgtaatcccaggactttgggaggctgaggcgggtggatcacgaggtcaggacttcgagaccagcctggccaatgtagtgaaaccccatctctactaaaaatacaaaaattagctgggcgtggtgcaggtgcctgtagtcccagctgctcgggaggctgaggcaggagaatcagttgaacccgggaggtggaggttgcagtgagccgagatggtgctactgcactccagcctgggcaacagagcaagactccgtctcaaaaaaaaaaaaaaaattactccaaactgtagtgatttaaagccacaaacattaccttagagtttctgtggttcaggaatttagagggacctcagttggttggttctggctcagtttctttcatgaaattgcaaccagggtatcagtaagagctgcagttatctgaaggcttgactgggcctagaagatactttcaaggtggttcactcatgtgactgttggcaggagatttcagttctttgccccatgagtgagtgtctccttagactgcttgagtattcccgtagcatgggagttggcttccccgagagtgagtgatccaacagagacagaccacgacagaagccacagtgtcttttatgatgtagtctctgaagttgcaaagcatcattccatttttttctgttatttatttattttttagaaacagggtcttgctatattgccagggttagtctcgatctcctgaactcaagcaatcctccccctcagcctcccaaagtgcagggattacaggcattagccaccatatctggtttgttcttagacaagattcacaaaaaccagcccatgtccaaggggagattagacttttagatttcacctcttaaagatagaagtatcagggaatttgtggacatattttaaaaccatcacagtgttcaacagaaggggcactcttttgatgagagtcaaaggaaatgaggaagctgaaaatgggcaacctaaaaagaattagctgacagctggaaaacttagagtgtacaactatacatcagtaatttttttattggcaactaattgtttttcaattttatttatcacataatattggagcatagctagctatatatgatgattttgggaaaaggatattgaggctgaaatctttcctaatgatgagatctattgagtttggccgtagtcccatagggggagtagttggggccattggatgcagtcatttaaaaactgagccagagagaagtttgtattggaaaaaaaaaatgaagtaaatgacagaatcagtattctgcaagcttggattctctgagactctaattttaaattaatttagagattttaaaatgccaattttctatacaactaagtgcttcaacagatttttgtctccattgaatccatgaaacttgagagttgttttggccattgcaaaaatgttcatatctttgacttccttggtgcttcttaaaatataatgcattcaagttataattttatttttgtttgctctggatttttattgcttgtgtgaaagaattggaatcccttagaggcacatcaagacatctacttctggcctggcagctccagtgactcagaatgtgtgttcagagcccaggaggttttggttttcttctctgccttgtcttttgactctttttttttcttttatgcagaatttaaatttcgtgaagtgtaataagtcatttccttcactatgtctgcctcggtgtcggaagaaaattcccaagccctctttatgaagatggtagaagcctgaggcattcaactcctttaaagttttgtgacttccagctatcagttgtttgagtaaaagtcatttctctgcctttcacattgtctgcccttcctgttgctttcccttcccattgtccatcttcccatggattctcagcctcagttcataccaggcctcttcatttccaacccccgtattccattcccatgacactcccctcttaccacattctctcttccagtcctaaaaagagaatcaccaggtgggacatttgttatagatagaaaaggaggataagaatatagactattttctttggcctgactgaggccaaaggaaggtgggaaaagtggagaaatatccatagacgtgtctgcaaagagtcaagagacaatggagggttgaaacatttggttgtgcctaggtcagtgaaaatcatggagggaaggagtattttagttgagtcaaaagggtggaatgtggggaagaagaggaaaaggtttttagggaaaggaaactgcatgagtgaggtgtctgagtggggacctgtggacagcgtggcttggctcaggccctggctttacatggagatgtggtgggaggcgaggctaggttggacctaggtaggaaaggggcttactttcccttaagggagtttgattttgtcagaaatatttgtcataacaatgatataggatcctaattttcaaagtgtgtggtagagataatttgggaccctcgagaggaatggccccctgtttagcttgtgagtaagccatcaaatgtgttccttggtaaacaaatagcccagtagatatctatcatttagtcagacatgcttctccacatacagataggtgttatttatagaaatggtcaaatgcctccatttacttgctctttgaaagacaacaaatgtggggataaataaaacctaactgtgttccaaaattaagggacagaaaatttgagtcatgtgaagcatatgtaacccactgtggttataaagagcctatgcaaattaggcagattgcatgcgtagtagagatggaagacaggtaagtgtgttgattgctctgctccttattctgtttacagagagcagtgaagtcagtcttcttgtcagttgcacatctgcacatccgggtcctccagccacatggccatggtgtggaatttaaagctgtgctgctgcgaagactggcatagaatctttgagggaggtagctatttttcatttctgaaaaaatgtatcttttaaatggctttcccccttgggagacagactcttagagtaacatcttgaactgtgatgcccttcactctctctagttcccaaaaacccagggcaaactcattgaaccctcaacaagtatggctcccatgattgtcaggattctagattgtggctgtggattacattctcaattcagaattaggagattgggtacattgagctcttgctccccctttcttttttcctcctttttatgaacggattcaagacctttcttcttggaggatgtgtttcttcaactctcagtcacagcatttcaaatactactatcccttctggatggggcaatgctggtaggttctcttaacattcagaattaggaacagagaagggattgccagatgtgttctagatgagggatttccagatgtgttctagacaggtgagttttaaaagtcattttgaaagagacacctggaacagcctggaacagagacacctggaaggagacacctggaacagcctggtatggttctggagccaatgatggggaaaaaaaagtacagttggtaataaaagtggagaacgagcaaaaacaaatccatggctttttgacatgttcatggtctgtccttttttgtaaaatatttttctttaacattatagatcctgaaggggttcaactgtccaggcatacttcttcagtttagggatgcggaacacccagaaaagttcaggacaggctccggactgcagtccagggcagaggcgacagcacttgctgtcggcattccagtaaccagaggcagcaacagggcacacacctcagttctagtggacccagaaccacaccagactgtcccacggtgtctctttcaaaaattaaatatcttacacagattttatctataaagttagaagtttccatcatgtgtcaagatgattcttgcataatatgttgtgaaattttagtagcaagtaattttctgtttttcttttcaaaagtacttgagaaattgctatttcctattgcttattcagttattctctttaacatatttaattaaaaatggttttacttttaaaaaatattattggctattttttcgggtaaatttttaggggaaaaatgtcttttgtaaagatggcaaggtttccaacccgtaatgacttatgctttttcttgatctgagacttagatttctatcactgttgtagcaattgtttctctctgcctctttctttagttactcctgcctcagtaactcaagagatggagctgaaagattactctggattcttacctgtggaactgcccacatcagtactagtgatctcatctgagtttccttcttggagggttttccaggactggggctgcctggtgaagtaatagatttgatattaatttttatttacatagcacctttcttgaggaacacagagcagtctatgggcattattttaatagtccaggaggagttaagcaagcctggagagctgaacaataaagtcctgttattctaagcattatttaatatttttatgatttgtccttcaaagaattcttggccttcgggtaagcgatggactgcaagtgggagaatgaactgttagctcagtctctctcacaccctgaagagtgtacacgtgacttgtgtattgaatcagcctgtaggtctctttaaaccgggtggtggctttaaaccacagagaggttgcttcttcccagaggatattgcctgtgctggttggtccccattgtttaagttggatgcacgctaatgtgctgttgcggcattctggacgaatgctgaggagactgtatttgttcatgacatctgatgtgagtcttgaacttgttacatttatttctctgcttttggtcacatcttggtctgatgaccaaacaaggcaactgtgcccttttctagactgatgtctgtttgtcaagcacagttttcacatttttatatttttctctattgttaacaaccccgaagcagaaatgaaagctttttatcacgggaggaggggtatcggcttcacttccatcccattcaccattcactctgaatatctgtggtttgttttaaaccgagtgccagtgcctcttcttggaggtataaatttgcacagggtctggcagacgctgcagacaggatgttgactcttgagtgtcttgactgactaggaggcccaatggcggtgctgcatggctccaggcaatctgtgcctctagccaaggcctccaaaacccaaagttttaaagtgcttgcttaagattttgggggctgattcacctaaagggatctaaaaattgcattttttttcctccaaaggaccaagcacagaagttgtgccagtggtttccctgttaactcctgactggcctgatttttgcttctcagacttataattcctaatcacctggtaggtgccactcgggatggtcttctgcctctggttagtcctgagcttgttttctcactggtgcagcaggaccttagaccaaaatgacctccagcatcctgtgagtcttggatctctgtgggatccgacagtcacccttgccccatgcttcgggttactttgtctattccacaattattgggtgcctactctctgcaaggcatcaggagtccttgaatattaccttattcaagacatgcaaagaagatgcttctgatagaccaaatggcttttgcgggagagcttgtgtctactgttagtgaattcctactaaattcttgaaaggtgagtggtattgccttcagcgtgtcacatgtgaggaatttgaagctcagagcatggatctctgtttgatgaactttaaaacttaaactttttacactataccctaaatatgtgggaatgattttcaaggagtagagatgggagaacatattttctaatccatccagcatttatggagatcctgttagagctctggataataatctagtgtcaaaagcagtagtgcattttcactaccaattttgagaagattggcatgaaaacctaaagctaattataatgaagaagtaagtgcttcatggagatgggaggacccgcttagaatacaagtgtctgttttagaattagattactttatagcagaatgcttgtaaaacacaagcatttttatttttatatgaaataaaatatagcttctgcttccaagaagatgtgaacattgtaaaaatcagaattaagtcatatgaaactgtctctgccttttgaaaatccagatgattccaagccaaaagaaatttttttttggcaaagaaatataagaagtttttaataacaataggcccggagaatctccagtgcttataaagtgactactgtagctgggaggtgaaatgggaataatgattaagtgcttgctttctttggatgtctcagtttgcctaagtgagcataatttaggtgactgtgtgagcatctgtgtggcagctgctggtgctacaagttaatgccagagaagacaaaatagttggcacacggattctaatttcatgattgtaccaggagccagaaaaaggaggagtttatattcttttgaagtgggaaaatgttgtctctttttttcttgggtttcacacacttgaacacacaaagtatcctcaagatatttgtaagcattttccgacaacttagattataagctgatttgtttgtgctactgtgaaaaagcaaatcaaactaggtgaattttctctgctggtgaaatcaggattctgttgttttttttgaatttctaaggtagactcccagataactttaaaatgtcctgtaagcatttaaaggaggggttactgaagtgtttaagtaaagtttgattggaacacagccatgcccactcatttacatattgtttttgacaggctgctttccagctaagcgggtccacagagttgaataggaatagagtccttttcgcctacaatcctaatatagttacaatttggccctttgtagaaaaagtttgctagccctcgatttaaagtattgactgatagtagcatcctattggatgtcattttgcaaggtgccagaaggtctgcttggccactaggacatcttgccatttcagacaacatgtcttgatcctccagggttagaaccaccggtgaaggagaaactgtcctggaaaaccatttgaaaagaatggagggctttctcctccagaggaataatttttcttcttctaagtgagatgaccaacccagctgatgggttcaagtcctaattttagctttctttgattaagtggcatttatctcaaagataacttatttgaagggctgtcatgtggaagaggcattagattgtgaggccatggggaaccaaattaggattaatgtgtgcaagttactgtgaggccagatttcagctcaataaaaaatagtacttgctgggaactgccataactatcatgtgcttttgtgggtaatgagctgcccgtcactagagattttcaagtaaaggttacacgaccacttgatacgtggaatgcaaacagtggatgagagatggttgcgttagaaaacctctggggccccattccaaccctgaaattggaatggcttctttggttaaagttctttgtttccaagctcagcttatgaccacagttttaatttgttgagggtcttatagaggcatcttgggatgattttctgaaaatataatattagccaaaccaaagcagtataaagagagacaagcttttctggtgggcaaagatggtataaaaaaggctggcccagagcctctctcccctttggccactccagtcatggagtggcgtcagaagggcactgcttcttgacggccttaaagcctgacagatgactggctgtcttcagctactgctaccatctttgctttctgcctagtctcctggaaagaggaaggacctggctaggggcctatcgcagatgtagcaatcaaaacagtgtgtgtcttgcaatttgccagagagttcaggttgcgatccagcagtgaagggcaggtctgggtgaagcagaactgcacagagacagtgcagttctgccgtcatagcacaaaagcagccatagacagtacagaaatgaatgagggtggctgtgttccagtaaagctttatttacaaaagcaggcagcaagctggattgggtccctgaactgtagcttgctgacctctgatagagacgttgaaagttagaagtgtgtagaaaatgccagtttcaattctctcaagttttggaaaaactgaactgaactggactgaaatggcatgtccggagtcacaccgtggttgagctgggattgtaaaccaggatatacttttagtctagggcttattttgtgataccacatagcctcggctgtgtggtcaggtgatagcatttcgtttttaagagaaggccacgctaatgaaagaaagctccatccccagtggctactccaggtggtctatgaatagagacagtgagagcccaagggtgttatttttagggaggcaaccatttatccctgtgacctggcttacccctttaaagatgggccccgttcacaggaaaacaaaatatatgttgcctaaattcttatggagaaatagtgccctggagttgtgaaaaagaaatgggctcccgcagctgcgtcacagcatttgatcacttcagccgagagtgccaggagatttgagacagatgttttcagacatgccgcatgcctaaaacatttccaggggtcgggctgcaaatagtgacttaataagtggagaaacagggaaagtatgcaagttgaggacacaagagtttattcaccgctaggtgcacggccaacccctttgcattacatctgcctgtcagggttggctctttaatctgtcgtgccctcggtattgctctttgtctgcccgtgaataaagtgcagcattgtggttagtaatcccactccagtgactcgacttcaaatgtggttttggagtgcatcccagagttctgtttgctaagcttcctactcctgtttcagagacaccactgaatacagagcagcgagcactgaaggcttccctctttccttaaacctgtcgggttgtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtgggtgagttcctccacggtccctaactgtccttactgagtcgagttttatgagattgtagcatttagacaccccctccattcacactgctgtctgcttcaatgggtgtctgtctatgagtacgagtatgtttctttcatgggatcttttaaattgcttttggaataatttttaacctgattcttggtttcttaggggaatggcaactagaatattttcccttattgcttagcatttacacagccatgtggtaatgggaatatatatagtagaagagaagagagtaggttttagatttagaccctaaggcatgacttgtgctgataagcttcaaattttatcagcccagtgataagtggaatttgtcttagatttgactcatgtaataaattttggaaggtggtgatgaaatttgaagtttttacttcaaaaatagccaagctctaaaacaaaactccgaggattgtcaaaaacctgtacttggttgtagaaaaggatacagagttgcatcttttgccacgtttctgctccgtctcacaagactgaatataaattgatatataacgtggatttggggaagacagactggtagattactctcagtactccttttttacgtggatttggggaagacagactggtagattactctcagtactcctttaagttaatttaaatatgaagtagtagttgctgtctgcaagaaagccttgttggttcattttgaatttttgttttttacttttttgcaaatggagaaaggattgtggtccacggaatgctgtcatgttgccatgttgtcatgcaatacagtatttttgtcgcagaaaaatgtcttttattattttttgaccaattatggtttgccatgtgtactcaaataatcgcagacacccacgttactttctgagttactcacaagaataacccaaatgtcagacagataataacactggctagatctggtctttttatggaatattgctgtttagtcttggaagtgtgtgtctgggggggtggtaggagaaggggtgtctgtgtcaaactgatttacatcaagacaaaataaagggacagcttgaagttcttattagatctttgattattctgctgttttattgtgactcccaatccttaggaggtcaaagcatatttttgatcgtctgtacttggaaaaaatatgtgcccatagatacgatttaaaagggcattgtgagtttcctggctatgataggggtactctgggcatagtttttaaaagaatttagccattaggtgccaaatggcacattatgctttgcagggcagggagccaagtctaatgggaagtgaactgatgatcaggaaactggattctggtcccggtcctgccactaactagctaatccgtagggcatgccagttaatatttctgggcctcagtttttctcattcataaaataaatgggattgtatttaatgacctctaaaatttagtccatctctaagatcatatgactttttatcagcaataagtaatactattttctggcttaaaaaaatttttttttttggagggccacagacaaggaggggaaaagaaaaggcaattccagtagactatcatgagtctgatggcttttcaccactttatctttcttggttgccttccttactcactgctcctttccctccttgtgtttattgtaaatctttacagtagcaatgacaaaataatcaaatgggtggtaattttttggcttccagtgtattcattttgaaactaaatattttgaaggctttgagaaacagaggaagtctacttgttgaaacacaccacacactttccttgctggcactgaaccagatgtttaggaacagaatatacatagcctactcaaaatgcaaaatgaagcaaaattatttacaaaagcatttcaaaagcagaactccactctccatataggatcggcagagcagtttaattttttgaaaagtagaggatggggtgagaaggacccatagtaataaatagtttcacattggaaattgtgggaaacatttcatttatattctgagctatttccctctcctgtttaacgttttatttcaaatattggatagtttgagggacaatttttatgatatttctttctttaagaatggtaattttatagaacttatagactgtgatcctttgaaaatacagaaaaattcaaaaacgtttatgcatatatctttttgggactttactggtttagtgtaattttattatttgcaaaaagtgattttctgatttttttcttctctctttgtacttgtttatagaatactaaatcttttgacaaaaaagacctatttggaaaatagtttaaaatttgggaaaaattcaaaatttactgtcacttgtcagctactccctttgatctctaatatttgttggtacttaaaggtgagggctggcaaactctttttgtaaagggccagatagtataaaatatgttttagactttgtgggccatacagtttctgttacagctactcaaccctgccatcatcgtgtgaaagcagccagagacaatatgaacaagaataggtgtggctgtgttacaaaaacatttgttgggctgaatttggcttgagtgccattctctaaggagtcaacataatccagggaaaattatatggacttcataattagttttgataatcagaataacagaaataatttccaacatttgcatggtgatttacagtttttgtttgtttgtttgtttgtttgtttgtttgaggatgtggaacagacatgatcatcaccattttttcaatacggaaacttaggttcagagtgttaattaagtgagcttgctttagtttcttggcaagtcagttagctatgcctagaacctagatatccttatgccatctgttttcttacctacctggagtctgcccatgatgtataagagggacaaggtgaaggacctcatggagttgtgtcttgtgggaaggctggctgggataacagagagagagaaagcaactgagagtccagcataccggggctgaatcctggggtaacattggctctatgtgctctttgggcccagctcacctcctccacacagtgcaggtcctaatagatatgtggaggttgttcttttacaggcttgtgggataattccttccttccttcatgctgcttctgtgttggtcttctggtctgtgatgagggtgagtctgggctttccaggtgtgaaaggcagcaggtattttcgcatgactattgagcatgcagtctctgttcttgagtattcagtgggagaaataataagtataacttctgcttaatgcaactctaaaagtgaggcccaaatgaatatggtatccaaaggaagcactctgagattctagaagagcccatttttatggatagtgattttgatatggtttaacagaatagttactttaaatggtacttcctatgaagcaggtttctaatgataatgactttttttttttttgagctcagccttgctgtttgccccacccctgcctttttaaaaatggaaacctatcccttgttgggtgggctgcaggttcaccgttgttgttttaaaggattcttaacattttatagggctaaaatgcagatgaccttctgggatttttaaattgtttataaagccttaagttcctctgacaagaagaacatataaattcgtgtcacaactagaatatttcaaacacagtaatactgtcacttggtataacttatttgtggagacattgaaaagcagtcatgatggtcaaaataacacatttggtttatgtgaatctaaagactcatgttctattagcaccaattgaataattataaaaaacattggaccatttaaaaagtatgttctcttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctccatctcctgacctcgtgatccgcccgcctcggcctcccaaagtgctgggattacaggcgtgagccaccgcgcccggctaaaaagtatgttctcatacattatttcatttgatgcttactgcctcttcggcatatggtactatccataattggcaaatatgagccctgttgctttactggcttcattaaaggtggtttcagccaggttttcttatcctagagtcacaatacctctggctctcccatgttgcctcctatgaccatatattaagtgactatgtataaaacatggtagtagattttctaagataagcaaatcataaagctgccttctaacagcttatactttgaggaagagatgaagggtatatgtaaataaccctaaattaaggtagagagctgctagcaggcgcccagagaagggaaataccacttctagctgagggaggatgcttagagagaaaagagatggcatgcagcttttatgtttagttcaccttgctgtccctgcctagaaagcgtgttgtatcatggtgaggggctgagtagataaatgcagatggcctgattgtggactgaagggagacgtggaacttgaaacattggtaagttccaaagtaaagatgcatgggggagtagagggaagagagaagcaaagttgacatgggaaagaagaatttacccccctagaattgggcatggagatgtgaaagcagaggtggtttctgggaattgggaatagtttcacttaaatgtgggacacatgaaaggtaataatggtagatgacaggttgggaaggcagattggtgcaaggctgtggaacaccttgaatttcaagcttaggcatttggattttactctttgagaatttactaaagttctctgaaagaagttgatacttgtcattttgaagaagagagaagtgctttcagttttttagctaggaaactcatgttttaagaggctaaataagtttctgaatgaatgacaacctctggcatcctgtagctgttctggggcttgtctgatgctctgcactgaaaatcgccttggagatttcacaaaaccgacctaatactgtggtgctgggatgaagagcagaagcagttcgtgctgctaagctgactgtgtaggttctcctcacaaggagggaagaaaattttctctcgttaaggcattaaataatctgacataactgcttaagaggggcaagcatatggagttttttctggaaacttagttcagtcactgagtttctcatcctttgccattcgtcattgtttggactccttaatgtttgtctcacacagaaaccaatgaaaatgccatcgtgtctccctttcactggagaatgtattttcccattaatacattgtgcaggtatatctcaggttttaaaagatgtttcaatacaatagtaaaagaaagtggttgcttttcctccaggcaatttagaatgcctaagaacttatcaaagaaaccacttccacatacatttagctatatcaaagaattttattttctaatactgaataaatgtcataatgtagagcattttccttttatttatttattttattaattaattaatttttttttttttttgagatagagttttgctcttgttgcccaggctggagtgcagtgccgccatctcagctcactgcaacctccgccttccgggttcaagtgattctcctgcctcggcctctcgagtagctgggattacaggcacctgccaccatgcccggctaattttttgtattttcagtagagacggggtttcactatgttggccaggctggtcttgaactcctgaccccaagtgatccacccacctcagcctcccaaagggattacaggcgtaagccaccacgcccggtcttttcctttttattttatttaagctgtagaccacctttaaaaggctagtattaggaacagttattcatttaacgtgcatttattgagcacatactatgtgccaggtatgggggttcaggcaatagcagtgcactaaataaaagtccttgccctcctccggcattacaaaaacagtgtggctacaacgtggatgaacctcaaagatgctaagtcaaataaaccagtcacaaaaaaccaaatacagtatgagtccatttatatgagatgcctaaagtagtcaagttcaaagagaaagtagaatggtggttgccaggggtcacccgggtggaatggggagttgtttaatgggtatagagtttcaattttgcaaaatgaaaaagttctggagatttgatacagaataatgtgaacgtacttagcactcctgaaccacagcacttaagaatagtaaagatggtacatattacatgtattttaccacaattataaaaacacattttaaaaatatagtatatgtgtacactactgtcaaatagatattaccaaaaatatactgtaagaaacgtatatgaactaatgtcaggaagtgatagacactctgagggaaaacaaagctgagaagggggatggagaatggggagtgttggtggaaggcgtggttgctattttagagagctcagggaatgcagggctgtctgatgagataacattggagcagggacctgatgaagtggtgatgagtgttgtgaggaaacatcgcttacattgtcatcagactctgaccctgctttttattttgtctaaaccgtggagcaccccccaaaaaggctgacatttggagcattcttccagacttttcctatctcccatcttgagtttgggttcatcgacctgctttgtatcagggaatcaaattaatatctgcagataaagagccttatacacagaggaaagaggcaaccaattcttgttctttgggtgaaaaaaaggatacagtcctggaattcttgcaggagtcttggtgatttataataaaaagtaaaggtcttagatttaaaaaaggttatcaagaaagtagtgtcacctttcttcagcattcttttttttagacggagtctaactctgtctcccaggctggagtgcagtggcgggatctcggctcactgcaagctccgcctcccgggttcacgccattctcatgcctcagcctcccgagcagctgggatcacaggcgcccaccaccacgcccggctaattttttttttgtattttcagtagagatggggtttcactgtgttagccaggatggtctcgatctcctgatctcgtgatccgcccgcctcggcctcccaaagtgcttggattacaggcgtgagccaccttgccgcacggccctttcttcagcattcttttatggagggcagatcacatgagtttggtatggagcttgcttttaattaagggaaataaaattggttcttgcttgtgagtggtgtagagggtgcgtggtggtggtgggcagagggcaggaggaccctgggtagacgaaggggtgcgtggaaaggtgattccatgggttacttggaacaagaagggcaataggttgaccttaagagccagaatcaggagggaataaggtccttttggttgaagaggaagacaactgaggcagagaagggcagtggggcggggggcagagtggttgtataagaacatatgtctgtagccaggacagttttttaaaaattaagcttaactaaaagaggggtccgtggtttgccagatctgtgagaaaggcacatgtgatagattgctccttttaagccattcctggcctgtatcttgggagtggatggggctccttgaaagggttgtgctaggccagcctggaataaataacctttcaaaattccttggggtctgtaacacaatgtcacaaagtgtgtattctttcctaggctgtcggcttgagcatacggagtgatctttggaaaagtctaaactgcttagcatagcatgcagggccctgctgcctggctccacggcattcactttggccctgccccttcttccaccccaatcctctacttctgccaaactgagcctccagggataccaaaggtccccaagtgctccggggtgtcttgtgctcctgtgtctctgtgcacactgctctctctgcctggagggtacatttccctacccattctgcttgggcaatcacccacttctttttcaagactcagccaagtgacgatcatgctacagagcctcatttcccttatttgttgacttgcctgtttcttccactacactctaaactgattgggaacaaagacttgtccactccatcttggcacctccagtgccagcacagtgcctcgctttggagatgctgaatgcatttttgttgacaataaattgtttatgcggctgcctgggctgtgaggtgtacacagaatttacctgatacagcttcatcattagttctcaggcaagtaaaatcacagaagtaaaataattaactgagaagactatgttagagtttaggggcataggaaataggatattccactgaccacaagatgcatgaaaaaggacaccctggtagcaatttacatggagctttaagtttttaacactgacttcactgtactttctactcatgggcaaagtgcaattagatttccatacctttagtacagctgttcctgctgcacagaattcctgctcccgctcttgcatccatgtaaatactgacagtcttttacggaagaaccttaagttccatttcaaacagttctgcctgtgctgttttttgttgttttttttttttttctttcctattatacctctagtcattactatgtcatttgacacttggttgtctagcttcaggtatattgactggctccaggacccggggttggtaatctcacctctctcattcttgacttccctgcatgtaaaacaaatcatatgatatcctaaccttccttggagggctattctgaggctcacaagaagtggcagactgaaggtgcatatggactccttggattgactggaagacctttgtctctttctgaagatgacaagtccttttcttaattctcaaactccatctcgtgtgctgtggggtagaggcgttgagagagagtgtgcttatgtctcctggagcttggtgctccctgtgcaccccagagacagtggttgctttatttactgatcctaacagcacaatagcatcaagaaggatatagaaggacaatttctttaccccttcactttggtgctccggtaggagcgcacagaaggttctgtacttgtttacacttaagcttgctgtgggtaggttagaccttgcacaaaaataatatcaggcttcaatatcatatggccaagacaatattgtagcaccatgtcctctctgccttggatcgtgcttcttcttgagttcacttgcttacacaggaagctgttgcatgttgccaagccttctggcaagggtaaaagcatttaaacagtgtaatacattttggaaccaaaagctgtggtcaggaggaaaagtaatcatcttgagtagatgggggcatctccagtgatgtatgattataacatttgatcctactttgtgctattcagtttgctgttggttgtgtaacttacctctgggctcctaggttagagtaaatttaaggaagctggacttaaaatagatatttgtaatcacatttatgcgatgcagtatatatacctgcaccatttattggcatatgagttgatctcaattttgcatctgtagtataaaagtcaagtatttgtaccaacttttaactatcaagaggtgtgtatatgggtgtatgtaaatatgtatttccaggtggagaaagaataattaatttgtctattgttggaaagcttcctggaactaacatcacaaatgatgtgaaaatgtttttgaggtcagccacatagtcatcttcatgctaagcagtccaggaaaataaaataactaccaaatggagaaggataaagttagtgagcattttaagattcattctccaaatttatatcataaagaaagaaaataagaagagtcagatgcccttccattgccaatttaatgtgatactgtcattgatatacttattaaaacttgattttctatttagttgaagggtatgggcctaaggaatggtttactgttcaacctcattatcttgaatttagactcatgcaatacttactgaaagactggcatgactgagtgttggcttttcctaagatttggttggggagaaaaaaaaaaactttatgcaatactgagagatttcgttactctgagaccaaacttcattcagatgcccatcagcttcaataagaattggtctggattatggggactttataagttttcctagtgtagagattcagcccaattttcatcagattctccctagaagaggtaaaaggaaaacttgttgttagagtttactacagtgaggaaagcagaccactgcccttctcctggcaagttaggaagtatcctagagcattcttagctaaagtcttatttagcaagattagaatatgtcacttttcgccactgcattgtccttttctgaagaaaggatgatttatgagtcctctggatcttcttgtattaataacatcttgagccagctgttttattgggtgtacacagagggtaattagaaacatctgagaatcccatagcgtgcccagaaaaccatgacgctgtgtggaaatgaaaaaaaataacattaatgccaaaattgtgtacttggtaaatagatgaataagtattcaacaaaatttcctttgtattataccattttccaaaaagaagctaaagtctaaaggctgaaaatatccttttattgaaatacactcactgcagaaatcataaccttatttggtaaaagcctactgactctgctgttcatacagtaattatcatttcccttctgtcaaagtctatcatattttggaccattttgtgccagaagaagtatttcttctttttacctggcagttacttgaaaattttagacttctgaaggatctcatttaaggaaattaactcttaaaagcactaaaaggactaatagtgtccaatttacgtaatagtctatcctaaaaatcgggttgggatgtaggagtttgggctctatttcagctggttatttgaaatttgatctgctgcagtggtggctgagtttgaagtatttgtggatgcagcagcaacagccactaagttcttggggcttgatttaaatcaggcactgctcttcttactctcaagacaaaatctagacaagaaaacctaacaatttggtggtggcttgtgaatggttcctttcattttcattcacaaataacaagcccctatgagaagtcaatgttgagtcacacagacatagcccaggcagacatgggcagagcggagggtggaagcctccagtgtctttccagcctgtcttgctttgcatgtccctattcagtatgccatttttattctctttaattgttttgaatggattcctcattgatcacatgtattagtccattcttgcattgctgttaaaaactacctgagactgggtaggtttcaaagaagaggtttaaggaactcacagttccgcaagctgtacaggaagcatggttggggaggcctcaggaagcttacaatcatggtggaaggcaaaggggaagcaggcacatcttacatggttggagaaggaggagagagtgaaatgggagatgctacacacttttaaacaaccagatcttgtgagaactcattgtcacaagaacagcaagggaaagttcgcccccatgatccaatcacctcccaccaggcccctcctgggcccggggattacactggggattacaattttatatgagatttgggtgggaacacaaatccaaactatatcattacagagatgaagttgtagctaattgtgtgttttgctagaggttatcagtgacttaatgaagcccctggaaggagaagtggattcacctgtgtaaaaatgtttacagggtaggatataattagtaactcagaaatgtgacttcaaatgcctgccttcttcaatccctaaatcagagattctcagtactggtaatattatacaacagaatctaggaatgctcaaaaggtacagatgcccagcctgcaccccagggtctctaaatcagaatttctcagtgtgctttggatatgtgtattttgaaaacaaataatgtaggcaattgttatacttagctttggtggagaaccaatagtctaaaccagtgcttattaccctttaatgtccgtaggagtcattatggatcttattaaatgcagattctgattcagaatcagaattctgggtagagcctgagattctgcatttctaccacatgctctgaggatgctgtgctgcccacctgtggatcactctgtgagttgtaaaggtctaaactattattaatccactctgataaagctatgtcatcaattaatgatgtttattattgagctcttaaatgagcctgatactatattaggaaatgatttataaatgccaaaagagactcaaccatatcatcaaatatgttaacctttttcaaatctcctacctcaggtcctgctcctgtgagggctgaggtttcctcattctgcgaggcagcgtctcaggcagagtcctaccaggatggcttaagcctgtggaaaactcatgcatgattgccatatgaaatgccgggagggcaggctgccttcttaattcatcctaccatttcagctcactccagtctgccttgtcttcagaatttttcaggggatggtgagaaagtgtttttgttcacatgtcccctaaattccaagggatatgtgtcaagccctccaaagaattttcaccttttttgctccagtggaacagacttggtttctgcaagcacagccagcgtcccaggaagtgaaataacagatactgccttttgtcttcagctttgggatgtagcccaaatcccataacaggagttcaattccatagtctgcacaatatctcagcaaaacattaccagctgccaatagtgtggtggtcttatctgcaaggatgatactcttggtttactagtaataggacagatatttcgttgtctttccaggaaggtggaaggggagatatatttgcgtaggtccatccttattcttgttaagccctacttgggattgatgttaagcattttgacgatatttgaggataccatctttaatttgagacaagagaagctacacttgaattaattgaatgatatcaattagtttaaacctgtcatgtagccatcattctttctgataacatatgttctctatgctgataacatacgttctctatgctgaacttgcctacctgaattgtccagatttgacttatgaacatgatacttgagagtactttgagcacagagttgaattaatagaaaataacatagagtgaagatgaattcattcactggtatcacaaaattgcaactttcccttctgtgtgtcatcaaaacctcattacatttccttcacctcactctggcctctcctctttcccacatggtctactaatacctagcttctttctcttattccccatctccaattctcttatttcacttgcacccatcaggcatatccttagctgggtgctcacttagctcactctgttactctgaaatatttggttcacactcataatgcagaagtgaggtggaaaaactgtttgtctgtcaaatagttctcaactggggcagttttgcacccccacctaagagacacatttggcaatgccggcaaacatttttggttattcaaatttgggggtgctcttggcgtatagtgggtggaggccggggatgctgtgtgtgtcctacaacgtacaagagagctcccatgggctgggcgcggtggctcatgcctgtaatcccagcactttgggaggccgaggtaggcggatcacgaggtcaggagatcgagaccattctggctaacacagtgaaaccccgtctctactaaaatatagaaaaaattagctgggcgtggtggcaggcgcctgcagtcccagctactctggaggctgaggcaggagaatggcgtgaacccgggaggcggagcttgcagtgagccgagatcgtgccactgcactccagcctgggtgacagagcgagactccgtctcactcacaaaaaaacaaaaaaaaaaaaaaaaaaaaaaaaaaagagagggagctcccatggcaggtaataatttgggcccaaaatgtcattagcaacaaagttgagaaggcctgctccttagagcagccttctttccattgccattctttcctatcagacaacatcttagaccctgtttcctattttgtccaggtccttggaaaaccctccctcttaatctcaagattgttctgtagatgaaatctctagccttctgtcacaaatgtcttcctttgatgatggtgccagagcaaacccacagcttgcctttcagctgtccttgcacatgtgttgacctagtcaactggacccaggctcctagaggcttgatttacatttgataatttgtatgagatgatcacattggattttagagggtgcaaggattgagatggtttgggatgtgatgggccttcattctgaagattctctggaaactgaaacaagaaatgacaaatgggaaaccgtttagcacaggaggcattttttttgcacgtctcagaagtgatcgtataacagaaactgcttttcagcactgaccattgctactgtggatgctcatttgcaatgtgtctgagctatggctgttggaaaaggagggaattctgagtgtgtttatttgaacgatagcatcatcacactttcaaataaacataacaccttgggagggtatgggtttgttatttctaacccaaacatctttacacatgccctttgaaggatcattttgccaagtttgaaagaaaaaactattcaagcattaaaagtctgacatattatttaactcattgaaaaaagaaaaacctctttggggccaaaacactctaggtcagctggacaacaatgtgtatcacgtttttaaagcattcacttttggaccaagaaatggccctagggagcaagtaaaagacattgccctcacctgcatataaagtcatatagcagtcttccgttatgttttggtcatcttgcctgggagacttggaattttcacagttatttcttttgtgcttttttacttgaatgaaatgcctgttcttaattccctcggtgtgtaggggggttatattttattgcttatcttcatgagaccccccaaacccataatttacatgactgattttttccccaattgtatcattttttagttgtaaaatatacataacacaaaatttattatttaagctgtttttaaatgtatgttttaatggcattgagtatattcataattttgttcagccatcatcactatccatataataacttttcatcatctctaacagaaactatacccattaagtaaaaattccccattcctttctcccctagcctctggtcacccctgttctactttctgtctctatgaatttgagtattttagagacttactatttgtccttttgtgactagcttatttcacttactttgctttcttttcttttttcttttttctttttcttttttttttttttttttttttttttgagacagagtctcgctctgttgcccaggctggagtgcagtggcaacctccacctgggaggcggaggttggctcactgcaacctccacctcccaggttcaaacgattctcttgcctcagcctcccaagtagctgggattacaggcgtgcgccaccatgcctggctaatttttaaaaatgtttttagtagaggcacggtttcaccatgttggccaggctgggctcaaattcctgtcctcaagtgatccatctgcctcagcctcccaaagtgctgggattacaggcgtgaaccaccacacctggtctcacttactgtgttttcaaggttcattcatactgtagcatgttttctttttaaggctgaatgcagttccgttatttgcatacactaccttttgtttatgcattcatctgtcgatgtatatatttaggttgtttctacctttttgctattgaaaataatgttgctatgagccctgatgtataagtatctgtttgagttcctgctttgaattttttggtgcatatacctagaagtggaatttctgggtcaggtgataattctctgtttaacattttgaggagctgccaaactgttttccacagaggctgtgccattttatattcccaccagcagtgtgtgagggttccattttctctacatccttgacaacacttattttcccattcttttattgtgcttcagcttaccctttttttttgtattttattttatttttcttcccataggttattggggtacaggtggtatttggttgcacgagtaagttctttatggtgatttgtgagattttggtgcacccatcacccgagcagcatattctgtaccctatttgtagtctttcatcccttgccccactcccacccttccctctaagtctctaaagtccattgtattattcttatgcctttgtgtcctcatagcttagctcccacatatcagtgaaaacatacgatgtttggttttccattcctgcgtcacttcacatagaataatagtctccagtctcatctatgtggcaaatgccattaattccatcctttttatggctgagtagtattccattttgtgtgtgtgtgtgtgtgtgtgtgtgtgtgtgtgtgtgtgtgtgtgtgtgtgtgtatcacagtttctttatccactcgttgattgatggacatttggattggttccacaattttgcagttgtgacttgtgctgctataaacatgcgtgtgcaagttggaaaaacccttctagacatgggcttaggcaagaattttgtgactaagaacccgaaagcaaatgcaataaaaacaaagataaatagctgcaacttaattaaactaaagaacttttgcatggcaaaaggaacagtcagcagagtaaatagacaactcacagagtgggagaaaatcttcacactctatacatctgacaaaggactaatatccagaatctacaaggaactcaaaaaagcagtaagaaaaaaacaaacaatcccatcaaaaagttggctaaggacgtgaatggacaattctcaaaagatgatatacagatggccaacaaacatgaaaaagtactcagcatcactaatgatcagggaaatgcaaatcaaaactacagtgcgataccacctcacgcctgcaagaatgaccataattaaaaaatcaaaaaacagtagatgttggcgtggatgtggtgaacagggaacacttgtacactgctggtgggaatgcaaactagtatagccactatagaaaacagtgtggagattccttaaagaactaaaagtagaactaccatttgatccagcaatcccactactgggtatcaacccagaggaaaagaagtcattatacgaaaaaagatattttctcgttttttaataaagtaagagccatactagtgggtgtgaagtggtgtctcatagttttgatttgcattcccctaatgattgatgatgctggcctcttcgtgagcttattagccatttgtatatcttctttggagaaatgtctgttcaagtcctttgtccaattttgaattggtttgtcatagttgatttttcaagaaaaacctgggatttccatttaacaagctaaatacttaactacagcattatctctagctgataattgattgtgaatctttagggagacctgagttttaatagtggtgctgctacttggacaagactcaaatttttaagtcttaatttcttcctctctaaaaggaggagttcaggaagtagatgttcaagatcctttgcagccctaaaattctatcattttgttgaatatgaaacatatctacgcagagaatgctagagtgtaaatgagatgaggctctctttgtgatgttttactctgaaaatatttactgtgctttccaaggatgtacagtatgttcccctttgtacttttttgggctctgttttccactttgaatcaaaggatgattttgtacaactccagtgatacattgtgtggtgatgtgtcatcagcttgacaagtttcatcagaaaagttaaggcctgaaagatttcgaaaacttgtaagtgactctgtattttccttgcttggtttataaaatcaaagttcttagaagagtttggctagaaacagaatgactccttggtggcctgaaggaagcacagcttgtttggagcaggatgaaaggatggagtcaggttgggccaataaggctgcagaggacaagtttttagtttagtttttttaaaagaaaactgaaatgagagcctgcaagccttagaatgcgctggggtcctgctacaaatgataacaaatggatcattcacattaaaaatctgagccgcgaaggatctaaattgcctcactgtggggaaaaagtcaaaagccaactttaaacttaaggaaaatcatttttataataaacgaaaaggtagtttcctaatacatatttgaattcatttatctcttgccaattcctggtaaattctaagtgaattctgaatttatctagattaacagcatcttgaattttttcttcacatggaattaaagaaaaggccagacatgtgagcattctttagcagtcaaaatacagccttgagtggcacttgtgccagagatccacccggctccgtgtccccagagcggcatcattggcaccattttcctttaggaaactggggggtggaggaaaagttggggttttattcccccagccccctcctgcagggtccctgaaggtggtttatgttcctctacctcaggccacagcgctgtcaggaggcacttctctgtgccagttctttgcttttgcaaccccagggttcttgctgtgggtttcccagaactctgcctgtacctttgtcaagaatctctttattaaactgtattaaattttgcaccacttgaatgtgcctttctttcctgactggcccttgactcataccaaaattacattagctaggcctgtaggtagattttttttaagttgatctgtatggcatctttaaaaaaatggaattaggtttttcgaatatgtaacacataatgcaaaatttagaagggacaagaggacctgctgtagagtgaagagtcagttttcttcccatttttgtattccaaacactcatttctccttcccagtgagtaatactctttcccatttctgtcttctcccagaatctgaatgtactggcatatgtgtatatatatccttgaaactgctagaatattttatttattgtattgtaccatgcgttgttcagttagcagtccttatcagcacaaataaatctgccttgttctttataaaggctgcatattccatcctggcatataatataacttattgaactggactgaattgttgggcagttgacctttctacttttgctgttatcatccaagcgacagtgaataatgaaagtcttagtatacatttgtgaatatctaggataaattcttagaaacaaaattgctgcatcaaaggttatgtgtttatttaatttgaataaatatttgccaaattatctaccataaaagttgaactaggccgggcgcggtggttcacacttataatcctagcactttgggagagcgaggtgggaggatagcttgacgtcaagagttcgaaactagcctgaccaacacagtgaaaccccatctctactaaaaatacaaaaattacctgtgcttggtggtgggtgcctgtaagtccagcgacttgggaggctgagtcaggagaatcacttgaacctgggaggtggaggacgcagtgagccgagatcatgccattgcattccagcctgggctacagagtgagactccatctcaaaacaaaacaaaacaaaaagttgaactaattagttttcccagcaatatatgaacttgtctgtatcaccataccctttctaatacagattattatcattattattattattttgagacagaatctcactcaagattggaactacaggcgcgcgccaccatgcctggctaatttttgtatttttagaagagatacggtttcaccatattggccaggctactctcgaactcccgaccgacctcatgatctgcctgccttggcctcccaaagtgctaggattacaggcgtgagccaccacgcccagtctctaatacagattattaaacactttgaactctgcttctctgatagattggagtttaagttgcattttgcttgtgcatgagattaagtttcttttcatgtgcctaaaacagagtttctccacctcagtgttattcacatttgggtggataattctttgttttgagggtttgtcctgtgcattgtaggatgtttgtagcatctttggtctttacctattagattcaagtagcaaccccccatctcaccaccaccaagaagtctctggggacaaaaccacccctgattgagaagcattggtctaaaaacttttctcctttgcctgttttcctttcccactgcacttctggtgtttcaactttgcttatggtgtttttgctatttacttgtttatttctttttaggccatacaaaaattttatattattttatgtagtcatatttgtaaatatgctgcttctcagttcatacaattgatagagaaattgatttttgataacgttttgttaatcaaataaaggtaccaaattcttcttcctttaatcagctgtgatacttcccttcagtgctagacagcaaaccaagggaaaccagagtaagccctgaattttattgatgactgctagcacatagatgtattggagaggatcagaaatcttaaattaataacaactaccactatcgagtctcttccgtatgcccagcactgtttaggtaccttgcacatattatatcttagccttgagacagagccctgcgtgatcaggatgtataatcattttaaaggtgaggaaactaaggcccgaagaggttaagtcacttggccaagaccacagagcaagcaggtagcacagctaggttttgaacccagatccttcagaatcccagggttgtgctttcacctcatgtgtgatgttgtctcatagctaactctgtgctggggttgacattaagcttcaagggaattctcagggaaaagaccatattcgtcgtgcttgtgagatccatcttacttctctttggcttggacagatccgcagagtactttcttccatcgcatctgactcaagttgttcactgaatcttgggtcttggtctgagttttgtattgtacttgtgcaactatttcctcctcacctgtagaatgggaaggataatacctgcctcataagatgttgtgagggttaaatgacagcatggtttgcaaaaaggctttgtgatctgcagaataatgtccatatataagtattattattgttactgttaattgcttgcttaccatacttcatatatttgattacatcaaaatgcaactatataactatacaactatatatataacaattgaacatattttaacatattataaaatagaagacattggtattaacacatgtaaccagtgtatacttaatttcttgagtatattaaacatcaaatattataaattgatagcattgcctagtacttcaatatttttatgtcatttagctataatttcaagtctgagtcaaaccgattatcttactgtatatatatttaatgaattttaagagaattcaaagaactttgattccatttgatttattatttcgggttttcatgaagaaatttacaaacttgacaggtctgcaaatgacagattttacacacttggccattacattggtgactgaagagcagaggttttgtttggactccaggcatgcaggggaggcagacataattttccccctttctagagttcttggccttggaaatttaatatctactttaatcttaaatgtagagatgctgaaaatcgtgtaagtcaaacatcaaaggtgtttagaacctagagacttgttattgtctgtgattattttagatgtttagaattgaaatgtggctaatgcacggatgaggattaagagctttgaaggctgtaagcagttaaggaaggaaaacctcatttcagtggctcatttactgtcattggcatgtttctgaacagttgaaagctgatttaccaaaggatcctgcgtgcaggaggagtaagcattttgtagaaatcagtagggaactgttttgagaagtgaatgggaagcccttagagctgaaagtagcttggagagcatctcattcattcttttcattttatagatcagaaaattgagacccagacagggaggttatgacttcaaggtcatagttggtggcaacgctcagatgcagacccaggcttctgactcccattgcatttccaagtgagatggtttttgcaagatttttatatccagaacattttaaaattggccatctataggatgatggtgctgtactggagatttctaatgcagtttgcatgtgtacgaggagcatcagagagagatcttgccccagctgaaaagccagtatctttttcccactgacctgtgcccacccaaataaggtgaggatgagaatcactgggttactgggaaaagctggaatgaccatagtcaagagaaaatataggccacatgcggtggttcatgcctgtaatcccagcactttgggaagccaaggcatgtggatcatctgaggtcaggagtttgagaccagcatggccaacatggggaaaccctactaaaaatacaaaaattagccagccgtggtggcatgtgcctataatcccagctacttgggaggctgaggcaggagagttgcttgaacctgagaggcggtgattgcagcaagccaagattgtgccattgcactccagcctgggcaacaagagtgaaactcttgtctcaaaaaaaaaacaaaaaaaaaaaaaaaaagagagagagagagaatatatatgcataaaacagagtattcctcagtcattttgtaaacctttgttcaacaaaagaatgaatacattgtgttgtgtaaacttcagatagagattgagagactatcaaacccaaatatccagggattaagtagttacatagaagtaagtagttacatagaagaaatattctatgtaactggggcactgacaggccctcccatcccagacacagaaggctacttactgcccaccggagcttctgcagggcctgataatgatggacatcacagttctgtgccactttttggaattaatctagagaaagaattgagacagggcatcccagatgaagccaaataggggtgacttatagttccctggttaattcctggagggggtcctgaataacaggctcttggatcatgcaaaggaagtagagtaataaaggacctatgagattcattgacattgtggttgtcgaaggaggcaccttctagccagaaaatggaagatttctttccagtgattcatatgtattacccagaacactttgacttcctggaatttaaaatataaactcaagtctcttggcaataacttttaaacactgcagatcactggcttctccactcctctcccttttcccctaaccccgatcctttaaatagatagcagtatacgtacatgttaggtagctgtgatgacaaaaaagttcaaaatgatgcacagagtgtaccttctttcttttctgtgatactgttgacacattctcagtccagcacagtataaccatgcaataggaaacacagttctttggagagctcagttaagtgagatgaaaatacctatcgtgattctgtgtctcatggccaggcaggatgcaatgacatgggaatgcagggggcctagggtctgcctaatctcagccctgtatgtgcttctgtgagtgagggaacaaagtacctgcctagcaagctgtggcctgggtggtgacagctacattttgcttgcttccctctcctaagtgagcagtatacttgctgctgtggctccgcaactcaagggcgtcctatcacaaataatgaaaaatatgggtcctttcagcatacagatgacttagtggtaatagtcccttcgaaccttgagtgcttgcttataaagtcaaggcccagccaatccagcagccacttcactgagctctggagtttgagttatcaaaaagctgtcacctcttacacttcctgtctagcaccttttaaaggtaacatcactgcctccacttccaaaaaagaatttctgttctccatctcttctatttcttattctttgtgtccaattcattcaactcttaaaataatactttcaaataatatccagaaagtctggtgattgtgcttctaacccccaccctccccaaacctagtgaagctgcttatttctctgcctcttggatctatgggtggtcccatttaggcttctttagtttcctatgtcatcatcttcaggattattagagaagaattcccagattaaaagtatggagaaagatttgattcggagctggaaggaaaggaaaagtaatgttcactgagtaccttctgtgtactcaacttagttttagccattgtcacatgctatttttctgcatcccaagaccaatgggtatattatttccatgtaccgattagaaaactgaggcctagcaaattcattttattttattttatttatttttgagatggagtctcgctctgttgcccaggctggagtgcagtggcgcaatctctgctcactgccacctctgcctcccgggctcaagcaatttttctacctcagccgctcgagctgggatcataggcacccgccaccacacctggctaatttctgtatttttggtagagatggggtttcaccgagttggccaggctggtcttgaactcctgacctcaagtggtccgcccacgtcggcctcccaaagtgctaggataacaggtatgagccaccgcgcctggcctcaaatttaaatagaatattcaatccagagaaagaattcaactttaaaaataacgattatggacaatttccatttctgtagccacgaagagaaaatttattaggggcttgaggagacttgccccttttaattgttggtggatgaatcgcaaaacttgaatttaatggaatccaagtgccttggactgcttttgagcaggtcattcatgtggttagagcaacgctgcttccaagggaatgttttgattgattgtgtcagcgtccttgggtggcccttccaggagcttgaatgcctgtgtaagtttggtttcctctggctagcttctaagctcctgcagatgaggtaccacatcttctttctattttgttcttctaataatgactagtgtaataaattaatcagtatggaaattcagcacaggtaggttgacctactatagaaagaggctttttcagctctgttgagagtcactagatattatagacaagtactatcaactaggtatttgggcctcgtgattagttgcagttatttctgcctcattattactggtcattgtggttcttaactcagggatagaaggtagattttattttatgtacccactctatctgttgctgaccagcacagtatgctgagaattcggagatgacatctaggcccagcaagaactatgataggttaataatttttgttagaggagaggagagtgcagcacctaccctataggtgctgctgtcatggttgttgccagcagtccagcagttatctcaatgaagactgggtctttcttgcccctcttgaccactccagaagttattgggacaatgtgtacactttggagatagcatggtagactttgagtattgactctgccatttattaatagtgtgctttgagaagaatactacatgtctcagaatctcagttttcttctgtaacttggtgtaaagcgatgtcattcacaggatggctataaagagtagatgacataatagctataataccctgtaaaatagaaatccaacaattgttagtatctttcccttacgtagaggttaaataggaagctttttttttttcctttttttttttttttgagatggagtcttgccctgtctcccaggctggagtgcggtgacatgatttcagctctgtgcaacctcccaacctccacctcccaggttcaagcagttctctgcctcagcctcccaagtagctgggattacaggtgcccgccaccacacccagctaatttttttgtattttcagtagagatggggtttcaccgtcttggccaggctggtctttaactcctgacctcgtgatccacctgcctcagccttccaaagtgttggcattacaggcgtgagccaccacgcccggccaggaagcttctttatagagactttgctgttcttaccttctgcaaacaaatgagcacatgaaagaatggagaatgttaatattagcgttaaagtagatatgttattttcttcacttttgtgtcctaaattgttagctgcaaaagattaatatattttaatttattaacaaagaaagtagaaacttttcaacaggtttattttgggcatattaaagaacctgcattgtagactataaacattcatgatcgcttttattgatgatcagtcttaggaattatgaatcatttggttagtgagtaaataaatgagaaatacagttctcatttaactctgtatttatcccccatggcttttgaattgtttctttcagatgggaaccaagtgacttgccagaagtgggcatgcttgctagcattttgtgatagcttcacacgagcttgagaagcacatgctgaggaacttacttgacactcatcaattttagaatagagtgacagccatagataaataatttctgtgttttgtcttcctcaaaagagcaaatttggagggagacagttgtatcatcttaactacctttttgtggctgaagtgttgaatctaaggtaccagaataaagggtgaagtttttaaaattttgcatgtttatttaatagatttgtatttgttcatatgtatgtgaataggtttatacataataaatgccacagtgatagtggtcaataccttaaaaataaaaattagttcttccttaatcattatttttcttgtttgctttaggaattctgaatggatgtcatgactatatatctaataattacttaggaaatcctctcaatctctgggcatggggtattaggctatgaaaaccagaattttccattttaatcataacaactctgaacatttttatgctaatggtgaaagcagaaactttgttcttgtcctcaaatcaaatttaagctttcctgttgattacacatatccttgacgagtaagattcactctctttcacctgcctggttattgatcagctcatgagcagatggaagatctaagcataaatcactcatgaagatgatgaataagctgaaagtttattcatatgtataccctttcttatccagtgatagtagaagcttcatatttaagaaggggattaatgacataatttattattgtttcttgttcttttcgttaaagggaataaacaatataagtgaataattaattgaattttgtaggaagggttcagaaaagacctgccagatacagacaggaacccttgtcattaaacccaaggccagcagacattgcacgggtgtgtgttagaagcaaaggcaaagggctctgggaaagagagtaagaaagtgttccttttagatctgagaaatagtaagctttaagaggctggctttattgatttatttattgagacaaggcctcactccatcacccaggctacagtgcagtggcctgatctcggctcactgcaacttctgccccctgggctcgagcaatcctcccacgtcagcctcccaggtggctgggactacaggtgcatgccaccacgcctggctaattgtattttttatagaaacagggttttgccatgttgcctaggctggtcttgaactcctaggctcaagtgatccacttgccaaggcctcccaaagtgctgggattacaggtgtgaaccaccacacccagcctttaagaggctttaaattgtcacttgacattggtaatattccagtatgctagaaatgatggcaagagtacaaaacatggccttaaaattattctggacatgatattaaacgtggtaagacaattggagactgtgactaaggtggcagaactgttcagtcttttgataattgccatgatcttatggtagaaaaagcactggaagcaagagcgagtggggtaggatgatgaaaaatggcttaaaggataaaaacatgtgattattaggtagaaggaataaattgaatgtatgatagcagagtagagtgactatagttagcaaaaacgcattatagttagttgctggacaccctaaataccccgacttgatcattgtgtgttatatatatgtaacagaattttatgtgtattcatacatttgtataaataaaagaagcagcacctggattttaggactttcaaataaaacatataaggtttgggggagaaaaagaaaataaattaacctacgtcaaaatcattgatttctagttaataaagatttgataattgtttcagaaatagactagaatggccatatcattaactgggtcataattttatggaaaaaagcttatttcatgtctctcctttttatcatagtgctctatccagaaaagatgctcagagaaaacaggtgtattgattcttattttttttttctcttaatatgtctagtaaaagtcagggtgcacactcactataagaacaatgattattaagttgacttgttcattaagattaagaataatgggccgggtgcagtggttcatgcctgtaatcccagcactttgggaggctgaggtgggcagatcacgagttcaggagttcgagaccagcctggccaacatggtgaaaccccgtctctactaaaaatacaaaaattagctgggtgtggtggtgcatgcctgtaatcccagctgcttgggaggctgaggcaggagaattgccctgaacctgggaggcggaggttgcagtgagctgagattgcgccactgcactccagcctgggtgacagagcaagacttcctctcaggaaaaaaaaaaaaaaaaaaaaaaaaaaaagattaagaataatggcccaactatgaataaatctgaagtttggttcccataccgggaaccaaaagagcattaatgatattgggtatatattattttcttaagatgtgtttaggatgtgggcctatcttgctaatgcttatttatagtattttagtctatgctttgactttatgcaagatctacaaataaatatttctgattacagaaaaaagcatcatttcttattttgatgtcatttggaataaaaaatgacccaaaaagctctactgggaaaaatactcttaattgatccgtgtataaacccaaagaaagtttaactttgagtcttgtggcctctgtcaggaggctggagatttggctccactgaggttcattccaacgattgacattcatttgtcacctacttagggcattcacagcagttttctaggtattgatgagaagatacatacctttgaagtttgtatacagacagtttccttatgatgcatatttgtgcaaatgtgtactgagaagcaggtccacctgaaccttcagggagcagtcaaaaggaagcttcacttaaagcaagtacataagagtggtggtgggcctcaaaatcgaaagaaggaagagtgtgaagaggaattctttcagaatctagccaggaggatggcatgtgcgttagtatacatccaggatagggagtgtggtatgttccagaatcacagatcattcagtttcatgatctaaatggagagtcatagaaaaattctgtagggaagtgaactgattggttgaatatgcatatcagaatgtccctcctggctatggtatgaagaaagcatattggagggattatgaaaagagggagagggactattgagaaggctctgctgtagtctgtgaatgatataatagcttgaacttggacaaaggcattgaagaatggagagaaagaaataggcgagacgctgaagagagagaagcagtagtacttagctacaattggcatctggttatgggacagagaagaatctaggctttgatgtttatggttcataaggaatattctttaaaatttaatagattataggaccataaaaacttagaactgagaaagcaattatatatcaggcctttcattttaccaactagaagagcaagttgcagagagctgcactgaattgctcaaggttatttagctttgcggtgcagacctacaacggaactgagatctcttgtctcccagtatggggaccttctgatacactagactttaaacttgtacagtaaactctctgtggaaaaggtgattttgttgcacccaggaatttatcatcatcattattattatcattattttagcagacggagtctctttcttaatgaatataatggacttagataatgtgaatcacctagtaaagtctgcttaaatgcatcagttccatgaagagaagaagtacagttttagaagtgaattggtgaaaatgctttattccaaatggcttgtgaaaataaggatttaaaagctggtaggtttccagctttgatggtatggagcctattagtacaattaaaggtgtaaaatgcattcttctttccccattagcttttcaagtttctaattcagttttggaagtcacctcttccatcatagcctaactttaaaagtagatacacacccctctatgagtaatgtatgtttttttttttttttcttgtttggatcagatctgctataaattatacaactttatgttgagatcaatttggtaaatttattagtttataagaattagataagtgattgtattttgtaaaaatatttcattatatatcggttaaaaaagtacatataaaatgtatggtacattttcattctgaattaaaacctcatagggttgccttaacttcagtatctagccataaaaggaaaggagaaagagaaacgggaggaatactagggaaaagttgctgaaattcttctttgtatacccaagtagtttctctgatgatacttggtttatttaggagaattgccagaaggatttagaaatgtttctagtccttattagtgatggtagttttaatttacttttcttccatgtctctgattcttatcctgtacagaatctagacctccaattgttttattgtggtaactgagtattagcgtgtacacaaggatgtttcaaatgtcaacttagtctaattctgagctacatctcgagagttaattagaaacatactcatgggccaatactgaggtttagaaagaattatcttaaggaagtcagttttgatacatattgtcttgatttaatggaatgttccagattcaggaagtatatatggagccctgaggaatgaataggcatattttaataacctgaacttgacataccaagttatttaagttaaatggaaggagacatgttggctcatctcatcagtcagtaatgaatcacgtggccctgaatagcgttagcatttgattctggaaggctctgctgtgtgattttaagcagtgtgcagtagaaactccaaaattacctccatgtaactgactttccaaattaaccaacaccctctactcccttttaaaaatatgctgactgatgcccatggtgtgccgaatactcctggctgatagctactccggggttgaccctacacatgacaccacccagatctgagttttgtttctactaagagtcagttcttttgtccctgcctgaaattgcattatttaattaaatgttatgtaaattgattaaaaagtgagtgccaaaaaaagaattatttgcatgaaaattaagatgaataatttggaaagaatcaataaaagtgaatctctaatataatattgactgctgatttagggctaggcaagacaacattaaaactttggaaagcaaattataaaaatcagaaatttggcattcaaacgacttcccaattaaaaaaagtttcataaaagcctcatttgtacattcaaaaaaaaaaaaaaaccaaacatatattaggtaccgaccatgtattaagcattttgctaagctctagggatgagcaactgaaaaagatgaggtccaaaaactgtttctttctttctggaactcatatgcttttggagcagtcagatgtgaacccagacaattagaattctgtctgtcctgcacacaagcatttgttgctttaagagcatgtggcagggagtgggagcttccagctttgccctggcatcttcaagaatggccttaggaaagaggtcatgcttcagcagaggtgtgggtggaagtagtaaggtggggaggtaggttgggatgaagaggaaagaggctgtatacaaccgtgtatggaggaatgtgcagtggtcagaagagtccaagtgttcaggatgactgagactaaaaagaacatgatgacagcagcagagagagatgagactggataggttgcaagaactagatcaaggagagcccttctgccatgattaggtttagatttcttccactggtggtatagagaatctctgaattagttaagcaggaaattgatgggtgtggttttcagttcaaatgagtctgtatcttagagggaatgatccagttagaaactatttgaggacctttttgctaccatcgaagtttatgataatatctaaaaaccaccatctagcccctgttagacattcctatcactctgtgcatagttgtaagaacagaaaatggaggctgagcacagtggctcatgcctgccatctccacatcttgggaagctgaggcgggaggattgcttgaggccaggaatttgagaccagcctgggcaacatagtgtgacacatctctacaaaaataaaaaaagaaaattagccaggcttagtggcacatgcctgtagtcctagctacttgggaggctgaggcaggaggatcacttgaacccaggagtttgaggctgcagtgaactatgatgatgccaccactgcactctagcctgagggacaaagtgacaaagtgagaccctgtctttgtctcaaaaaaaaaaaaaaaaagaaaaaagaaaaaaaagaaaatgggtgttgtgtaaaataagcaatctggatttttaatctatcagattataaaaatgaaacttgtgatgttgtcttacaaatttttaatatttagtatttctgaagagccatttgaaaccaatcagtatttgggattgtgtacccaccagaggccaggagtcctctaaaactagttttccctgggtgtttttgtgttacatggagatttaaaggtcacagtccacctggcctttttagcatgttaaaagaaaaaaaaaaggcatcaggagcctgttttcctgcctaagggttttccagttgaggtatctagaaagatctgaggctgagcttcttaaatgtccatctctcccacagctacacaggctattatgtatgctttgggatggttaatttccaactcatagtgattttgacaccttgtgctgcatccagtctcgcctacctatatgctgtcagtgacagtttgctactcagaagagaggactaaaagggatccgtgccctttaaaagaaataaaagaccagcatagaaaatagaggccttggctgtggcagcagagttaggggggagccatgggaaagtaatgatccatggagggtgggaataaaaaggagttgtagtcgggccttgcagatttttgtttatagtagtggttcccaaacattgtccacccagaatttattccttttggcatttgctggaattttatagaccctatttcattttattgcccagtgtgtttcttctttcatgtcccatggggaacgtttctctgcttttgtgtgagtcctagaaggtctccatgcccttctttagcttgcattcttcctctgttcttccattcctaactccacccgaaactgccacattatatttttcttttccagcacattatgtctctctccccctctgaagccttctgttcaaaatagctgcttatctttagaaaataggaaaggaagttttatttaataactaatattaagatatttagataacagttgaaagcaaaattagttacaatctgtacttaatacagtgggtaaaagctccagatggaatgagttgaataattaagcaagaaagagaagaaaataaaataccagcatgaaatagattacttatcagatacttggaggggtaatagctttttaagaattgaaaccatagaacatataatagagaatagcacttataaacttaattatagaaaagcagcaaacaaaatttgtataatccagacaaactaaaataaacaggaaatagattgacaaagatgttttcatcaataagacaaatagaatcttaaagtttatgatccataaaaaccaacacgagagtaatttaaaaatcattaacattctaagagataggtaaaatatatggataacaagatagttcaaacaaggagaaataaaagcagtaaacagatatgtggggaaatgttcaaaatctttagtaaagacatgcaaaatcagcattgtggtaatataatcagatagtaagaaaaatattcacagctcagaagttaccttgaaactagtaaattggtaaaaatatttagaaataaaatccaggggaagcagccaagatggccgaataggaacagctctggtccacagctcccagcgtgagtgatgcagaagacgggtgatttctgcatttccatctgaggtaccgggttcatctcactagggagtgccagacagtgggcgcaggacagtgggtgcagtgcaccgtgctcgagccgaagcagggcgaggcattgcctcactcgggaagcgcaaggggtcagggagttccctttcctagtcaaagaaaggggtgacagacggcacctggaaaatcgggtcactcccaccctaatactgcgcttttccgacgggcttaaaaaacggcgcaccacgagattatatcccgcacctggctcagagggtcctacgcccatagagtctcgctgattgctagcacagcagtctgagatcaaactgcaaggccgcggccaggctgggggaggggcgcccgccattgcccaggcttgcttaggtaaacacagcagcctggaagctcgaactgggtggagcccaccacagctcaaggaggcctgcctgcctgcctctgtaggctccacctctgggggcagggcacagacaaacaaaaagacagcagtaacctctgcagacttaaatgtccctgtctgacagctttgaagagagcagtggttctcccagcatgcagctggagatctgagaaggggcagactgcctcctcaagtgggtccctgacccctgacccccgagcagcctaactgggaggcaccccccagtaggggcagactgacacctcacacggccgggtactcctctgagacaaaacttccagaggaacgatcagacagcagcattcgcggttcacgaaaatctgctgttctacagccaccgctgctggtacccaggcaaacagggtctggagtggacctctagcaaactccaacagacctgcagctgagggtcctgtctgctacaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcacctctcctccaaaggaacgcagttcctcaccagcaacggaacaaagctggacggagaatgactttgacgagttgagagaagaaggcttcagacgatcaaactactccgagctacaggaggaaattgaaaccaaaggccaagaagttgaaaactttgaaaaaaatttagacgaatgtataactagaataaccaatacagagaagtgcttaaaggagctgatggagctgaaagccaaggctcaagaactacgtgaagaatgcagaagcctcaggagccgatgcgatcaactggaagaaagggtatcagtgatggaagatgaaatgaacgaaatgaagcgagaagggaagtttagagaaaaagaataaaaagaaacgaacaaagcctccaagaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagatactccttgagaagagcaactccaagacacataattgtcagattcaccaaagttgaaatgaaggaacaaatgttaagggcagccagagagaaaggtcgggttacccacaaagggaagcccatcagactaacagcggatctctcggcagaaactctacaagccagaagagagtgggggccaatattcaacattcttaaaaaaaagaattttcaacccagaatttcatatccagccaaactaagcttcggaagtgaaggagaaataaaatactttacagacaagcaaatgctgagagattttgtcaccaccaggcctgccctaaaagagctcctgaaggaagcactaaacatggaaaggaacaaccagtaccagtcactgcaaaatcatgccaaattgtaaagaccatcgaggctaggaagaaactgcatcaactaacgagcaaaataaccagctaacatcaaaatgacaggatcaaattcacacataacaatattaactttaaatgtaaatggactaaatgctccaagtaaaagacacagactggcaaattggatagtcaagacccatcagtgtgctgtattcaggaaacccatctcacgtgcagagacacacatagactcaaaataaaaggatggaagaagatctaccaagcaaatggaaaacaaaaaaaggcaggggttgcaatcctagtctctgataaaacagactttaaaccaacaaagatcaaaagagacaaagaaggccattacataatggtaaagggatcaattcaaaaagaagagctaactatcctaaatatatatgcaccaaaaacaggagcacccagtttcataaagcaagtcctcagtgacctacaaagagacttagactcccacacaataataatgggagactttaacaccccactgtcaacattagacagatcagcgagacagaaagttaacaaggatacccaggaattgaactcagctctgcaccaagcagacctaatagacatctacagaactctccaccccaaatcaacagagtatacatctttttcagcactgcacaacacctattccaaaattgaccacatagttggaagtaaagctctcctcagcaaatgtaaaagaacagaaatgataacaaactgtctctcagaccacagtgcaatcaaactagaactcaggattaagaaactcactcaaaactgctcaactacatggaaactgaacaacctgctcctgaatgactactgggtacataacaaaatgaaggcagaaataaagatgttctttgaaaccaacgagaacaaagacacaacataccagaatctctgggacacattcaaagcagtgtgtagagggaaatttatagcactaaatgtccacaagagaaagcaggaaagatccaaaattgacaccctaatatctcaattaaaagaactagaaaagcaagagcaaacacattcaaaagctagcagaaggcaagaaataactaaaatcagagcagaagtgaaggaaatagagacacaaaaaacccttcaaaaaattaatgaatccaggaactggttttttgaaaggatcaacaaaattgatagaccgctagcaagactaataaagaagaaaagagagaagaatcaaatagacgcaataaaaaatgataaaggggatatcaccaccgatcccacagaaatacaaactaccatcagagaatactacaaacacctctacgcaaataaactataaaatctagaagaaatggataaattccttgacacatacaccctcccaagactaaaccaggaagaagttgaatctctgaatagaccaataacaggctctgaaatggtggcaataatcactagcttaccaaccaaaaagagtccaggaccagatggattcacagccgaattctaccagaggtacaaggaggaactggtaccattccttctgaaactattccaatcaatggaaaaagagggaatcctccctaactcattttatgaggccagcatcatcctgataccaaagccaggcagagacacaaccaaaaaagagaattttagaccaatatccttgatgaacattgatgcaaaaatcctcaataaaatactggcaaaccgaatccagcagcacatccaaaagcttatccaccatgatcaagggggcttcatccctgggatgcaaggctggttcaatatacacaaatcaataaatgtaatccagcatataaacagaaccaaagacaaaaaccacatgattatctcaatagatgcagaaaagacctttgacaaaattcaacaacgcttcatgctaaaaactctcaataaattaggtattgatgggacgtatctcaaaataataagagctatctatgacaaacccacagccaatatcatactgaatgggcaaaaactggaagcattccctttgaaaagtggcacaagacagggatgccctctctcaccactcctattcaacatagtgttggaagttctagccagggcaatcaggcaggagaaggaaataaagggtattcaattaggaaaagaggaagtcaaattgtccctgtttgcagatgacatgattgtatatctagaaaaccccatcatctcagcccaaaatctccttaagctgataagcaacttcagcaaagtctcaggatacaaaatcagtgtacaaaaatcacaagcattcttatacaccaataacagacaaacagagagccaaatcatgagtgaactcccattcacaattgcttccaagataataaaatacttaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatgtatagattcaatgccatccccatcaagctaccaatgactttcttcacagaattggaaaaaactactttaaagttcatatggaaccaaaaaagagcccgcatcgcaaagtgaatcctaagccaaaaaaacaaagctggaggcatcacactacctgacttcaaactatactacaaggctacagtaaccaaaacagcatggtactggtaccaaaacagagatatagatcaatggaagagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatgaattaaagacttaaacgttagacctaaaaccatagaaaccctagaagaaaacctaggcattaccattcaggacataggcatgggcaaggacttcatgtctaaaacaccaaaagcaatggcaacaaaagccagaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaccccatcaaaaagtgggcgaaggatatgaacagacacttctcaaaagaagccatttatgcagccaaaagacacatgaaaaaatgctcatcatcactggccatcagagaaatgcaaatcaaaaccacaatgagataccatctcacaccagttagaatggcaatcattaaaaagtcaggaaacaacagatgctggagagggtgtggagaaacaggaaagcttttacactgttggtgggactgtaaactagttcaaccattgtggaagtcagtgtgacacttcctcagggatctagaagtagaaataccattggaccgagccatcccattactgggtatatacccaaaggactataaatcatgctgctatgaagacacatgcacacgtatgtttattgcggcactattcacaatagcaaagacttggaaccaacccaaatggccaacagtgatagactggattaagaaaatgtggcacatgtacaccgtggaatactatgcagccataaaaaaatgatgagttcatgtcctttgtagggacatggatgaaattggaaatcatcattctcagtaaacgatcgcaagaacagaaaaccagacaccgcatatcctcactcataggtgggaattgaacagtgagaacccatggacacaggaaggggaacatcacactctggggactgttgtggggtggggggaggcgggagggatagcattaggagatatacctaatgctaaatgacgagttaatgggtgcagcacaccagcatggcacatgtatacatacgtaactaacctgcacattgtgcacatgtaccctaaagcttaaagtataataataataaaataaaaaaatagaaaataaataaaaagaaataaaatccaattttgacatgttaattaattaatctatttatttattttctgagatggagtctcgctctgtcgcgcaggctggagtgcagtggtgggatctctgttcactgcaagctccgcctcccggttcatgccattctcctgcctcagccttctgagtagctgggactacaggcgcccgccaccacgcccggctaattttttgtatttttagtagatacggggtttcaccatgttggccaggatggtctcgatctcctgacttcgtcatctgcctgcctcagcctcccaaagtgctgagattacagtcgtgagccaccatgcctggctgacaacatgttaatttaatatattaatatagtgctattgacgttattgattgacatattctttttggaaattcatctgttgatatactcagaaattcaacagcccagcactagattctagagaaagtggtgaacgaaataatctacagtatagtgcacgacctgaccagcttcccaagatgtggagatggcaggcatgagcaggcttgagccactgtgcttaaccatcccaaagctgttatgtatgctttgggatggttaattttcaagtcatagtgatttcgacaccttgcacatcccttttgttgctgatatgctggtttgctttcccttttatatgttcttctcattgcgccctgccatcataattacgaagttgatgaggatggctaacgtttgctgagtgcctgctatgtgctgagttctgtgtactgtgaatatatgaattcattcaggtcacacaacagccatatgagctggatacaattatttttctcattttacaggtgaagaagtggggtagaaaaacattaaataacttacccaatgtcctgccagtaagaaataatttagttgggattcaaactcctggaggtctgattccaggctgttgctcttaatgtctatgctctgtattctccccatggtgagacagttacattagtgtaatcgactcatgttatattttcttgttcgctatatctcctagcacattgccttgcatactaagcaatttgtaaatgttaactgaatgcatgagaaaataattactaagaataaaactttgtgcttgtggaggatattctttggagctttatctctaatagttaaaaaatgcagacaaggctgagcgtggtggctcacacctgtaatcccagcactttgcagggctgaagtgggcagatcacttaaggtcaggagttcaagaccagcctggccaacatggtgaaaccctgtttagtacataatttttgtatgtactaaaaatacaaaaattagccaggagtggtggtgggtgcctgtaatctcagctacttgggatgctgaggcaggagaatggcttgaacttgggagatggacattgcggtgagccgagatcacaccactacattccagcctgggtgacagagtgagaccttgtctcaaagaaagaaacaaagaaagaaatgcagacaagctaagcacagtagaggaatggctatataatttaccatctgccaatggaatattatatagctactaaaatcaatcattaaggctctgtagcaatacatggtgcatacctgtatgaaggctgtgtagtaagaaaagaatgcaaatgtaaactgtagtggttaaactgtaatctgaacactcatctaggctttacaaatttgtgggcatagataatgtaatgatcaaatcacattacgctagccaaaagcccttgcttgcttacctgcacccctctgtaccccctgcaagtgtttctgatgatccccaagggctgctccccagcctgctgaattacagggatggaaaggaacctgtggattgtgtccctcagccacctcatttttgcagatggagacactgtagtctacatagtgattttgaagtcttttaagattgttgccgaaggaggcctcaatctcaaggtgtttggtgtttctgcagccaacaaatgttgctgcgtttttcctaagggggacagagccttgaggtttaggaatcattaggagagagcgacaatgacagcatctgtgatgaagaatgtgaagtggaattttatgacatgcctaatatatggagctccttaggttatgcaaggtataaaactagatcaaaatagatagcgcacagcaatggcgaggttgatgataaatgaacaggaagctataaacaaagttgagatgatgaatggcctcatctcatctggtgtgtgtgatagcgcttcgtatctcctgggttataaacagaacatgttattgaagcatttactaatgcccaccagcattaaaaatttgtggtatttttggaattgttgtttgcattgaggttgatcttttctacttgttgaaatctgcatttactttaacattagcttgatatacctggtatttgataggtggcgatggaatgaaaatggtcttattaattttcaaagcaggtaacaaaaagagtaatgtcctatttgcttgaatgaactaaaccaatggttaaaatagtctttaaagtcagtgatgcttgaatggtatctcaccaccatgttggtttgttgatgataatagtcttggtagatcctgtggaggaacttccttgtaatgatgtctgtccacccccaacatttttgtaggtattaattagtatgtttctacatcttctggcatgctttattttccttttttctttttcttctttagagatggggtctcactgtgttgccaaagctggtctcaaactcctggcttcaagtgatcctcccaccttggcctcctacagtgctgggatttcgggcatgagccaccatgcctggcccccagcatgcttttatttgctgtttttaaaaagtcacctctttgtctagagcaagcttgtccaaccccagcccatggggtgcatgtggctcaggatggctttgaatgcggcccaacacaaatttgcaaacttttttaaaacatgagatctttctgtgattttttttaaagctcatcagctatcataagtgttagtgtatttaatgtgtgactcatgacagttcttcttccagtgtagctcagggaagccaaaagattggaaacccctcatctagagtttaaaactaatggttactatgaatattcgtgaagtcttttagttcttgtgatatataaaatagaaaacaccttcattataaaagaatgaaacgataatgtatttttacatctgatgtcaaataaatgcatatattcttaaaaaaaaaaccaaagagatgctcactgatggggagtgttgggtgcatctttaacttttttaaagcattttctctttggaactctgttgtgtcttttgcatgtactatggagaatactagtctcttctctcatatgtaaaagaaaatccctgtaccttcataatgattatatatttagtgagttttaagttaaaacttttagaaatttaattagaatctggctaatgggttatttaaaaatgtaaaataaggtttaaaaacccaaagccaagtgtccagtgcacattgaaagcgtatccaatagaagatcctgtagctatccttgtttttccccggttctgtgtcctgtgattcagatctgcctgggtcctaagttttaatctatcatttatattctttgtgtttaactctgtctacttttacagactgccttatatccttatggaaatgaacaggaatcgggcctgtgtctgtatctgaaacccagcttgtctccctttctccctgcctcttacactccagccacatcagctccctctcagttttggagcctttctaaaacacctcacctcaaggtcttcactcatgttatttgttcttctgtaaacactcttctgccaacttttcatcttgctgtattcttccccctttaggttcagcttaaatctcacttccttggacaggttgttctggatcaccctaactctggttttttgatggagtccgagtcagtataagttaacagacagataatcaagaattgaagataggcagttttagaacacaacaactgtaaatctccacattccatagggacaaaaccagtccacattcttctttcttggtcatgtgtaggactaggccttcctggttcctctgttctagctttagaagaaggtaactgtcttcttggagtccagcctttcttttttccccttggtgatgcataccgaatgaaaaggcaagcatataggtttggttttgtgtagcgtggcatagtttttttttttttttttgacagggtctcactctgtcactgaggctggagtgcggtggtgcaatctcagctcagtgcaacccctgcctcccgcgttcaagtgattctcatgtctcagcctcccaagtagctgggactacaggtacatgccaccatgtctggctaatttttgggatgttttaaagtagagacgggggtatgccttgttgaccaggctggtcttgaactcctggccttaagtgatctgcctgcctgggcctcccaaagtgctgggattacaggtgtgagtcaccgtgcccagcctaagtagcataggttcttaaagtgagcaatggtttgctgtagcatgtaattattatataacatatttgttatcctaaagcagaatggggggagaaataatgtggtaacttaactttctaaaaatattgctacccatcaccaaccagccctgcaagggatatcaacaaaaatgctgaaggcctttaagggaatattattctaatcagagacaagtgggaaagtcaaatcaaaatcatgtgtgtgtctgttctgcaaaaggacagatacgggttttccttcagatggaggtttgttttccctgctctgcctttgccacgataacttgaaatggtctgtctgctggcacagaaagccagggagcgggtggagtggccaggaccctgctgcaggaaggtcaagaacattcttagagtgccttttgggaaccagcagccgaagtatttttatagtcagctaagataacaggaaagaaagaggcagggtctgcctttttatggtataaatttttagaaaattcagtttgcccgcatttatatacaagtcatgaatatttgttcatctaaacaaggttccaattcgtggcacagaatgtgaatattattctgtcagcccaattacttgagtactgcaagttgttttacagaccaaagtgaatggtggaatacaactgaaacgcctgacttatttaaaacctccagcttgttgttcttccagcatggatccttttgctcattttgaccttttacagttgtaccgtgagatactttgagtgaccgtcacaaaattacactttctggagtaacaggctgaaggcctacctcttgttaattgcagtagttcccaggtgactctctgatgcaatatagtgaattatggtgatgaccagcaaagtatcaagctaacaaggttatggaatgtctcagccagcattctgcagttcaccttcctgtaatattttctaaaatatatgccccatggctagccttgtaaccagcgtaccacaagcatctcaagtcaaccttaacaataacgtactcttttcctcttgatgttctgaggttttatagaacttgggaagcacagatgatacatcactagatgatgttttgagagtggcatgaacttttgaaacagaaggaaactattcatagttgaatcctaaagtttgtaggtgtattttcaatttgtttctgtgatgtaactgactattaggtataaaaagactgcctgccacaaagggttcaatacatacttattgagctgagacaaagagctttatattgtcatttagattttagaaatgctagaactggagaatagatattttatttattattcataaagggttataaatactggacttttattggttgaaataagtcaagcagaaaccatttcctttataaccagagagacacagggttgttggagtttagggattattgctgtatccacgtatgctggtatagtccttgaaacaactgtgtggaggttatctcagggggttagaggtagatttaaatgaaactaagttcatgatagagttcaaagtctactgctgatattgggaataccttgtaaaagtcaattggttactgtttctttgtttaaaaaaaggtggtgttggccgggcgcagtggctcacacctgtaatctcagcactttgggaggccgaggtgggcggatgatgaagtcaggagatcgaaaccatcctggctaacacggtgaaaccccatctctactaaaaatacaaaaaattagccaggtgtggtggcaggtgcctgtagtcccagctactcggaaggctgaggcaggagaatggcacgaacccaggaggcggagcttgcagtgagccgagatggcgccactgcactccagcctgggtgacagagtgagaccctgtctcaaaaaaaaaaagaagaaaagatggtgatatatatatatacacacacacacacacacacacacacacacacacacagacatatatatgtatgtatgtgtacacatacacacacattgtattctagtatagattgattatagggagccctcactttgcatcttaaaaatcaatttaaaaatgatgagttctatgaccttaagaaatttttgccaaagcattaaaaatgttttagtgtaggttattaatatatagggaaatgaaaaaaatagtacagctaatatttatttagtacttgataatttaaaatgttagaaacattgagagttaaatgtttcatttctttgagtaaaacttgggaataatttcaacatgtttgcttttcattgtataactgatgatatagagtatttcttttcttttgtgtactgtcgtactcctttttgagtttgtacaaaacgttggaagctgatccaaagttgtgaaatacctgagagttactttaatgttaattcctttgggaatcttcatcctgttcattacagccaccttccaatttcacttccagtgttgtcactttgtatttctttgctatactttcttttttgttggctcatactgtctttcgattatccacttttgtaaaatgtcctgtgatttttatccctctgagatgaggagatggcagaactacctgctttgctgtttgttcctgaactgaataccagatgtgcagggaccaatcaccgacaggctttcagagaagtgacatgattggtcattggtcgtgatacacatctgttattcacatcatgatttgcgaaccaaagagctagcagtgaagtttgtatttgatgcagttactcagttaatataccttggtaagtgaagtctgaaccacgttgtcgggggactggtattatttaacaaaactacggtaacggaaattcatgcgtattggaaccataccaagtgaggagtgcctgtattccagttataaattctttgtagtacatttaaagctgggcctagctccctttgctttacccattacacactgagcctgtccagtgtagccaaactgtggtgcagaaaatcaaatcagagttgaactgagagtttcaaagtcattgattcaaccttggagtcagctttgactttctcttttcttacccaagacctcacagagtagtttgggcactaatgaaggtatttttcagaccccatccagcatggggagttttgacttgatctgcagcctacgccctgaagaaagtttctgggttgtcacctttgtaatttttccaactctctcctccctcctccactttctcccctcttccttggcctgctcttttcctcctgtgtcccatcatcaagttccactgattttccctccagccttacgttactgcatgtttctttcagttcctgttgccatcatcctaattatatgtttttcaacttgaatttcaattgctataatagtttcctcactgactttcccactctactctctctcctttccagctaatcccgcatgccatcactggagtaatcttcctggaacactcttgcagctttacttaatcctctgcttgaagcctccaaaataacttactgataacagaataaaacccaaagcccttatcaagcctgtaataactttctttgtctaacacaagcctccttcttcgaatttatcacctgatctcttcccttccctctagaacctgaggtttcagcaacataggtttactcattatctcccaaatatgcccaccacctctcctttctatgcattgtcttcctaaaatgcactttctgatgttgtctgaatcttgaccagtttcaaaaacttatcctaaatgatctctgctgtgaagtctattttaacttcctagaaatgtcttttctcctctgcagttccaaaggatttatatttcatactttccagttaccgcttatttgctgatctgtgtttttagttatgtgttatttaatttctccatttagcttttaagtcctagatgggcagggactgaatcttctataccatgaggaatggcatttgacagagtgataggtataaatctgtcccttccctcattcagtattttctgtttttttttttttttttagcatttcttctagacattgggctatgtgctagcagtaaaacataacaaggtaacttcctgacctcacagagctctggttgagtgaggcatacagagaagtagtcagtcagttgtaatgccataagatgcatggaatgatggatagtgaatcagatttgtggcagcaagaaggtaagtgtcaagcctagatgaggggcaatgggaatgcttctagaagtgaggttcaggcagagtctgaaagatatgtaggaatcaggtagttgacggaggccagatggaaagaatgttccaggcagaggactcagtgtggataaagctctggaagggtgagagcacactgaggaactgaattaagttccatgtagctgtattgtagagaatgaggtaagattgctaagtgtgatgagattgcagaggatccctgtaatgggcaaaaagttgacatctttggtgaatgttcaggagggaggacttccaggaccagatgtttgagtagataaaatgagggggcagcacccaggtgtttcttaaagatcgcttggtggatggaggtattggagggaagacgatgagttcaattttgaatttgaggtgcctatgaaatatgtatatggtgacacatagttgtagacaatttgaagctcggaagaaagctttgaccagaaaataaaaatttgggtgacatcagtgtatgataggatgaaatcatagagaaagagtgtgtagagtcagtgaagaagacttcaagaccaaaccttaacacacatcagtatataaagaacaagtaaagagagcagagtctgcaaagaatgttaagatggatcaggcaggaggaaggagcaaaataggtgagtgaggtgtcatggaaaccaagggaagactgaaatccatccattgggtttagaaatgtggaaaccattcatgaccctagcaagaatagtttctgtgtagaggaggggcagggaatgggaaaacataaaccggcccaagatagattgtagcgcattgagaagtcaacaaacaattatggtggaaagtttagttatggaggagacgatttaaagagggtagaagctggaaggaaatggagctgaggggcttttattataatattcttcaagctgctggaaatctgtgatgtttaaaggctgataggaagaattcattagtgataaagaggttgaccataagctaaaatagccagagttataactcctcttaaaattctttgcccagtctgtcctgttacctttcagtattctaaataagttaattccaaactaattttggacttcactgagatcttgttacacaagattgcaaattcctataaagtatgattcaaactattctacttatttgttctgggtagcatttagtgtcttaaatagagaaaattttcaacaaatattatttttattactgatttgtttctttattttttgagcaaatatatttaatttttaatttttgtgagtacatagtaggtatatatatttatggggtacaggagatgttttgatacaggcatgcaatgcgtaatcacatcatggagaatgaggtgagcaaatacttatttaatctccattgtatgccagacatttttctaggtgccaaggatgttaaggttaccaggccatacacactaccaggccatacataccccttgttctcgaggagtttatcatctagggagtcagttaatgaaataattatggattgcaaatggtacttaaaatggcatggtggtagacaatcatcttgagtggctactgtatatacacactcttttcctatgaacttttctttccattgttggagggagaataattacaagctattaaagagttaaatgacttaagatggaaagaaaaaggtagtcagtaacggagactacttttggcatagcgagtttactcctctgtttaccatttctaaaggtcatgggactctgatgcctataatgggctgtatgttttgcaggttttgttggttgatcattacttagcctctgagagactaaccaactctccatgttttctcttttcccttttagtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaaggtaagcttttttcattccgcccatttgccagacctctgttaacctgccaaacccacatagaagtcaaggatctgcgggtggccagggctggtattgaaacagaaaggagtacatgatttgtggcctgagaaatggcagtagagacagaatgtgggcccaggtatgtagctgcagtactttctaggccatagagagttagtgtctaggaaataagaaaataaaaaggagcccattcttctctagtgattctttaccaccaagagctaataaatgtgcatggtactgttctgacaaggcctgggaaatagaaagatgagcaagacagtgttctggcccttacagcattaataagctagtggatcgcacagtacctgctggtgaacttcacaattgaagaatgcttggttttagttgtaaacaatcatttaacctcactggacttcaatttgttcgtctgtagaggaaagtaaactaggtcacttggagctcaaaaattctatgacgaattcatccttttaaacctggcatttttataaatgcacacttttaaaaagggaatcatagaagtttactggctctaattctttaaaacctgagtccttgcatcaggagatgagattttgtttgaaagctacggaaagtagcttgttatagatataaaataatgcactttggtattttgtgtgtgtgtatgtcacaagaagcacaaaaataacaggtactgtattatttaagggtaagagaattgtgccttgtaaaactgggttttctcttttaatagaaacatgtaaatcctacaatttttatgacagaaattttatgagaaattcaaaaataatcaaatgcttgatctttctgattaacatttgataaaatttacctgcttagaacaagcagcatgaatttcacagctttatgactttggaaaagaatattttagtctcatgaatgtattactgttaaaagttttaatttctctctataattgcaaattttaaaaacatataaattcaggcttaatttttattttgcctgtgcccttaagaattgtgatggctggctgggcacggtggctcacgcctgtaatcccagcactttgggaggccaaggcaggcggatcacctgaggtcaagagttcaagaccagcctggccaacgtggtgaaaccccgtctctactaaaaatacaaaaattagccaggcatggtggtgggcacctgtaatcccaggtactcgggaggctgaggcaggagaatcgcttgaacctgggatgcagaggttgaggttgcaatgagctgagatcgagccattgcacatcagcctgggtgaccagagcgaaactccatctcaaaaaaaaaaaaaaaaagaattttgatggctatgcagcaaaatgctacacatgcatgcatgtttataaaatttactttcatgttttaaaacttttgatttgcctgttagttattcaggactaacaagttttcctcccaatctgttgtagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacaggtaaacatcatcaccgagcctgctttagcagtgtcttacagatatggtatcattttaacaagaaagccagacttgataaaaatgcttttttaaaaaaaaggctttgacaaactatgacttgtggccatatttttgtaaataaagttttattgccacactcatagccacacttattcatttacatactgtctatgcccattttcatgcgatgactgcagaattaaatagtccagtgagatcatatggtctgtggaacctaaaatatttactgtgtgtctttttacagaaaaagcttgccagtccctgatgtacagaatacatttatttatttatttgtttattgattgattgattgattgattgagttggagtctcactctgttgcccaggctggagtgcagtggcacgatcttggctcactgcaacttccacctcccagcttcaagtgattctcctgccttagcctcctaagtagctgggattataggcacgtgccaccactctcagctaacgtttataattttagtagagatggggtttcaccatgttggccaggttggtctcaaactcctgacctcaagtggtctgcctgcctcgtcctcccacagtgctgggattataggcatgagctaccatgcctggcttccagaaatgtttcaggaagtccatgattacctgtttctattttttcagttaggatgatctgtgtataaaatgtgtcaggcgtgagatatggtacagaatatatattccgcaaagatgcttgtaaatatttttgccttttgcagtagttttgttcatgagttttgaattcattgtgcaataataattcatgtcatctttgacaggaagtaatatttcatgttatcttttattttcttataaaaattcaggccgggtgctgtggctcatgcctataatcctaccactttgggaggccgaggcaggtggattacctgaggtcaggagttcgagaccagcctggccaacatgatgaaaccccgtctctactaaaaatacaaaaaattagcccggcgtggtggcaggcgcctgtaatcccagctacttgggaggctgaggcaggagaaccactggagcctgggagatggaggttgtagtgagtcaagatcataccactgcgctccagcctgggtgacaggagtgagactctgtctcaaaagaaagaaaaaaaaattcataacttgcaaggtgtagtgcatgagttgtttgaagtgtaactttaggcctacatttatatcataaagtgagagaaaggcaaaattttctttaaaactcatcattgaatgtgcatagcgaagacaacctaaaagcgttggttcctccactccattatgtggtaatgatggaggcttcgttctgtggtttccctcctgtcttttggttatgggttaaacccctcatgagaagactagatgagatacatttattattattcctctgcgatgtcttgaatattaaaaatatatcgtgtgtgtgtgtatatgcgcatgaaatacttgggagtaatagaactaattgtcactgctttagaaacctgggaaacacttttaggtagtaagtcaatggtaagattgtcacctttcttctaggagaaggaggggagattgtagacctgaatggaaggcagcatatgggaatggaaagagcatccttgtggagttgtaagaccttgattagagctgtgagcccagcactcggtaggagggaagtggcttccttatctgcaaagtagagataagatgtggggctcatgagactttgttaagattaatcaagataatgtgagccctgctttgcaaatattatagaacgatgcaaatattagcttagagaatatttatcaagatgagtcaaacttaagcagccatctactatgactgtttttatatcatgtgctttcagtaagataggggacagcatcgatcccacaaacacagccctcattggcctgtggacacctgaaatgcgactacaggggacctaacgtggcttttcattccccagttttgcaaatgcttttgggagaaggaacatcagtctaaatttagcttaaaagtaaagacaatgtttatgctaagggtagattttgataaggacagtggggctgaagataaactttatacacttcacagctttgcactgaactagtcttggagagggaggacaaatttcgtgccatttgcattgtttattcattccagcttaggttggtcatggagaaaggaaaaagcagatctttttaaaattgtgtgcccagtacctttctccccgtttccaagttggaacacagatgataaaaagcaagaaaatgaggcataacaaacttgttattcttgtataatattaggtgattgttaacaagaaaagatgaaaagatactattgacttgtaagcctagagtgtacaattgaaatgaattggctaattgatggagttacccaaataattaaaactctggaatacttttgtcttatctgcatacatctctgacttttggtctaaaagatccaaacagtgatctcaattcttaattcattttgcatgtgtactcactcatacacagcttcaaaataagacctgttttttggaaagcattctcagcatatatttattggtcttcctgttcatgaggaatgttgctggatgctaaagactgcccaattaatttgtgcaattagggtgaaccaggcatttaaaaaatacattactggcaaataatcatagtgtgtaggtgtatcctactatcctacaaaggattttgaaaacatttgtgctttcttgctgtggttggtttgcaaacgtagctatagccaggaggtataggtagattttaaatggcagataatccaaaacaaaaacaaaaccctggataaatgctcactgttgctttgctcagtggagccgtcttattaattgcaagtgtcaaacattgagactttcaatgcaatagttaccaataaacatctatgtttatatgttgctatgagaggtcatatacaaaataaatttggcagagatagcccttgtttctgtggcacattctaataattaggtagtaaacttgggattgaacaccaagatgaactgtgatcaacgtatttaaattcaggaaagctttgtagggtagaatttcagaactgtttggagggtggaggaaaatggatgattgatgaggaaaccaagctcacagagcagaaagggagagtaattgaacagaggaaagagaacagtacaagaaatgggcagggaagagttgtcagaagagatcagagaagtgaaatagcttgggattcttggcaggctattgcacaaatattaagcctcttaaatctgaggcatagtgcagtataaatgacttgctggcaaggtcagcgtgtcaggaagcccctttgactaagtgatcaactcagcgtcattaatagtggggcagcctgaccttatgtgcctcctgctgtgagacagtatagagtgcagaattacccatgaagtgttcttgccaaatatatctaacctgaatctaatcaaacccttagacttaaccccaagtttacagggaataccaagggtaaagaaacaagttaaaaacatcacactcagacagaaaaaacaatcagacattgacaacgtagggcattgttgcctggtttcttaaaaaaaaaaaatcagagtataaaagaaagtgagatgatgtttgtagaaagagacacaaaaaataagtgtaatatattcaccttaattaaatcttgattttttaaaaaaaagccagatctaagagatattttgggaatagttggggaaatttgaacatgagctctgtcttagtccattttgtgttgttataacagagtgtcacagactgggtaatctataaagaaaagacatttatttctcactgttttagaggctgtgaagttcaatatcaagatgccagcatgtgaccagggccttcttactaagtcaccccatagcagaaggacaggagaacacaagagagcaagggggagctgaacttgcttttataacaagtccactctggtgataactaacccactcccaagataatgacattaatgcattcatgagggaagaccctcttattaggtcccatactcctaacactgtcgctttcaggggattaagtttctaacacatgaactttgggggacacattcaaaccataggaaatgtcattagatgatattttggaattactagttttcttatgtgtggtaatagtattgggattatgtaggaaaatatccttattcttttttgtttgtttgttttgagatggagtctctcactctgtggcccaagctggagtgcagtggagcagaggtgacactgcaacctctgcctccctggttcaagggattctcctgcctcagcctcccgagtggctggaattacaggtgtgcaccaccacacccagctaatttttgtatttttagtagagacggggtttcaccatgttgcccaggctggtttagaactcctgacctcaggtgatccacccgccttggcctcccaaaatgctgggattacaggcatgagccaccgcacccagcaggaaaatgtccttattcttaatagatgaatgctgaaagttttaggggtgaaattccatgatgttcgtagtttacaggcacactttcttttactgcacctcacttccactctttgtagatagatattgtgtcttttactaattgaatgaaggttctggcagccttgcttataggcaagcaagtttttctgacagcatgctctcactttgtgtctctgtcacatgttggtaatttttgcaatatttcaagaccttttcattgttgtatctgttatggtgatgtgtgataagtgatttttgttactattgtaattgttttggggcatcacaaaccacaaccatataagatggcaaacttaattgatacatgtgtattctctgactgctctaccaactggccattcccccatctctctccctgtcttcaggcatccctattggctgaaacacaacaatattgaaattaggctaattgataataacacaatggcctttaaatgttcaagtggaagaaggagtcacacatctctcactttatttatttttatttatttatttatttttgagacagagttcttgctctgttacccaggctggagtgcagtggcacgatcctggctcactgcaaggtctgcctcccgggttcacgccattctcctgcctcagcctcccaagtaactgagacaacaggcgcccgccaccacgcccgggtaatttttgtatttttattagagatggggtttcaccgtgttagccagggtggtctcgatctcctgacctcgtgatccaccctcctcggcctcccaaagtgctggggttacagacgtgagccaccgagcccggccacatctctcactttaaatcaaaagctaaaaatgattaaccttagtgaggagggcatgttgaaagccaaaataagccaaaagctaggcctttgcatcagttagccaagttgtgaattcgaaggaaaagttcttgaaggaaattaaaagtgctactccagagagtacatgaatgataagaaagtaaaacagctctgttgctaatacggagaatgtttgagagaggtctagaaccagccacaacattctcttcagccagagctcaatccagaacaaggacctaactttcttcaattctctgaaggcttggagaggtcaggaagttgcagaagaaaaatctgaagctagtagtggttggttcatgaggtttaaagaaagaagccatctgcataccataaaagtacaaggagaagcagcaagtactgatgtagaagctgcagcaagttgtccagaagatcactgataaaggtggctacactaagcagccttatacctgaagaagatgccatttaggactttcatagctagagagaaagtcattgcttggcttcagaggacaggctggctctcttgttaagggctaatgcagctggtgacttttagttgcagccagtgctcataggctgttctgaaaattctatggcccttaagaactatgttaaatgtactctgcctgtgctatataaagagaatagcaaagcccggatgacggcacatgtgtttgcagtttggtttaccgaaggttttaagaccactattgagaactgatgctcagaataaaagattcctttcaaaatattactgctcattgacaatgtacctggtcactcaagagctctaatggagatgtacaaaaagatgaatgttgttttcatgcctgcaatcacaacatccattctgtagcccatggatcaaggagtcatttggactttcaagtcttattatttaagaaatacattttttaaggctattactgccatagatcatgattcctctgatggatctgggcaaagtaaataaaaagctttctggaaagagtttgccattctagatgccattagaaacattcatgatacatgggaggaggtcaaaatatcagcattaaagatatttaattaaattagatacttgaaaatgtcaaatcccacccttatggatgactttgaggggtacaaaatttcagtggaggaagtcactacagatatggtggaaatagcaagagaactcgagttagaagtggatcctgaagatatgaccaaactgctgcaatctcatgttcaaacttgaatggatgaggagctgctgcttatgaatgagcaaagaaagtgctttcatgagatgaaatcgactcctggtgtagatgctgtgaacattgtgaaatgacaacaatggatttagaatacgctataaatttaattgataaagcattagcaggacttaagaggactgactcattttgaaagcagttctagcatgggtcaaatgctatcaaacagtatcacttactacagagaaatatttagtaaaaggaagggtcaggtaaagctgcagacttcactgttgtcttattttaagaaattgccacagccaccccaaccctcaggaacccccatcctgattggttgacagtcatcaacatcaaggcaagaccctctaccagcaaaaaggttatgactcacagaaggctccgatgattattagcatttttaaagcaataaagtgttttaaaattaaggtatgtactttaaagcatagcgctactgcaaacttaatagacgacagtatagtgtaaacatgacttttatttgcactgggaaactgacagattcatgtgagtcgctttattgtgataataactttattgcagtggtcaggaactgaacccacaacatatctgagatattgcccgtagtttcagaggtattttacacacaagtagcacgaacttgactcttgagcggttcatatgcaggtgatcattgtattatcctttgaatatctcagtatattggaaaatattttagaaagaagggggaaaatattaaaatttcctagacttataaatagaatagtatattttaaagccgaatttaaaagctttcactgtaatacatttagagactttttagaaacaaacttaaagtttttaactgtttaatgggagtgttgggtgagtgtgaggtgacatgaggccaaggaagagaaattggccttgtgaaatgaccaagggccaatctaagaagtcaagttgaaaaaaaaggagatgactataggggattttgtgaggaatcaagcatcaggattgcgttacaggctgttgtgaagacaaggatgatgaagaaatgaacggttctgaattttcttctaaataaataaatgctaaataaatgctaactaaataaatgctcaccagagttgatttcttgacccttagcagggaggattgtgagaagatgagcaatgacatctttgttacaagcagcctcatccttgattaatattaggaagggtgtactcttaattatcagtcaaggaagtccagggtgttttcgagatggaatgctagagaattaatggagaaaattcagtgatcagtgaatagatttgctgatgatagcttaaattcatgaccacagaggacatttctttggattgcattataatgagaaaagagcgggaataatggagttaaaggtttctgtaatgttttctcaccttgacagagaatgccaacctgtagggaaaaaaacatttctattgttttgtttttgtaaaaagttacgtttagtatttcagagttctaaaaatatgtttaacaatcaaataaatcattggtgtttatgtgaattaggctgtctatataggcagtctctataggcatcactaaatctcctatattcaaagaacagaaattgatctcatagaactatatagggtgacagacaggagtggttttcttgaatataaatcaagtatgaagtagttggccggtcctaattttggcagagttaggtttctgtgctacctggagtaagttgtggtagtctacatatatgtgaaaacatttgcaagagtttgctcactgactgttagaatgacaattccagtggttacaatcaccagccacttcagggtaatctcatttttcacaggcttcaaacccgaacatttctgtggtagttatcatctctgaggagaggccaagtttcagaaaatacccctccaatttatttttgcatcataggaacattgaatatgttcatcttttttacataaaaatcaattgtataagggtgtcctttgtttttaaattggatctctttaacagtgacctaaattcaaagcttgtttggcatctgactttttgattgtttcaaacatgttttattgattgcccagttcctggaaacaaacatgtagtgacctagttatgccagatggtatgaaaaggccttctatgggaagcatttagaatcacagtatagagttcagggtccagcttccatgctgaacctgcccactgcctcgttgcacaagcctgtgctctttgttgaacccaggaacctgcctcgtaatcagacagaagcgttataaggggagacaaaaaattcaagtgcttcaagatttcctgtttcaagatgctgaaagatcagaaaattttacatataaatacctgagttaattaaaaagcaggtattccaggactctggaaaaccctgatttatacagcatatgttttaagtacagcactctaacacagataaagatgatcaaataacacatgaacccacttttatagtttgcaactataaaactcttagaaaatattttaaaaaccataagaaacaaacttttctgcatctattgagataatcaggtggtttttgtctttggttctgtttatatgctggattacatttattgatttgcgtatattgaaccagccttgcatcccagggatgaagcccacttgatcatggtggataagctttttgatgtgctgctggattcggtttgctagtatttttttgaggatttttgcatcaatgttcatcaaggatattggtctaaaattctcttttttggttgtgtctctgcctggctttggtatcaggatgatgctggcctcataaaatgagttagggaggattccctctttttctattgactggaatagtttcagaaggaatggtaccagttcctccttgtacctctggtagaattcggctgtgaatccatctggtcctggactctttttggttggtaagctggtgattattgccaccatttcagatcctgttattggtctattcagagattcaacttcttcctggtttagtcttgggagagtgtatatgtcgaggaatttatccatttcttctagattttctagtgtattagcgtagaggtgtttgtagtattctctgatggtagtttgtatttctgtgggatcggtggtgatatcccctttatcattttttattgcgtctatttgattctcctctcttttcttctttattagtcttgctagcggtctatcaattttgttgatcctttcaaaaaaccagctcctggattcattaattttttgaagggttttttgtgtctctatttctttgagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgcttcgaatgtgtcccagagattctggtatgttgtgtctttgttctcgttggtttcaaagaacatctttatttctgccttcatttcgttatgtacccagtagtcattcaggagcaggttgttcagtttccatgtagttgaacggttttgagtgagtttcttaatcctgagttctagtttgattgcactgtggtctgagagacagtttgttatcatttctgttcttttacatttgccaaggagagctttacttccaagtatgtggtcaattttggactaggtgtggtgtggtgctgaaaaaaatgtatattctgttgatttggggtggagggttctgtagatgtctttgacaaaattcaacaacccttcatgctaaaaactctcaataaattaggtattgatgggatgtatctcaaaataataagagctacctgtgacagacccacagccaatatcatactgaatgggcaaaaactggaagcattccctttgaaaactggcacaagacagggatgccctctctcaccattcctattcaacatagtgttggaagttctggccagggcaattaggcaggagaaggaaataaagggtattcagttaggaaaagaggaagtcaaattgtccctgttggcagatgacatgattgtatatctagaaaaccccatcgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttccaagataataaaatacctaggaatccaacttacaaaggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatgtatagattcaatgccatccccatcaagctaccaatgactttcttcacagaattggaaaaaactactcaaaagttcatatggaaccaaaaaagagcccacattgccaagtcaatcctaagccaaaagaacaaagctggaggcatcacgctacctgacttcaaactatactacaaggctacagtaaccaaaacagcgtggtactggtaccaaaacagagatataaatcaatgcaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatctcttctttataccttatacaaaaattaattgaagatggattaaagacttaaacgttagacctaaaaccataaaaaccctagaagaaaacctaggcattaccattcaggacataggcttgggcaaggacttcctgtctaaaacaccaaaagcaatggcaacaaaagccaaaattgacaaatgggatctaattaaactaaagagcttctgcacagcaaaagaagctaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggatatgaacagacacttctcaaaagaagacatttatggagccaaaagacacatgaaaaaatgctcatcatcactggccatcagagaaatacaaatcaaaaccacaatgagataccatctgacaccagttagaatggcaatcattaaaaagtcaggaaacaacaggtgctggagaggatgtggagaattaggtacacttttacactgttggtgggactgtaaactagttcaaccattgtggaagtcagtgtggcaattcctaagggatctagaattagaaataccatttgacccagccatcccattactgagtatatacccaaaggactataaatcatgctgctataaagacacatgcacacgtatgtttattgcggcagtattcacaatagcaaagacttggaaccaacccaaatggccaacaatgatagactggattaagaaaatgtggcacatatacaccatggaatactatgcagccataaaaaatgatgagttcatgtcctttgtagggacagggatgaaattggaaatcatcattctcagtaaactatggcaaggacaaaaaaaccaaacaccgcatattctcactcataggtgggaattgaacagtgagaacacatggacacaggaaggggaacatcacactctggggactgttgtggggtggggggaggcgggagggatagcattaggagatatacctaatgctaaataacgagttaatgggtgcagcacaccagcatggcacatgtatacatatgtaactaacctgcacattgtgcacatgtaacctaaaacttaaagtataatgataataaaaaaaaagaagaagaaaaaaaaagaaacaaacttcaagattaaggtctttatacatattctacagaagaaaataaactttatgtggattaggaagaaaggaaaggactggtagttgatgtggaatcctgaaatcattgtgaaaactcttttttcctttaattattggtcatataaataataagccttagggcaaaattgggttaaagtgacacaagaactgtttgggattctgttagagatgccagaagttgttccagcagttctgtttggacaggaaaaatggaaacagaatggaccattggagaacaagattatctaattgaagataggtctcttttggcagatatgttcagtaacatcctaagctctaaagcttagcactggaacacacacacacacacacacacacacacacacacacacagagcattctaaagggccaaatagatatacttagcttttgtttaaaaaaacttaaaagaataagcttaatggagaaattaacaggaaaatatgagctcattgaagtggaaagtatcctaattgcatggctgaaattacttttttttaaaagagtttcaatacttttgtcacaggactttgaataaagaaaaatatttcttggtttccactggacaaaagccagtaagaagctggggaaatagatgtgatgcctgccaactccacatgggagaaaaagatgggtagatggttgggtcgatgcagatgagatgggcactttggaaatcttttctcagtgatgagaaatggtgttcatttaggggagctgagacattgagttctgctcagaaacctgctcttgaatttccgcagtatctctcctgtcctggcaacgtgaatattactgggatgaagcctaaatctatgattacaaaacaaacaaacctagttttatcctgacagaagtaatgccagaattattgtaacacttttcacactggttattccctaaactgagtccataaactatgtaaatagattagaagtctaaagaaaaaaatggttataaaacatcttacttatgtggaaggggaactgagccaggctgggtcagtagagggcagaggtgaattgtggctctctcttcctccccatcgcctaaggccacatgcccttatggatagggccctcccaggtgatcttggaccagtgcagtggcctgccttcttttggaggagctgctgggcagtgactggggaaggtgaggctgaggctactagacatctgtcttcttgctgagcagagagctcagttggagtgtgtgctgattgcatttattgaagcttggcttccttgaggtggaataagtcattaacaccaggcacttcctatgccatctgggcttttcttcagtgtcccactcaagtactcctttggcataatctaagaaatatttaattgagtgttactgagtctcttgtggctctaaaatggctgctctctgtagccatccgtgccaaaccttacctgcgtcaacagctgaaggtatcactgaaggtgtcctacacatctcactgataggtgctgggacttttaagtgttagctggtcttgttccagcaacctctgccagattgactttcgcgcaggggccctctagcctggagtcaagaaagatcagcagagacaggggtaagatccaaagagggaaaatcaccgcatgtgagagagaacatgtctgcatgtcactgggctcctgccagtggagaggagaactgctcgttttacttggattgagaatgtagggctgggacattaggataatcaaaatatagattcttagaacttcagagaatgggttgtgacccagacgttacccttcctgcggcccagtatctggtctttacccaggtagatgtcttctgggaaccaaagaggctgtcagctttaagggtccacctgcccggacctgtttaagagaagcaagtatgtgtttcttcattggttctccctaagcccctcctctcagattttttttcattttattggcaattaaaatgcctttatcatgacgtggaatatcaaattaccatattttatacctctagggctctataaaataatatacctattaataattagactcctgttcctacataggaataagcattgaaaataataattatggagcagctcagagtggaagcatgttgagctacttctgatattggcaaagtggtaagattttatggtcactgtgtttgaagatgacagttctgagcatgttggaaatagttttaagagacgatggcttgaattgatggttgattttggctctatacattttaagaaatggtttcaggatttatagctggtatttctgggctctgatggtctgatgtggctctgtgctatccctcagaattgagatttgctaaaatgaggaagaatcatctggtttactaaaaaaatcagtcctctgaaatctgccccataaagttgtagtgagagaagcaacattttttgccgtatattgaagaggacagagttctctcctgaaccttctctaagaccatgatagtactgtttttttcctttctcatccttccattttttttccctcttctgtctcctttcttaaataaaataatttatatatagaattgaatgttctatttcaacaaggtcactgtatgagactgtgcatttactctagtgacactgccattgggcaaatagcttggacacgtctgtgaacaagatttgccaccgttgagaatatttaaagtatgtctctagccttgaagaacattctaaaattcaaaatattttgtatatttctaaatattttaaacaaagagagcaatgcctccaagatgatcactttgcagaagactggtttagaatctgcaagctctaacggagttgttaaagaatatggtcttaacattctgtggcttcaagataagcctctttttttttttctttttctttttttaagagatagggtctcactctgttgcccaagctggagtgcagtggcaggatcatagcatgctgcaagctcaaactctcgggctcaagtgatcctcctgcctcagcctcccaagtagctaagagtataggtgtgtgccaccatacctggccatggggcaagcctcttcgtaagacaatgcatttttagaaaactgatagctgatttgaccttcaaaacaatcaggagaaacatgaaaagtagacatttatgtctcccatttatttatgtgaaatttgaggctcagagattgggactagcttgtgttggtatttccaagacaatagctctctttccattttagcaaattcatcatatcttggccctcagtttcttcatttttcaaataattggattggctaaggagactaccaaggtgtctttgagccctccaaacctctatgatgatttctacatctttgctcttttctgcaatcttagacaccactggtgctgacatatgcacaggccatatggacagatcaatgtcaaacagagtgaatgaataacctatacttgtctctcaaatgctactgacttagaagactcgtctttagtatcagtttctctgaaaagctttttagtacttcttcaacccacacttctctctgttccttaaatctttattgcatttagaatctaatcagacaattttaaatttaaatattttaaagttgttgcttttgtgcctcgtttctcttcctcaccagcttgcgctttttataaggccaggatcacttatgaattgatcttagaactaggcacacatgaattgtgggtaaatatattagattagtctaggttgtgcttcagtaacacattagcacaacaaagtttacgttttgtgtgcattagacatgttagaggtgagcagaggactctgctctgcatatttcagggacttgggttgatagtggttccatcatgttactgccatgttatccagaatatatggcttccttaattcctacagcagggaacgagaggttctgcaaaggaccacactcattccctttcccatagccccctgttcagaatgagtcccatggccatacctattagtgctattgatggaattatgcctcccatccccaaattcatatgttgaagccccaaaccccaatgcagctatatttggagacagagcctaaaaggagataactaaggttaagtgagatcataagggcagggccctgatgtgataggaccagtgagcttgacctctctgttgctttccccacacacttgcacaaagaagagtccatgtgagcacacagccagatggcagccacccacaagctaggaggaggggcctcaccaaaaatccaccatgttggtaccataatcttgggtttccagcctccagaactgtgaggaaataaaaaaaaaaatctattgtttaaaccacccagtctacggtattttgttatggcaatctaacacatagttttggagctgggaaatgtggggaaacaagtggctctttggggaacaatggatgtttctgccagaagagtcagggcagtggacaagacagacatggttccctgcacccagggatctaaatgaacctgttagtgttatttgtggctttcagtttttctacatgacttgcaaccaaaccacaggtaattattagttttgagttctgtgtacttggaagagacacagaaaaaactgaaagcttaaccaaatgaggcatgcattacaatttcacatagtgctatgaggcctaaaatgtttttggttcctttgattatctctttatagacatgaagcttaatatagaagatttatctcaatatggttgtagaaataagcattggaggccaggcacagtggctcacccctgtaatcccagcactttgggaggccgaggcgggcggatcacgaggttaggagatcgagaccatcctggccgacacggtgaagccccatctctactaaaaatacaaaaaactagccgggcgtggtggcagcacctgtagtcccagctactcaggaggctgaggcaggagaatggcgtgaacctgggaggcggagcttgcagtgagccgagattgtgccactgcactccagcctgggcgacagagcaagactccatttcaaaaaaaaaaaaaaaagaaaaattggagaagataggcatttatgttcatcattttgggggtgatcaggttgctatggtgatagtaatcatggctatatgcacatctttattccctctctcaacatgagtctttctttttagacacattcctagtaattaaacttaaaataaattcgatctactcaccatctagtactaggatttatcacatgatttgtgttgttttgccccaaggaaaggctaacaggaattatgatgtcagaatataatcatgataatactgtacttaaattttctttttgcaacttaagagcaaaacacacatatcacagcctggaagaagacttgactgttgaaatgttcaaatcattgtagaggtggagaaaataggcagcacagattctatcttttctttagaaaagatgtcaagtagaatcataagtttcatgcttaagagggttttttttcccttcatatgtgactttaaaaaccatttttgccttagtgtaacttttaaaataccgtttcataaactaaagtagttgtctggaattccttgaagcccatggtttggcttcagcaggttttaaacaaatacactgtcagaaatcgatgtggatacatttccagcagttaaatgctctagtcacagtagatactttgtaaaatcaatagcctgaaatatcagaggattatagttgtatcagattccccaaatgcctaacattgttttaattactctaataaaagaaagctgagtggacttaaaaaaaagaaagaaaaaaaccttgcctataaagaatgttctgctcaagccaaagcaaatttttttacaagttctcttagaaaatctggaagtatttatgcattttcctcttcttatgagacaatgcctgttacccagccagttctgcattgtacagtgctctttataacaacgacccttagaacaagttgatcaaatatgttgctctagttgcactagcgataggggttagagatttagaactttttactttttgatgcatagaaataagcatatttaatgatctagtactgggacactaaagagtgttcatgagattttctagtttaatttggagccatagttgattcaggggctagaagaacaccattttgctcagaacattgtcaggagtcacttttccagagtggagatgtgtttatatcatagtgaaaagacagtttaagaggagcaaagaagaggaaagacgaagtttggattgatccaacaacctgttacatgtagtcagtacttttcccataggggacttcattctgattcttatgaaaagaagttcaagatttcaaaaaaaataggattaacattcctcatccagattcatagtattgatggtgtagcttttgtttactagaataccccaaggctttgtgccagaatgttagagtaatgtgcttctgaatgtggatggaggtgaggatggcacctgcatgggtggaataatttatgggacatacctgtacagtgtaggttgatggattataatgtgactttataatggtcacagcccagtacacccaagatctgcatttccatgaccatcttgaatcatttctgagatcttgcctattgataattatatcattcattatagctacccaatataatctagaatcgagccatttaagagctgtaactcttctcaggaaggtagagctgccctttgtgtgtacaggttagcaggaaagggctggcatgacgtagggtgaggaaaaggcagcccattattatggttatccttgattaggttggcctaggtcagggtatgaggataccaccaggcaggctgtggcagcatggaatctaatgtatcaacctggcaggcagggggcacctgaggaacaccgaccttcataggattgccctgccacgtagctccttggctgccctcagccctgccctggagctttcataaaatcatagaacttgggcacttaaatgagtattagcaagtagtctgtccttacaattttatgggttgatgcaactaacatccagagaggtagatcagtttgcagttgagtttgtgtgggaggtggggagtaaaactgaagattttagtgtctagtccagtcttgctactattttttttttttttttttttgagatggagtctcgctctgtctcccaggctggagtgcagtggcgcgatctcggctgactgcaagctccgcctcccaggttcaagcaattctcctgcctcagcctcccaagtagctgggattacaggcgcccgccaccaagcttggctatttttttgtgtgtgtttttagtagagactgggtttcaccatgttggccaggctggtttcgaactcctgacctcaagtgacccgcctgccttggcctcccaaagtgctgggattacaggtgtgagccaccgcacctggccagtctttctactattgcaccctgactcttaggccatttcttctagggatggaggattcacaagaaaccattgctatctaaacctgaaaggacagctatattctctgggacctgacttagttagagagtcgcatgctgtgtggtgttttgtgattgggccatggatccttgaggggaaggagcacagtgagctccattgctgttgcttcatggtcttggttctctggcaccaaaacatagcaccatgacaagtacgatcgtgatgtccccaaagtgaaatcatctgccgcttgaacgtcaatatttacaagttgaattattggaattccatgataccatgttgtgcttcttaagcagagttaaaatgaaatctatacaatgacatgccctccacagcattaattcactgagtatttctttactagccagagcacttttgagaaaacctgaatatttttagcaaggtcttaagaatatctttttcttttatttctatatctaacttacgtgtttattttatacatctcttatctgtaggctgaatctgggatattgtatatcgaataactactagattaattgctcttttgttaaataagcccaggtttttaaaggaggagcctgggggaagagatctaatacaagcccagtggggcttggccatatggctgtctcacatacagtccgtctcacatgtgttgtctcagtccactcaagagctccatgaaaaacggatgtctctagtgccattttatagaagacaaaataggcagagagacgttgagagttttgcctatagtcatggaggtggtaattggtaaagtgaagatgtgaatgtttttctattttcaaaagctgccctcttgccatttacccagttgtgggtcatccttacattgcttttcactgagttcaaggggaatgtggttgtgcagaaaagtctgtttcctgttcataatgtgctaatgctgcaaggcaagtagatatctgggagtttgctttgtgttcagaagtctttttgctgtggctggacagcatttgttgagataagatattattcgtgctgaacttaactcctttctgctgtttgtttgagaaaaagtacagtcaatgggcctccaatcatctaatttcaaatttttgtcctcttgttattcctgattatgtttatctccagtatagtttcttccttttcctccctgtgaatgatatactttgtcctggtaattcttttttacatttcaggggaagtactagatatagaacactttacctttataaaaacattatctctttctccttttcctcctcttcatcctcatcagtctttctgtacttaccattgtttcaaagatgctaattatttaattggaagcaatataaacttttttgctttgagaaaaggaactatgatgcttcttttcccctgtttcctggttgatttttatatccaactgtacatctaatctcaaatttggaaaaccctccatggtttagctccacatcttctctgactctgcacacccactctttgttccttcgtattgacctgccttcccctgtctttaccctcctccgttgccactggcttttctcccagctggtggttggtgttatgcttagctagagctgttccatctctttggaatctctctccccagtagagccattgagtcacttccttgtttcagttcttgcctaaacacagtcctacttactcttgcaagagttacaatgaatcagacttctgttttatttcatgttttccctcagtgcagtctctacaagtattttttgaaacctgtatcactttaacgttttgggttctctcctttggctctaaaagatgttctctactgaaacttaaaatattttatactttattatataatagtccttcatagcataataaaatgagttatatacatgtaatgaagacaattaataagagtatttcagtttatcattttttagtgttttaaatagtaagattaagtagtaggttcctgacatgtggctatctttatggagtggcccttttaatagttaaatatctgaagacttttaataaatgtgtcctgagagtttatcaaatggctagtactttaatgctggttataggttttacccacaccaggcaccagttgaggaggatgattggggcctggagtccagcccatgctctgctcatccaactccatgtcctgatgcaggtcacatcctacagctgcccttttctaatccccacacaggggttgatggagtcccagtatctgggattggacaagcatcatttaatctcacaatcctttggggttgggattactggctcagagaggttggatgatttgctgaacttctcactgctagtaagaagtttctgggatttcaatccaagtctaatgactccagtccagcactcttttcttaccaccactgctggatcctccttccccaggactctgcacagtgcagcaaacactcttggaatgagggtacgttgtaggcactataggtaccagcgattttaatacgtgaaaattaaatcttataaaaccttatgaaaccatattccaccatctatcacaatctcttcaaatcatcattcagcctctgaagcaactccagtggggagtttttaattgacaaaaattgtaatccttggttaccagataagttttgaactatctttcctctcacattgataggcagatgtaaaagtgtctatgatcacagcccaactttgaatatcagggaagtgctacagtattacctcaaaaatgagattaaagtctgaagatatgtgttcccagtcaggccaagatttagatacatacattaccctgcaatctgtaatttttgatgactagcttcaaaattaaaggtttttttcactattgcttataataattttgtgttgtaaatgtagtaacatggatatttgtggaataattgtaatgattcttgaacagccttaccttctgcatcacagtgttcatacagatgtgcacataggaagggttgaaaagttattttcatgcactcagtgttccaggaatcatgaccagtgcactgctgaatcaaggctgggagtagctttgtttgtttttcttccttttgccttatttgtataagtgctgtagttagaggcccaggcagcatgagcaactctagagatgtggaaatgagggaggaggagataagacaaaaggaggtggttaggaggccgtctgcctagacgcagtcctattatagatgtgagagcagcagaaacacttgagttttgctgtggtgtgtagtaacttgtatttcctagatgggataatgtaacctatcagtatgtagtgaccacagaaccttagaccttgcagaaatcgtaaaggtcatctgcttcatatcctgggcatccctgagagatgggtttccatggtcagctcctagtgaagtcagcatcttccactgttaaggagcattaactgttgaaaagatcttctgcttaatgaggttgaatccactctttctatgatttgtagcctttagtcctgccaatacaagttaagcatcccaaatccaacaatctgaaatccaaaatgctccagaatccaaaatgttttgagtaccaacataacactccaaggaaatgctcgttggaacaatttagattttgtacttttggatttgggatgctcaactggtattttcaaatattctaaaatctgaaaataactaacatctaaaatacttctagtcccaagcgttttagatcagagatcctcaacctggaccttcatcgtgcaacaggcttcctcttgctcagggtatctgaacactgccatcatgtctgcacgtagtctcaccgttccgcctttcctcagttgatccttacaggacctggttgccagaactttcatttctctgcttgcactgcttcatctaggtcatgcatgggctgaatcctgggacagctgtgtagggttgtagtgtcccttaatctgcagcccaaggttgtgtgagctttttgaggcactgtagcttgtttgacccaataggatttttgttttggatttgatttagctaaatattgggttgtaaatttagcacatttctccaggattacttattcgtaagacacatcctgaaatgataaggctttccatgttaatgtagtgaataattcacaaaggaggaattccatttgtgtttttaacttgtaaaacatcacctcaatctgtgcgtaaaaatatagttagcgtgagcctatatctgtgtgattacatctcaccagaaagcagaacctaacagtcatagacaaggattttctgaatgctgatctcatcctattccatgtgattctcttcagtgtggccttttggtgtgggagagagaagatctttcctctaccttcttttcctgtaggcatttcctacatccaggtgagaccctatggtgttcagtggtctcttgggtgagagccctgagtatggccacagagatctctcagatggagtttctggctgcacatcgaagcctcttcatagttaaataactgaagggcatatgtagaactttgagtcttgttataactgtgacttcatctcttgtagcttattcttatactgtgcagacccagtttcaagacacacacagtgttgtggtaccacctacactaccatttatttaaacaatttggatggcttatgctgctcttggctgtggacctgcaaaaacaaagccatgggataaagcggcctgaatcatgtaatgaaaaccttgtacctttctggaggccctgttgagaaaaaatgatttatttttgccctaccaaataaaacattctaggaatccaaggtgaaaattggattttaactgctactaacattttaagcatataaaatcagcaagtgttgagtgtttcgcttgattaggagatgaacctaaagagtccagtacaagaatgatctgcatatgatgtgaactggtgtcttacataaattttataaaactggaaataaaccctaagcatgctttggcagccaggttgcaacggtggggacctctgtgtttttacagaatcattttgttcccagtcttaggcctgggtcattgttcgcctttcctcccttcagtccttcatatttcagggttacacgttttgtgattaagctcaaggagtatggaaactacctgattccagccccaaatatgtgcctgtcttctctaaggttcccgtttgttctcacgttggatctgtctctccctcttcttctccccactctgcgtgtacgtgcctgtgcatgtttgtttcgtcatctctgtgactacctacccacctaccactttatcactctttttttggtccagtcttcccccgtgtctgagactgttcatctgtggccctgccgctgttccaacctcggggactttccctcactgcacgtggttaaacactttgctgagagccctgtcttcaaacagacttccccaggtcattgtgttggtatctggcacacaacgtcactcattgtttatccagttgtgttgttttataagagagtttctttatctcaaggaatgcgtgtcacgtgtctgcaggagttactgccccggtttcaagagatgtgatggtcttgggctttactgacttacactagggcttttttcagtgccttccccagaattacgtgttttttcaagttcatctaaaaaaaaaaaaagcaattgttttggtatgcctagttttgcttaactcagaatgtctttaacacctgcttttatattagggaagttcattttgtctcgtagggtcgtttcttatggagtctggtactttcgagagggcaattagactaacctgtttgattgacaggaccgtttacaatctactccactcacacgccttctactccctggggaatccgacaaacatttggggcctcaaatgggacatctggagtagggagcttttatctataataataataataatgataatggtaatgatagctgacacatgtaagtgctcagctataatgttcagcattgcacatgccttttttctttcatgtttcatgaccctaggagaaagatactattatgcactctacgttatgggtaggaaaatgtctaagataatgcgtgtaagaagtcctacagtcagaattcattctcaggcctctctaactcctgagtcacatttttaatcactatcatatactgctgttggagagcacacagcatcctgttgaaatcattaaaaataataaaaccttagaacatcaaagctatgatgtaactaaaacttagctgagccttctgtggtttggtcttgttttacaatttggatatgtagttacttagcgcctcagtcagaatgttgcatgcttggacctggcagaaaagaaacgctgcccctggaggcctgccaggtgactggtgtctactacttgctgtccttctgagggccaccacctgcctggaccttctgtcaccacactctgctcactagcctggggtatggatgctaaacttccattggttttcttttgttttttgttttttttttttgagatagagtctcgctctgtcgccaggctggagtgcagtggtgaatctgggctcactgcaatctctgcctcctgggttcaagcgatccccctgcctcagcctcctgagtagctgggactagaggcacgcaccaccacgctggctaattttttgtattttagtagagacagggtttcaccatgttggccagaatggtctcgatctcctgacctcgtgatctgcctgcctcggcctcccaaagtgctgggattacaggtgtgagccaccatgcctggcccctccattggttttcacatagccattgcttgcctggatggcctacaactagcttgttccttagttccctaggttgtttgttcctttcttcatgcagcgtttcctgagcatttgcaacgtgtactgtgtactggaatataaacataagatacatacgcatttaacaaaaatgcatctcagaggcagtagactgtatagacagtgctgtggggtaaaaaggagggaggaactcattggaattaaggagataggggaggtttcatagtgatggttcttcagagctattaatacatctcatgggttgaataaagtttattctgggaaagaaaaaaggggagggtgttccagccagacatgctccttttggaaggacgtgatttgttcagaaaataaagagccctttggtatgtctgcaggatagaggtggatggggacaagagattgccttaggtgggaataggaaggaccttatagatcattctagagtgtgccattttcagacaatggagagtcagtgaaagtttttaatcggtaatgtgaccagatttgtctttggaaagacaactctggaaactgttgggaggatttttgtagaggctgaggcagagaaaggcagaataaccccttggatgctctgtgtttgcacaggagacaaaaatgtggggtgtgttagcctgcatagcaggggtggagagtcagctggtcctcccctcaggctggcctttggatgggtccacagagcaggatctgttttcttaggcacttcctcaccccattgaggtggtctaacttcaggcccctgcctctcagctttttctcacttcctgtggttgaccaggagtcttacctggtcttaacactggacaaccagtgttgcaccagtagcctctaagtcctactcttctgcctgctcaagctggtctcgcttaaacatgctggcaccttcctagcttggctgacctccctgggtcagaatacttggctgcctggagccttcgtctctgctagagctgatttggcccagccagtaattgtttcttctgtcctgtctgtgcccaggccttggggttataggaagaccagaagcctcctgtaggtgggacctgtgccatcttctcacattttacacacatgccatacccttaagagttatgttccctgatggtccacacaagagatttaaacagacagatacaactaaaatctaaaaagcctatattgatcttacacactatgaggctcttattaagaaaaaaaggcattggaaatttaagttttatgaagtactctgagcagtgacagattttcttagactagaaaaacatcaaggtgctcccatttggaaatgtacttgttcatttttgtgttgtattgatttctgtccaggtattttctttccaagttttatagtttttttcctttctaattgtgtcgataacaagggaactggtttatagcgtggctgtgagggacagcagtgctctggggctgggcatcctgcactcaattaaccttcatatttcacacctaatcattgcagtgtggcaaagcgctccctggcctttcaaagcaagaggactgctgtggaactgtgggtacctcctggggctttaacaaatgccagaaatgccccaagaaaccatgtaagtaatgtttcctcactcctttgcaggttaatgtagcatatctgttttttatgattactcctttaatgatgaggcaatattagactttcaaagaactctcctactgaattctagaatgtagtactatgatgtgcatttccagaaaatttgcaagtctgaaaaagttttcatgtcaattattttgtaataagcacagttattaattatcctctttagttggattacttatggggaaaaaaagtcttaagtggtaatgagttaaaatggactttttgtctcaggggaagagaaaataagatctcttttaaaatggtaaataaatgtttcaaaccctgtaaaaagtacagttgttatttcctaggtttaaattccttaaatgagatttttattaatgtccacaacttatgttgtagtttttgttatattatcggttttcaaatttcattaaaaggaaagctaaaatggagaaataattggttgttgatttgtaaaagagaaatttataatcactaggacacaattctttcccattttttctgacactggttttatgctgtcacagacctcagcaacattaatctatattaacacccccaggctttgatttgcttttattgttcagaacatgttgatttgaataaatcagatttacacctttttaatactctattcctgacaataatttgtacctttagtttttcaatgtagtattaactctggataactgatttctaataaatacttttttttctttttgagacggaatttcactattgtcgcccaggctggagcacagtggggcaacctcggctcactgcagcctccgcctcttgggttcaagtgattctcctgcttcagcctcccgagtagctagggttacagacatctgccaacatgcccagctaatttttgtattttcagtagagatggggtttcaccatgttggccaggctggtctccaactcctaacctcaggtgatctgcctgcctctgcttcccaaagtgctgggattacaggcgtgagccactgcgcctggccataaatagtttttagagacagaggtgactgggtttaagttgagctttctgacccttattcatcatgtttttgccaagagagcaagtgatatttttgtcagtcatctttctttgcctcatataactgaagtttttataatttttttattctttgtactgcaagaaatttctcatttgctttaaatgaataatttttgtttactcctcttatctgttgatttgattgtattctcaaatgccttttaaacctctatattcaatctaggatttgccatctgggcattagtattccatatctctttcttacattatttgttcttctaccagtataacaattcattttaagtaattgtctctcatttggacttctttgtctcacaaacttacagattttctaaatgcctaaagcaagtaattttatttattttgttgatactactcatctctttttagaagactaacttgtggaaatgcccaccgaagttcctcataattaatgaattcttcatttacaaaaataatccatgtaaataaggacattttcagtactgagagaattttccaagcagatgttctaagctgattcgatgatcatttgcaatgcaaatttccaggaagtaggttgagtgtgatggttcatcgtcactggaagatccatttgcttaaaattattttggcaacctgaccaaagggatagctatgatgcatttggtttgatttaaaaattttagtgtttgaagttaggtagccctgagttcgactcccagctctttcatttgctattgagtcttagagctcattaagcaggaatctatacctaaaacgttgaagaggcgttgccatctttttttttttaaacctgcctctttgtttaccatgtctgtctgtctgtaggaatattgaggaggatgatatattttccactgtttggtctaagaattaaggatgagggaagttaggttcatagaactttgttttggtcctaagtctatgttctctaatattaaataccttccccatctgtcttatttttctttttcattttcatttacccccttctttgtgtatcttttgcttagctgcttctcttctcttgtgtccaaaccccaaagtagcagggatgtgatagacattaaaggtaaagagattcctactgtccttttattttttttttaatccctaacttccactcttgaccttttgtcgtttttgtctagaattgcgtcatttttatctaagatgagttcactgatgtctgtggtttgtgagctctgtattttaatcttgataaggacttagttgaatgtgaaagtgcaaagttgctgtcacttttaactaaatgttggtgaaaaaaatccatatgttggctcatttaatgtataaaattgaagagactgccttcacttcaggaagggcaatgtggactatgaatgaagtaaactgttaacatcttgacatttattctgtttgtgtcctcttaagtgactcactcccaagaaacacactcagggtcacattcttcctgtgtcatttaaaaagttttcctttccttggttgggactcctctctaaatcatattcagtttggaaggaagcagactttccttggctttctacgctatggttttgtgttccacacctcttttttttcactcaaactagttcaaactttagttttcaagtggcttttatttaacatttgaagtttttgtttagccacatacagaaagacctttcattgttgatcattttttttgctgtgaatacttaattttaaatctgcaaatgatttcttaaatagtttgtgacccattagaaatgtgcctagcatgaacaagtcacttgtcctttaaaacttttgagaagaaaatgaacataaaatcctaagctgaggaggactgtaagagattgcctggtctggctctctgccttcaagtagatgactgctgaaagttctaaaacaagttcatatccatctcttttgactttgaggaatttgcagccagagatcccacagtctctgcaggatgcctgctctagaggtctatgggacaagacagacctgaggccaaggagctgaatggagggactcccacacgcccatatctcccgtcttttaatttgcctttcccagatgcctcactctgatcttctcttttaggcattcgggggaatctgaagagaggggaaatacagcaaagaaaagaattgaaggagaagagggacaccccagtacatattcaccctgttcctttagtggtgacagataaagagcatatggggaggctgaaataattttattttttaagagaaaatttccctttttattttctactttccccttttactcctctttcaagtcttttttagtggtttaatctttcatcccattttgattatagcttgttttctgttgcacagtagcctcttaatagaagaattccttactgcaggacatagcaatggcatttgacactttgggagtgcttatcacacttaggccctgtggtaggcatttttcatgaattatctctaaattgcagaagaattcttccctgctcagtagatgggaattaccctcattgtatagaatttctgtgtgaaacccaagaggcttgtttcccaaggtcacagctattgataggaagaggatttgaaatccacttctgccacatcccagaactttggctgcatccgctatgccaggtgctctctcaagtctcactctagagtatcagaatctcaggaaatagggttttgttgagaagttggtgattgcaacatttgtattgtttgcatattctgagtgtagcccttttaatttcctgacttcctctcatcacctgcctattcttctctggttcataatggtgagaatcatctcatgactgggatacccgatccagcaattaggatgagtgtataatttattgtctaaagtgggacactttggggagtaaagtactgttaattaactttgctggaataacagacatcacccagaatgttccaggacgtgtagtaaccctacctacaatggataagaaaatccaaaacctaaagcacatcaatggggaggaatagatcctttgtgatggaaatatgtaatcactaattagaagaaaatgtacaacaatcttaggattgtttcagttaacgtaataaagatttactgataatttcttgggactttattgcaaaataagtatcctgaaaaataagcagaatgggaaaaaaattatggagatatacattggtattggtttcttatattaataaatgaataagtaagtttgctgatgccttaaatggcttcagatatcacttacactagtctaagattgtaagaatttaagtatgtaacaaagcatttcttcccttacagcttatcatggatacaaccaaatgatggaatgcctaccgggttataagcgggttaacaacaccttttgccaaggtaagactaactgaattcattgatgtggactcaacagttgttttggctttttagaaacttcagttgtttgccacggcttgctcattcgcccagcctgtcacagtgaaccacctcatgttcactccttttggctaaggaaatgtaaggaaataagtttaaaatatggttattggaattgctttactaccactgaaacttgatgcaagtttttaatctaaaagagtttggatagaatttaaaagagtttggatcacattagagagcacactgtggtttccatgctagtcacctcatatcctttcatgggcgtgtgcacacatgtgcttgcaggcacccacatgtacttagcagttctacttcattgccaatgcatggttgggcaacagaattcccttttctcctctcatcaaaatgttgttggtcatctcaggaactagatatcagagtaaacacattttgcctaggcaataagaaaagctatgtagctaagtgtgaaatgccctgagtacttttgtttggtttatgttgaacagtacagcaaagttgtacaagcagggggaagctaggagattgtctggtacagtgtctactttataaatgagaaaactcaagcccagagaggttaagtgactttcttgtggcagcatagagctgagattataacttgagtttaccaaggcctagtttagtacccatatatgatatcatattttgttttagttactttatgggaagaccaatgcttctaatttccctttacatgtctaggatgaagatgttgttattagtaacttggaaatatgtatacattgaaactgagaaagcagagagcctcccagagtctgatagaaccaaaagccatgttgagaacatggcacatgtcttctgatttgtgttctgaggctctgtatccttcaccaccatatgtatttaggatacagtagattaaggtcatgttacagagtataggttaaccccctattcaaatggctcatgtcaaaggaatatcttgattacctgagaattttctcaagtagattgtctatcaccctattcaaatggctcatgccaaaggaatatcttgattttttatctgagaattttctcaattgtctatagtgcatctgtgtaacttttatgatatgtagagtctttggtaacataaaagaatttatttagaaatgcacatacagtctgtctttgaaagactttgtcttaaaaatattgtaagccctcatgtgtcacagaatgttgagaaaattagaattaaccacttaaggagaggacacccatgacacattttgagaaacatctgctaaacttagtaacatgggaatagtggattaatctacattattttagagtcagaatttaaggtatcattgaattaattagatggatgaatgagtaggttaaattaaataatgaatagattttaagatgcatgttttacaatataaaccaagttattgttttatagatttggataaaagtctatagccttagcacatctgtaggatgcattagtagaaatggaatgaacagggcagtggaagtaacaaccttgtacactgtgcccctcagactgatttggggtttgggtgttcagtgttcattattgtcttttggttaataaagtcaaccaagtttgtgaaggacctagaaacatgagtgtgtttagcacgcagaagtacagactgaagagaaatattatggctgccctataaacacgccttaaaatgtttgtaaacaggccactaaatgattaactgtcctacaaaacaagacatacctaataacaggggacacttcaggaaactcggtgtcgaggggctaaaacttatgtgaaaggctgagacgtaattcctttcttctcatgcacagtctctgtcccaggggactgatggtaatgatagcatcatagaactggaatgtgcctatgggccatctaaccttatatgctgttcaggataaaaatactcttatcatatccctggccaatagttattaagaagctatcagatcacctctgtggacaggaagctcagtacttccaaagacatttcatttcaaggttgttggggaactctattccacagaaaaggctttcttgtagttgttccgttaaactagaggacagaggagggtccttatttatccttcactaatccaatcctgcatagctaattgttagatacattttccagaatgtcagatgctcctaatttctcttaatgtcaaatggataaaatatacatatgttctcttggtatggtgtgtttatttgtttgccattttttaccattcatagatatttgaagacagaaggcttactctctcttagatagttttatggtgttatttcttccttacgtatttagcgtaattcacaggagaagacatttggtcctgaagttttcttttagaaagtgtttcggttatggagcaaattaatagctatactattattcagatttcccattactactttgtgtcagttttaataatctgtattaccttagaaagtgtcattttatccaaaatgtcaaatgtattaatatgaaatgttttcctaatatcctcttttctttttaatttatatagcaacccccatcccttttagttatattgctacctgtgctatatttgtttttcttgaattaggcttgccagtggtttatcaatgttaccaatttttcccccaaagaatcagttatttgttttgttgaaaacatttgtctatttcactaatttctgatctttgttttcttttcctctacctttttgttcaattgctactatttctaatttctttagatgcatacttaggtcattgatgtcagcctttcttctttttctgaaatgtaaataaaaggctgtaaatttctatcagtctagattctgactttaactgtgtcccttaattttgtgtcattttcttatctttaagttcaagttttaaaaaaatttccttttattttttatcagcatataataattgtacatatttatggggtatgtagtgatgttttgatacttaaaatgtatagtgatcagatcaaggtatttagcaaatctatcatcttgaacatttataattggaacattcagtgtatcttccttctacctatttgaaactatataactacaaaacactagaacttattcttcctatttaactgttgtattagtccgttttcacactgctgaaaaagacatacccgagactgggcattttacaaaagaaagagatttaactggacttacagttccacatggctggggaagcctcacaatcatggtggaagccaaggaggatcaagtcacatcttacatggatggcagcaggcaaaagagaacttgtgcaggggaacacctatatttaaaaccatcagatcttgtgaaacttactcactaccacaagaacagcaagggaaagacttgtccccatgattcattacctcctaccaggtccctcccacgacatgtgggaattcaagatgagatttgggtggggatacagccaaatgatatcagctgtcattttgtatcttttaacaaatctatctttaactttacctcccctctacccttcccagcctctagttatcttctgttctactttttacttcagtgagatcaacttttttttgcttccacttatgagtgagagtatgtggtgtttaactttctgttcctggctgatttcacttaacataatgtcctccaactccatccatgttacacaaatgacaggatttcattcatttttatgactgattagtattctgttttgtatatacaccacattttctgtatccattcatgtatttttggacacctaggttgattccatatcttggctattatgactggtgctgcaataataagttcaatttttaaaaattattctgattttgttattgacccatggattatttagaaatatattgcttaatatgcaaatacttgtgaaatttttcttgttctatcagttgttgagagaggtgttaaaattgcctgctacgattatggaatggatttttttctttcacctctggcaaatttcagtctgtgtttttttacctttacaatgggtgtcttatagacaacatgtagttgagtcttgcttcttttctacattctgatatctctgcctcttaataggggtgtttattgcagtataatctaaagtaattgatcctggcataccccaaagttggggcctagcctgagagggtttttggctctgctcaggaaagaattcaaggctgagccagcagtgaaagaaagcaagtttattagagtagcaggtacagcagaatggctgctccataggcagatcagggctatcccagaggtggggtggcccagcatagtagcagcagcgtacagcaacagtagccatccggagcagcagtccctgtaaattgctggctagctatatttaatactcactcttaataatatgctaattaaggggcaggttatttcgaattttctagaaaataagtggggagttcttggaaccacgtaagataacttctgggtcactgtcgtggcatttgtgaactgtcatagtgctggtaggagtgtctttatgctaatgagcagtgagggtgactagaggttgccttcatggccctcagttggttctggccattttttctgctacagcctattttgattagcagggtcatgattagtgctcagaaaataagtcctgctgatctcctacctcataattattgatgtggttagatttaggtctatctaaacatctttgtctgatcaggaatttttttgttcttttctttcccttttcttagaattccattttatctattggctttttaccaatatgtttttgcatcattttaccttttttttttgtcttttttttgagacggagtcttgtttgttgcccagactggagtgcagtggcatgatctcagctcactgcaacctccgcttcctgggttcaggtgattctcctgcttcagcctcctgagtagctgagtagcaccaacacacctgactaatttttgtgtttttagtagagatggggtttcaccatgttggccaggctggtctcgaattcctggcctcaagcaaatcacccgtctccacctccagaagtgctgggatcacaggtgtgagccactgtgcctggcctttttgtattattttaaagggattactctaggaattataatgtatgtagtaactgatagaccgtttgtattataattcctagagcaatcaggaatttgacagtttaagttttcatagcctatttagagttaacatagtacctctaaacagaaaatatagaaatcttgcctccaagtagctcctctttttggcctgaaaatcaatcccctacttatgccccatgccacacccttagtgaaaaccaccatgacagtctcccagacagtagtaggatttcctcttactctgtgttggaattatttattcacattatatgttgttgttcacctctttcttttcctgacaggctgatttctcagacatcaaggacccagtcttactcacttttgtgaacccagaggcccaatttttaaaaaatagatttgatgtggatgaagaaagggttcatttgttattgatgagataagaagctcttttttttttttttttttttttttttgacagagtctcgctctgtcgccaggctggagtgcagtggcataatcttggctcactgcagcctctgcctcccagattcaagcaattctcctgcctcagcctcctgagtagctgggactataggcgcgcaccaccatgcctggctactttttttatattttcagtagagacggggtttcactgtgttggccaggaatgtcttgatctcctgacctcgtgatccgcccgcctcggcctcccaaagtgctgggattacaggcatgagccaccacgcccggccaagaagctcttattatagctttattttatttggtccagtaccaatgacttacaaataaaaccaacatatttgtagtgattcatgataaactatgtttgtaagcccagaagtcataaacttataaagagggaaataaataatgaattaatttgattttaataactaaatttactgtgtgccagatgctttgtttaataagcactttatatcagttatctccattagcctttaagttttctatttaaagtaggcactattataccccattttacaggagaaattgagacctagagaggctaagtcatttgtgcagcatattgctaataagtgctacatgcaggaattaaaccaaggtagaatgaggccagaacttatgctatcaaccgtcttgttctgctttagggaaagggaactaacctttattgatcatttactatgggttagtccatatgctatgtacttggtttaatcttcaaaacaatcctatgagatttgggcattattattctcaattagacattgagacacagagaaagtaaataactttcccagggtcacaaagatagttaataagcccaaccagggttataccctttttttttttttttttttttgagatggagtcttactctgtcgccaggctggagtgcagtggtgcaatctcggctcactgcaatctccgcctcctgggttcaagcgattcccctgcctcggcctcccaagtagctgggactacaagcacacgccaccacacccggctaattttttgtatttttagtagagacagggtttcaccatgtttgccaggatggttttgatctcccaaccttctgattcacccacctcagcctctgaaagtgctgggattacgggtgtgagccactgtacccggccctaaccagggttatactctcataccacctatggccacctttaccaattatatatttgtttatattttgtaaaatatcactaatgcagatactagctaattagaagttatgccatctgttgtgagagctaatagaagtcaaagcaattaatattaattttgttttatttcattaaaaagtgatggttatcagccagatgtaatggctcatgcctgtattcccagcactttgggaggctgaggcagaaggattgcttgaggctaggagtttaaaaccagcctgggcaacaaagcaagaccctgtctctacaaaaaaaataaaataaaaatttgctgggtgtggtggtgcatgcctgtaatcccagctactgagaagctgaggcagaagggttgcttgagtccgggagttcgaggctgcagtgagctatgatcgtgccactgcactgaagcctgggcaacaaagtgagaccctgtctctaaaaagaaagaaggaagggaggaaggaaggagagacggagggagagaaagttgtacaatacatttcttttactggctgattaatgttttgaataatttatattaataaaaataccactttagaagtgatagaagtgcaaatttgcaagtaatcacttgctatctattttgtatgttagaatggagacttattcaagtaattgcatgagtttttttgcattttcctctgtcggtacggctgactgacccttagcaaactttgttcatactgagcatattagatggttctgccttagtcaattcgctgatggtctactggtaacaccaaatcctggcttaggtctctggaggatatttgtaaagcagtgttatactttttggcaatgattctaaagtgaagtaacacacaaaattctatttcatgggtcctcaaggaggcactgctaaattacattacaaaggcatttgactcataatatgatttcattcagtaaatctattgaaattactattgagagaagggcttaatttcactccctttgtgatattgatggtcagtaaaatgaaatcgaacttgctcacattacatatgtacattcagttttcctagaaccttgaagctttttgattttgttttcctaaaggttttcaaaaggagcccatttagcatctaattgcttgtgccttccacattgttcttacagtctaatgtcttctcagtttacaaagcacttttaaaattaaagtggttaataactagaattacattatttccttcaactaagtgaactaatgtcctgaaacaacttttactaatgtgcactcagtaacaaagaaccaactgtatacatgttaatttgaggagctttcaaataattgccctcaaagttgttttttttcctcctctctagtggtgctgcaattatcttttcaaagggatgatttattacatatacacacatggagctccaaaacagccttgctactctcagcattatggaattgttataatttgcttcatttatcataacaaacaatatagttatatgctctgatggatctagagcagcatttgtcatttgattattatgctataaaggtctgatgtagaactagaattaaatgaaataatactaagagctcctacgtccatgctgcttttctttaatactcagtccttccctgagtggaaatactgagtaccctcttttgtccatattttgccataagtgggttcttaaaaagttagatgtaaatctaagtttcaaaaatagaatttggttctgaaagtacttggggaatcagtctgttgagtgattttattaaaagcaagtatctcttttgacataccaaagtcacttaccagtttcagtttacaaggataaaatcaacttagtattatttgctacatttttggcacgtactgtgggcaataccacagtacctcagtacgtgctgaatgtaattaaaagacatctacacttttataattcagtgtatgtatattcgtttttcatagatcatctcgaagactttttaaatgactcagtattccacaaacattaatcgctggggcactcctagctatagactgaaagtatgtgtgatgaatgatgggtaagacattgttcctgcccttagaatttagtgtaatgaaatcactttgaatgagcaggatgcaatgtgctttatttactcttcgaactagctgaattttagctggctccctatgagcccgttaaaggaaataggaaagagctagccacataactttctttcagcatcgttttattatactcgttctgctttaataaaataaatttatgaaaccgatacattgaggcacaagaatactcattaccaaaactttcagcctaggctccttttagataaaaagttcctcggagtgcatctgaaatcacattttgtttggacaaaagaagagataatgtacctgttttcagggggcatatctgttattaaatgagactccacagtcttgatcaatattctgcataaggactttttggctacaaagcgcttgtctggactgtagcttgcatttcagacctcttcttaatgattaccaaaaaaatactgagtgtgaactgcagtactgtgagcaggtaaaggcagattggtctttgaatgctttgagaaccctagataaatgagcactagaaagtgcaggtgagacccccaagaaagcctgcctggctggagaaaagaatgtgtcttgtagcatagtgctggattaaaacagacatgtagaatgaggtgaaatgattgagaatcttaaggcaaagctcttataattaatcgaaccatttgcatgcaattaattatgggctttgtgatacgtgctgggaaaacacttactggatttgttctgcttttaacataatgttaaagaaaaatattgtttataacatttgttaaagaacagtaagacagattttattcaggtaactgttgtaacaggtataagaactactgcagtggagttttggggtaggggagagagattgggctcaactctgaaaataaggaaaagtaaaagtgtatcaccaaggagtgagggtgagagtgtgatatcagtggatgaaaaattactaagaggacacatgaggggtaaggggggattctggctcaaccatcctaggagggtattcttgctgaaggcagatcagggtgaccagacattacctaggggttggtggaagatgaggaacccaatcagatatccagcatgggggattctggctaaactaacttaagaggatattagctaaaactggacaatgcagagacaaatacagaagcatacatgaagtcagagctagttgagaagagggttcagaggagcctgactagagtttgatcaaggagagcatctttgtcgatggaacactgaaaggccattatggcaacctcttggatatttgaaagaaaatggatttgtggcttagaccagagtcattattttacaggtattgtcaaaggtgtacctaatggaaataaagcctttttccctcatatagctaatagttaaatgaatttactgtcatttttctgatggcagtatttcttgtatcctgtgcttgtttcctgcatttgtttcttcttttggggaggatttgccaaataaaatccagaacccagttaaatttgaatttcagataaacaacaaataggtttttaaagtaagtacatctcaaattatttatttgaaattcaaatttgactgctatcttgtatttttatctggttaatctgtattttgaggttatattctttaacagatcctttagtgagggtcactaaagtatatactttatgtgtctgaaaatatctttattttgcactcattttataatgagactactcgtgtgtacaattccaggttgatagttgttttctagtggtgcttgactacattataccaaagtcttctgacttctgtgttttgacacctcttcctttgtagataatgtgtttctctcttttgagataatctcctaattctttatgttctgtagttttatcattatgtgtctatatttagatttatctttattttactcagtgtaatgtcactctgaaaactcatgtctttcctcaaatttgaaaagtgttcacctattatgtcttcaaatatcactttccaccatgcttttctgctgaaactctcattaaacaaaagttggagtgtgtttttcatggctcttaaaaaatcttttgtctttttattctctttttcgctgcattttgaatggttatctcagttccattttccaattttctaatttctgctttactatgcccatctaggctttatctcatttgttacatttttaattttaagactgtttttcatttccaaggtttctaataaattattgttcatagctacctgttcttgttttatattgtttaagtattcatttaactggttaaggtatgctaaaaatccttaaagaatcttggtaagaccatttcgtaaaattattctcatctagagaatatttgtgttcaaatcattggcttcaattagtttcttagcaaacaagcattaaaatttttaattgggttgataagctcactttgaatcagaagtttattttcatcctccccacccttttcctttttctgtctagcaattttatggaaatttccacttggagtttggggccgttggtctagagctagattataatgatagcttctgacccatggagcttttctttttatgatactgtttgcataagaatgtgataattttcctttttctaatattagtaaatttactttttgttcatgattgccttacacaacttttcaatctacttatttatatattttgctaactttttttttatttttattttttatttgtttatgttaacttttgttgaatgactattcagtggagccattgtgttaagtacattggagacaaccttgtgagataagtagtggtttgtgtgtgtctgtgtgtgtatgtgtgtagctccctcttttctagagcttatcactaccctttcaacttcagatcaattttatcttacgaactttcaaataattcagtaagtgttttctttagtgtctggcttctttcactcaacagtatatggccagcacaatttttatttttagaattctgccttataaagtgaaaatatccattgatgtttttatttaaacaccttttcccctcttccatcttgttcttctctgacttctctgcttagaccccattgccccaaagttacagctttgtctctaaagttgccttcagttgcattatcataagtgagttgctatgtttatttctttctagaaggtttttgggaatatataagagagtgatgtgggcataaagatgaaacttagacgagatcgggcacattcagggtggtatggctatagacacgagcattcctatacaccaataatagacagacagagagccaaatcatgagtgaactcccagtcacaattgctacaaagagaataaaatacctaggaatacaacttacaagggatgtgaaggacctcttcaaggagaactacaaaccactgctcaaagaaataagagaggacacaaacaaatggaaaaacattccatgctcctggataggaagcatcaatatcgtgaaaatggccatactgcccaaagtaatttatagattcaatgctatccccgtcaagctaccattgactttcttcacagaattagaaaaactactttaaatttcatatggaaccaaaaaagagcccgtataaccaagacaatcctaaggaaaaagaacaaagctggaggcatcacactacctgacttcaaactgtactacaaggctacagtaactgtatatgcagaaaacagaaactggaccccttcctcacacattatacaaaaattaactcaagatggatgaaagacttaaatgtaagacctaaaaccataaaaaccctagaagaaaacataggcaataccattcaggacataggcatgggcaaagacttcatgactaaaacaccaaaagcaatggcaaaaaaagccaaaattgaccaatgggatctaattaaactaaagagcttctgtacagcaaaagaaactatcatcagtgcaaacaggcaaactacagaatgggagaacatttttgcagtctatccatctgacaaagggctaatatccagaatctacaaagaacttaagcaaatttacatgaaaaaaatcaaacaactccatcaaaaagtaggtgaaggatacgaacagacacttctcaaaagaagacatttatgcagccaacaaacatgaaaaaaagctcatcatcactggtcattagagaaatgcaaatcaaaaccacaatgagataccatctcacgtcagttagaatggcgatcattaaaaagtcaggaaacaacagatgctggtggagaggatatggagaaataggaacgtttttacactgttggtgggagtgtaaattagttcaaccattgtggaagacagtgtggtgattccttaaggatctggatccagaaataccatttgacccagcaatcccattactgggtatatacccaaaggattataaatcattctactataaagacacatgcacacatatgtttattgcagcactgttcacaatagcaaagacttggaaccaacccaaatgcccatcaatgatagactggatgaagaaaatgtggcacatatacaccatggaatactatgcagccataaaaaaggatgagttcatgtcctctgcagggacatggctgaagctggaaaccatcattcttagcaaactaacacagaagcagaaaaccaaacaccacatgttctcactcataagtgggagttgaacagtgagattacatggacacagggaggggaacatcacacactggggcctgttgggaggtggtgggctaggggagggatagcattaggagaaatacctaacgtagatggcgggttgatgggtgcagcaaaccactatggcacttgtatacctatgtaacagacctgcacattctgcacgtgtatccaagaacttaaatataatttttaaaaaagatgaaacttagaatatattgttcttggtatatgttttggaaataatagtagaaaaccaacaggtaagaactaagactgcggtcaaccagacttgataattctgttcttcaaaacacttagaaatgtttaatattccttttgtttagcctgccagaggttaatcataattttctattgtattttcatttaatctcagaaactgtcatgtacttagtttgatgccagatcatgttttacagtggtcaatggctcagtgggaactgatagataatttactgatttgaaggtgttaactgttctggtcatcctcttagaactactgctgcactttctagtttaaatgtgcacagtattttcagtaagaatttaaacagtttttgatctggacctgagcaccctatttcagcatttgcaaatcaaattgggacccattcctgtgcattttagaattatttttctggtgtgtcctcttactatgctgggataggtttcaaaaaggaaatgtctgtttattttattaactcttcctcaggaaagacagtggtgaagtgagtcattagcacattgtatttttcaatagctctttgaccttaatctctgtggctataaaatgaatgggaagatgcctactgtattatgagtgatgaagaaagcccatgatggattcatgttactgtgaatatttcaaggagaagttaatgtaatatctgtagactacagtcatgaatccaagaccaacagagtaagtgtgtgttgctagcagcgtcgtccatgtgtagcacacatgtgtcaagaaataaatacaagctgttctctgggctctgataattcctttatcatgttaccccgaagacagaagaattggaaggaaaggagttgctgccacagtggtttgacttttttcagtgagtccagtgattgaatccatcctatggtggatggtcattttataatcatgggacagttacagggtggtgggtaggcttttaatggcagtggggcctagatagaagcaaatataatcacgaagagactcatacaatagtctttgaagctggccccagagagcagcatttcacaaaaatgtttccacagatgaccagttcagaaggatgttaatagattgtgtgttaaaaagggtcccacagccaaatgtgcagaaaaaccaagttaaacacagaaaaacaagagattttgccaaaggactcttcgggttttaaatatgcttatgtatatagaataggcagtgtttctcaaacatatttggctgcagaacccctcttttagcagaggtctcacaaagtctgtgttttgtgtaaaataccttgggtaaaattgctctagaacattggttttcaaatatttttttcttaatctcctagaataattttgaaaaagttatgtgttcacatatctttaagctgacatctacattttcattaaaaagtcaagtggatacaataggttaatttctggcacatttatattgtatgtgtgcattaaataatttcatcaaaactttggagctgcagaattggttcatgccattgataaacagtctctgccatttaacctaattggtaaagccagatcttcttatgaaagaaatcggactcattactttttctgtgactctatcctggggttgatatatttgtgaattgttcatttattctgtgcctgtgagaattttacctttcaagacagtgttcttagaaaggcctagaaagattctggattgacaagaggtatgccttgacttggtcaagagcaagaaggccctgaggaaaggggaagataggaaaggaagattggcaaatatattcttaggcagatgacttcaaaaagaaacatctgaaggctgaagatctatagattagttcccttaaaagtgtctaagcctgtgtgtaccctatagaatatcttcatgttccttcgtggtatgtctacccagtgcaaagttgttctttggaagtttaagaaatatatatattgtctaagtgatccttattaaataacttaatagtctgtctgggaaaagtatttgtattaagaggtatttttctgctttcaagtggaaggcatactgctaatggaattctgtcatggaatttatatttactagcaaaagctgaacacacacagatgaatctccagaaagcttcatattttcacacagtagaaagatgctcatgtcctgttcttaccttgtcctgactcctgttggacatgcctcatttcctgtataaacttgcgtcactaagaagacagtaaattcttactcactttgttaaacatacatactttcctgtaggagaagagatgcataaaaatatatttatttcccagaagggcacttgtgctgttcgtaatatattatgcaccaaatgtcatactttctttattccctggcattttcagccctggcaactggcagattgttttgaagtcagagaatatttaaactacaagtaaccttggggataatatagttcagcccctctgtgttacaggagaggacactgagatcaagagaaactcagagacttgctctgggtaacataacattttgtcctagttggaccaaaagctagatcttagtggaatattcctcctattattttcccccatcctctccatcctttttagaaatatggccttggacgaaattatctctgtaaaatggaataattattcttgtactgctcaccatccagaattgttgtgaagttccagtgagatacggtgtgctatagaaatgtaaagaatcctgatgaggtagaaggaagatgaaggtcctcacttcatcgtcaccttatcgcatcattcccatgtactgaaatacttaggctgttttatgttgggttgttcatagggagtctcttgttatgcatgtatacctgattactttatattcttctactacctggttaataaaagcccagccctcttatttctgttgtattagtttgaaccataggacattgccaatatttgaccattttagaagaagagcagttttagaagaaaagcagttttgtgttcctgaacttcatctgtgagctgaagtatgtggtaggctatacaggcagagatacctgtaaatgttttaaataagtggaaaagtatgtaaagctccttcatgttagctgtagtagcttcatggattttgcctactccagaggagcacatgggtccgtatgaatttctttcctagtttctgtttctgtaaacttctagactgcctgcctgaacacaaaagctcagatggggatagggaatggtgactggctgtatgtgggtgctgagccccttcagccatttattttggccttcattctttaactcaggaagttgttctgtatgcagtggttataccacttcttcaaaggacagacttccacagttttccagagaaatttgtcatctatagagggagaacaaggaataaattcatgtatttttcaaactaaatattaaaatacttttgatttagttagaatctgttgaggaaggtttgttgacgctttaaaatatgagacttggccggatgcagtggctcacacactttgggaggctgagcactttgggaggccgaggtgggcggatcacttgaggtcaggagttcaagaccagcctggccaacatggtgaaaccctgtctctactaaaaatacaaaaaaaaaaaaaaaattagctgggcatggtggcatgtgcctgtaatcccaactactcaggaggctgaggcaggagaatcgcttgaacctgggaggcgaaggttgcagcgacctgagattgtgccgctgtactccaacctgtgtgacagagtaagactccatcttaaataaataaataaataaataaataaataaataaaaatatgagactcctgaaacactatattgttatttgaatttattccttcacaaataagctatttataaaatgacaaatattgtaatcaggttttatttgattaaagaaagaagatagctttaggcaatgaagtccaaatagaattctggtttaccattcacccgtcacgttccatacagttgttaagtctgaatagaattacggtttaccattcacccatcatgttccatacagttgttaagtctaaatagaattatggtttaccattcacccatcacgttccatacagtttttaagtataaatagaattctgctttaccattcacccatcacattccatacagttgttaagtctaaatagaattctggtttaccattcacctatcacgttccaaacagttgttaaactttggcctgatgatgtcatcacttggaatgttcttctctcatccagatacaatgcgttcagttcaaccaatgctttgttcttaacgtgtttgtgagtctctgacatcctttactttaatttagaaagcttgtgactacctgtctaggaaaaatcacttaggcagttgctcctgtttcttaataattagaaatgtcttattaatttattaatttctgaagtcctatgttaaaattatggggataagttgtttgttggctgggaaggggcacaaagaaccttctcaggtgatggaaacattctttttttttttttttttttttttgagacggagtcttgctctgtcgcccaggctggagtgcagtggcgcgatctcggctcactccaagctccacctctcaggttcacgccattctcctgcctcagcctcctgagtagctgggactgcaggcacctgccaccacgcctggctaactttttgtatttttagtagagacggggtttcactgtgttagccaggatggtctcgatctcctgacttcgtgatctgcccacctcggcctcccaaagtgctgggattacaggcgtgagccaccgcgcccggccagaaacgttcttaatcacaatctgggtggtggttacaccacaagtagatatgcaaaaattcatctagttgtatacttaagattgatatattctagtgtatatacgttaaatataggaaacagaaatctaatctctaatttgtagtagctcaggaaatataaaaaaatagatgaaccaaggcagttgaaggaaacagtttttctggaagctgtgagaatgtgtcacaaaggaaggcccaggcttcctgggttcttcgggccaaaattaggggaagtgttggtgccagtgccggtggcacaagctgattaaaacagtcataacaggaagagtcttacacgattcttcgtctttgtggatgtttctgtttcttcctgtctatacctgataggtttgcttggtcattttgtttgttttcttccgtctgaattcctgtcctccattcccatggcatcagagtcaaggcagtaagcagtgtggagagtcaaagaaggggcattggaagagggtactaggcattggttgtaaatcaggtatttatgagtctggggggaaacctctacattaacctggcagccagccgcaaggctgagatggtgctgttatagaaaccacctagcaagggaaaattctgggtcctcaatcttatcatggaatgtgtagtggtgcagccaatgaacaggaatacaggccattcaggggaagaggaatgctaataatcataccctagtgaggatatgaggggaaatagaagagtggaaattttgtccagccttcttgaccacaactggctggttacccaaacttgaggttttacttgggacatataatagggcttcacttgtaccgtgtaagctccaactggacttggcactcttcctggtccttcatggtggttttcttaaaaagaatgagttacgggggaatattttcagttacatgctgtacataaaagtgcattacagaacaacacacacttcaataaataatgagatggtcaggtgctgtactgtgtgccgtaccaggtgtcatctagctgtagcagtttccagctacgtgcaagttggaacaccatagaatttatacagcaaatatgcattaacttatcatttgaatgtcacggaaggtatcatattttatcactgaaattaacttaaaaattgcatgctctgagtaaaatatgtacgtatagatcacgatgcctacttagaacatgaaatattgatgttcatataatgttaatatttgcttaaatagtgattgagggctgtattttctttttatgtgatgatcctgatagtaatgttttgctaccattgtatccaactttttgattttcaattaattacctttgcaagtgactatataatctttctttgtaaaatcacttcatttatatctctcctctttcaaatcgctttgatttccccctggatctccatatgcagagtatcttaagtgtctatttgtagcagtgatttcctctttcactgtatttctgaatcttctgctgctactgggtatttctacttgggtatcccaatgtgaccttgaactataaaactgaactcctcttcttcctgccttctttcttcctcagaactccttccgcaaaaccagctgtgatttttttttccttttttcttagattaggagcctcccagacatccttgactcctttctcttactttctcatgatgtgtagtccagtcaagcaccatgcattttcagttgttcttaaaaaaaaaaaaaaaaaagatttgtccattctttatcttcctgattgttctcactgtcaccagcctggctgttaccaacctcatacttgcatgaccccttcaagtgatcagacttttaatctcttctcaacaagccatgtgttggccaggtgaattttcctagagtctgtctttgagtctttctttctcctgctcagaaacctttagtatatagctccctgttctcaatgaaactgaatccaaatgcagcctgaattgtaccagctctgtttccaactatttaccttcctgaatcttcttttccagccagtggtttgactcatcatttcctgagcctccatccactggccacactctgtgctcaagctccagggtttcccacacaagtcattccttcccttcctcgcccatccatccagctcctgcccagacatcagcactctaaagccttacctcctcctcagtgccacagtctgccccacctccagcttccttctgtggcttttactgtctgtataggcaatttcataatttaacttctaacagtttatgacagttctttcttgtgatgacttggactgcttttcacttcttaagtttttcaaatattcatatgtatagttagactgtcagtgcttctagagtgagagtctttgccttacctatatgctccataatgcctaacataaactaacactaaagcaaaagctctgtgaaggccagaatttttatcagtttttttcactagtaaatccttagcacctggcatgtagtaggtatgtaataaatatttgctatataaattgtaaatgttcaataaacattaactgatttaagattattcacacctgctacatccttttttcactataactaaaagattactatagtgaaaaaggaagtgaatgcaatgtatagccagaatctgctcaatggggcttgactgctccttctaaagaattgtgttttcctgcagatattaatgaatgtcagctacaaggtgtatgccctaatggtgagtgtttgaataccatgggcagctatcgatgtacctgcaaaataggatttgggccggatcctaccttttcaagttgtgttcgtaagtaataatcactttttattcctgttttggattaattgtctttggggtttttccaaaagaacggaaatactcagtggccaactgaatgcttgtaaatatacaggaaaacctcattaattaaaataacaagcaaggggcctgcctgatgtagtaaaataaattgatatcatggaaccttctctaaaatgcatttttattgtggtgataaaaatataatagctaaaactctgaatagagactaagcacaccgaggaaatatgctttgatgaaaagaaaagagagaattaaaatggacatatcaaacttttttggtacctgagagatgacagtaagtttttccttcataaatacggtattttaagcattctttaggttgaattgaactgtgtcccagcttctgcctttaattattccaaattctgagtcactggactctgatttaatgaggtttcacttctttctcaattgtaagagtctggaaaatagttaccaaggccctgtgttttagattttctaattcagtcctaatttcagatattgtcttgttctttaaacccaccaaaatgaccctaaattatactgttttgccttaaaaatgtttctgagattttcccttgtttctgataagggtaaaaatccttcattaaaccacatgttctaatattggttctgaaagatagtttcaccaaagagatactccctctccgtgtaaattaatccatgtaatcactacagatcatatgccattagagaggaatgcattttaggtgtaaagttctcaaatgcagatttgagatttttaagaatgtcttatttttaaagtaatcatgcccattattataggtaagcactgtaagattttttttaaagagatggggtcttgctatgttgcctaggctggactcaaatgatcactgttcagcctgctgagtagcatgactatagacatgggccttgtagcactgcagatttttaaagattatatacaatttaaatggctgcatggcagaaaactattaggataattttaagaacaactgtgtattagtttctttcctgcaagtttttgtttttatctatctatctatctatctatctatttatttttgagacagagtttcacttttgtcacccaggctggagtgcaatggtgcgatctccactcattgcaacctctgcctcccgggttccaatgattctcctacctcagcctcccaagtagctgggattatgggcatgtgctaccacgcccagctaattttttgtatttttagtagagacagggttttgccatattggtcaggctggtcttgaactcatgacctcaggtgatccacccgcctcagcctcccaaagtgctgggattataggtgtgagccaccatgcccggccacttttatttattttttaatgtggctttggtatataatgagctgcatctttcttgtctagtttgaaatttgccatttggttgacatgttcttcatgagtttactgccattcatttttaacgaagcttatctctcttaactctttgccctaaggtgagatatgtagaggtgataaaataaagacaaatgtagtaaaataaaaatgacagtctcatttattacttttaggtgagtttgttgagtcttttgaaatgttatcactaattactactcttttcctttaaaaactgtcaactgcagattaggaagttttacacgtaagtcctcttttctgtgttcttttacaaacagttctgatcatgaagcagacagacacctaattataaggctttcctaacgggtggtaaaattagaccataaaattacatttgcacacaaattacctttgaaactgatgcaaggatttggaaatttcaggccaaaaatcacattgttgatgacatccagataacttaggggatcatttttggctgatttgaatcacatgaataaatatgttaaatcattttataatttaaatgtaaagattgtagagtttggatatagagtttgttgtgaatgctttttccacccttttataatttgacttgtagtctggttacaattcttatattgaaggttgctgattaggtaaacttgcagaactagtcacaaaacgctctgtgaaactttgaccagatctgatgtctagagttgagggcagacatccaggttttaataagattatagaaatctgccaatgagatttttgaaacacttgcacatttccttagcatttattttccctgtcattgcccaaataattctgaacttattaaacaaccatccattcttatttgaaaaataaataattcaattttatggttcagctacaacagctgaactgataagtattaagagacgtttgttgctagttaagtgttccagttgagagttcgaagtgaaaacctgggctctttaccagtgttgagtgagaagatttatttctctttcctctgaatttaccacatgtaacatcacagagacatgtagagttcctttaggatttgcgatttgaaccagtccagtctgattttcaggtgaattctgtgaagagcttgatgggggaagtctgaagacagaaggaattagggaaaagggtgatacttacagagtaaaggaaataaatgaaaagataatggtatttttggtagtcacagggaaatagcaggaggggactggagatcacacacacgcacacgcacacacacacacacagacacacacacaggcactcaacacagtggttgctaaatgtttgctctggagagagagaaaaccagccagggatgaagcctgcaggcaaatggaggacaaatgacaacatttgctaggacagcatgaatttaggccatatccagagcatacaaggtgtggctgactctctgaactcctgcacatggttatggccaaggaacaacgggaagcactttctcttcttgaatgcactgaactgagatgaaccccccagaattccttgactgcagccaaaggttgcaacaatttcactttctctccttgccgcttgccttggcttagccaagctaaaaggaagaaagcaggcaaatgctggcatttgctgcctctgacctctatgtttgaggcttaggatggtgtaggagcattctccagacatgttgctacctgatttatggggaaaggtggaaattcgaggacttttcagagcaaattcaagaaaagtatcatctttgcaatccaagtaggaagactttctggctttctgaactcctgcaggaacttcagagctccaggatgagtgctgctgagaatgtgtccataggttcagtaaaaaggcccagataaaagaattctgagcctgggcttttgccttttcgtagtattcttcacccatcaacttggagctagttgacagaaatggagggttagagagaagatgtgctcaggaacttctgccgtagtcctggaagtcatgagagaaagggcaaatgccttttaattaagtacatcattcatttgtaatttcctgagcatctttatgagaaacataccatgcttatcttatacattgggaaactaaagctaggaaagtttaagtagcttctcacacagctagtagctgagagttgagatttaaaacaggatttgtgcctccaaatttagggttctagatcaggagttggcaaattatagcccatgggaaaaaatctgtttgtttttgaaaataaagttttattggaacacagccatgtccattcatttacttattgcctaatgctgcttttgtattacaaagacagagttgagaagttacaacagaaatcatatggcacacaaagcctaaaatacttattatctgatgcttgacagaaaaagtttgctgacgctcaagctaattaacactgtccaatagaactatctgagatgatggaaatattctctatctgtgccacctcatacagcagccactagtcatgtatggcctgtgtaactgaggaattgaatttttacttttatttaaattttatccaaggagcaacatgtggctagtgcctaacatattgagtggcgtagttttgtatcctttttggcaagccaaatgggttaattactgctagctttccagcttttccgttaatatgggctttccttccagacttgatattttttgcccatggtaacattttctccagagcaccccggctgggagcctgtgtcatcttggactcttttgtatcttttggtttcaaaggatgacatttagtcttcataatttatcttatgcccgttcttttctttctaccttctctgtggccatctcaggttaggcccctagcctccctcacttggaggtctcatggcaccgtggcccggaggtgagacagatctgtacaagctgcttgctcccagataattacagtaaacaaaaaccatgacaataataatttttattgcaaacttcgtaaatgccaggcactgtgctaagcactttatgtgaattatcccatataatacttacaagatctctattggatttgttctgttatttttcctaatttagaaatgaaggaattaaggcatagaggggttagggatctttccaacagtcatacagtccataaagggtagagcccagatttgaaactggatctgtctcactccacaagctgaacctttaatcaagaaatggaaaagtctgaaatgccaggaggagtaagtcatttatttaaggagaactgacattttaatctcacctgccacactatagaataggtgacgtaactgcaatggccttgaattattgtttcttttattttggttctccacgaattttttttttttttttttgagagggagtcttgatctgctgcccaggctggagtgcagtggtgcaatctcagcttactgcaacttccgcctcctgggttcaagtgattcttctgcctcagcctcctgagtagctgggattacaggcgtgcgccaccacacccggctaatttttgtatttttagtagagatggggtttcaccatgttggccaggctggtctcgaactcctaacctcacgtgatccgcccacctctgcctcccaaagtggtgggattacaggcatgagccaccgcgcccagccatgaaatggtttttaatgacacatttcccagagtgcccagtggttcttactgccctaggtaagctgcctctcagactcctcaaagcagctttacctgcttcctagacctgtatcctaacactcatccccatagatactaagctgtaaagggattaaatgctaatgtggaatttcatccaagaaatgattaaggatattacagatgtgggtgggagtgattgcagactagtaaggttagctagacttttaaacccttgctcttttctgaaatcctccctacttttcaacttcttctaagtaccagattaattaatatctgcttaatatttgtcattcacattttaacccatttatgcctggtgttccattattggaatgctgagcttgtgggagttatttatatcctgctcaaggtcatctcagtaggtctgatttttcacacacacacacacacacacacacacacacacacacacacacatttacaacctccagcataaatgggttaatacattagagtagtatgtctttgaaagtataatgtgagtttattatacaatcctataattaaggccataattaaatataagttgcttaatatatcactgaggaacccgaataatagtatcttagctttttactcttgttttgtaattgaattgccatcaccatgggctgtatggttatgatttggtactatacttgggtacagagctatatgcttgttaccagtttgaaaatttgtcttatgtctgtagccaagagcaaaaaaattactttcctggtggatgtggcattttcagtaggttttatgcttctgaagtgcttttccttttagataaagtatcagaatctttttgccgtaattttagtaacacatcctgcacaaaataggatctgacaaagtactgtttcagtgtacaaacatgtaagagcctacaggcaccctttattatcactcctcagttttattcgattctacagctgcttcccctatcccttagaaatcttttggtatttctagttttctttagtacagcataaaaccttatgactcagtagaatatataatcacatgtaccatattttaaataataaacgtagtacactaatgtgttatcctttacaattaatcttccagtctgaggttaaagatattcagacaataacaacaccaatcacatcattctgggtagcatattgtttctgggtttacgcatcatattgaccggagtgtgaaaatactagagatgtttaataaacagaatgcaagtcatttgaaatgacaaaaagaacaacaggcaatttaggtcgtaaaataggggcagttttaaatggcacaccctgtcaggtatatgtggcataaatgaacagttttggcttcaaatagttgtagattaaagaaaatgtgaatcatgaaagcatcagtaaaatttcggtttgggagaggctttaagatggttgactagaggcatctggtgctcaccccctccacaaagaagaaccaaaatatcaagtagataatcacactttgaacagatcatctaacagagaacactgaggtttaacagagaagtcacaggaaacacctaaggcagggaaggagagggaaccaagggagcctgctcagccaggattagctgggagcctggggaggctccccagtgtgaggaaagggtagatgagagacctccagtgatccacattcccatgtgaattcctgcaatcctagccacaggagagcccttcggccctcacagactctgagacttaacatagggagctgcctagagacctcgtgatggaattgctgccgagagggagctcatgcatgctgggtcccacacacaccttctgagtcttaagcaggtaccaccaccattggcacctgagcactcctctcagaggcctcaggtcaggcccacccaacgtaccactaccatcacagctggcactcacctgtatataccacctgtgggcctggggactggcctgcccagctgctaacaccagcatggactgcgtgagaagcagagggttgtctcaccactgctgctgccatcacctatgctacacccactgcccaggagcctgagaacctgcctggctaactgctatcactgctggcacctaagcaagccacgtagagacccaagaattggcccacttggacccactaacaccaatgccagtgtacgctgccctcgggcccaaagacaaacacatttggcccacctctgctactactggggctgaggactggcccacctggtagcctcatcctcggcaaaattttgcacagaatctactaacaactgcatcctaaggcactgaagaatcagagacaccactgatgctatttacaactgaagaaatcttatggagactacactactgcatgtggccagaatcaaagccaaagtgccccacccaaacagcaccacagataacatcttcaggaagtcctcccctaaaagagatgctagaggaggctgggcgcacggtggctcacgcctgtaatcccagcactttgggaggccgaggcgtgcggatcacaaggtcaggagatcgagaacatcctggctaacacggtgaaaccctgtctctactaaaaattcaaagaacaaaattagccgggtgtggtagtgggtgcctgtagtcccacctactcaggaggctgaggcaggagaatggcgtgaacccgggaggtggagcttgcagtgagctgagatcgcgccactgcactccggcctcggcaacagagtgagactcagtctcaaaaaaaaaaaaaaaaaaaaaaagatgctagaggaattgggtaagggaaaggcaagtcagaaaacctcatttgtatggtgatatgatagagaagagctttggttgggtttggggaatgggcggcggggggacaccaaacttattcagcacctttggcctgacctggacctggttctgtagaatacactccatccatatttgcattagaagatgaacttcttgaaggcagggctgtgttttgctgattttcatatttgccatgtgtgcctagcagagtatttagctgttaggttgatgaactcttatctactaaacgtatagcagaagatgaggattaaagtttaggtattggatggctatagccttgtatacttttgcagtgttttccgaagagctgagcacatcatctcttccttctctggtgtactgtctggctagaacaggggccttgtgtggcactcgaaatcagaaaccactttctgcctcccattcatgttcactggcgtagggtgagacctgatgggccctgcaagctcttacttccctgggatgagaagagcagaggctggcttgcagcatcagccatgttcctcattctccaaagtgcctgattattcactaaatgctgccctagagttatctctactgtggttaaatatagaaaactaggtagtgattttggcagtaggtgactaggtttatttggaaaggtgggtttttgttgaaatgtttctcttcattacgcacacatacctaattgcatgcttgctaaaatggaagaagagaccagagagggacagggacaatcactgtcacgacttttggtgccctgactctaaaactcacatggtaaactgatttttcttcaagaaaggtgatgctctaaatctagacagatttatcctgaagtgtggtttttaattcataccttagggttcattttactatcatttggaaagccaatgtagttttggtttctcatgtaatgtcgggctttatctctctgcttcagctgatccccctgtgatctcggaagagaaagggccctgttaccgacttgtcagttctggaagacagtgtatgcaccctctgtctgttcacctcaccaagcagctctgctgttgtagtgtgggcaaggcctggggcccacactgtgagaaatgtccccttccaggcacaggtaagacatgcccagctgtatgcgcacatagattcccagccacatgagtacacgggacaactttggcaccttgggtcatttgtggtttctgactttaatttttaataatacattgtaaatatttaatcacctttgtagaaactgtacacatacaatgttgaatcagtgggaaaaaattatgtgcaaagagattttcccatttctatgtgatatcagacttccttttgaatattaagaaaagccattatattttatcttcaatttccaggactctgagtctgatatttaagtgtagagagaccagaaggctctgctgggccatgcgctttcctaatgattggctgctcatcaattcacagtaactagactttgtgcaagttgactcatttactcatttattgagtatcgtgcttaatttctttaattggaaatggaggaaattatattcatgattgaatttacgctatgaagattaataacttaaggacagaacttgccaaaactcctgaaaacttctgtgggagttgagtattaagaagtagattattctttatccttcaatttggtacataattgccttatgccctgagaaggcaaatttatctctttaaataccttctaccaatgaaccaccaacttctcaagcaggatcaagtagagttaagtggaagagaaagaaatgtaacctgaaagcgttagacctgatattaacaaggaatggcttcaatgtcacttacttggggtggacattaaatagtctactcaattgcatgtttgataagatgctttctacctaggaaagtgtcttaactctcacagggccatgtagtgtcttaaagctgtaacttacaccatagcagacaagatttaaatataagtatcatgactcacctttgttcatggttagaaccagaaagaactgtgttaaggcaaaggataatacaacattgatggtatgttggtagactagataattttaggcctccaaaagatcctagtaccctcttgtgctcttgctcttgtgccatctgatgcacttttttttttttttttttttttttttgagatggagtctcgctttgttgcccaggctggagtgcagttgtgtgatcttggctcactgcaagctccgcctcccaggttcacaccattctcctgcctcagcctcccaagtagctgggactacaggcacccaccaccacgcctggctaattttctttttgtatttttagtagagacggagtttgactgtgttacttgatctcctgacctcgtggtctgccggcctcagcctcccaaagtgctgggattacagggatggttccactcattattaaaaattaataatcaagtaatctttataatttatagacacgtttctcttgaagttcagtttttaaagctttcagtttgtgaatttattatgcgtattattttgtgtctgtataatgtgtttttaatttttttaaattttttaaatgtttagcttttaagttcaggggtaaaagtggaagctcaattttgatagctttataatccttacatgaagcataaattgagatggtgactggaactcagggatactcctctctagtactatcaataaatttgaaaataatattcaagataaaatttttgcacttaagttttggttatatggtgattttcactaaaaatatttagttcgttaattctttaaacttggtttttttttttttttttttagggagtttgttgttgtttttctggttttgtttttgtttttattatactttaagttttagggtacatgtgcacagcatgcatgttggttacatatgtatacatgtgccatattggtgtgctgcacccattaactcgtcatttaacattaggtatatctcctaatgctatccctcccgcctccccccaccccacaacagtccccagagtgtgatgttccccttcctgtgtccatgtgttctcattgttcaattcccacctatgagtgagaacatgcggtgtttggtttttttttttttttttttttttttttttttgtattttctattacatttattaatatcaaacactgttgtttcctgcatttttttttattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgtgatctcattgttcaattcccacctatgagtgagaatatgtggtgtttggttttttgttcttgcgatagtttactgagaatgatggtttccaatttcatccatgtccctacaaaggacatgaactcatcattttttatggctgcatagtattccatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactggatatatacccaaatgactataaatcatgctgctataaagacacatgcacacgtatgtttattgcggcattattcacagtagcaaagacttggaaccaacccaaatgtccaacaatgatagactggattaagaaaatgtaaacttggtttttaaagtcatgttttcttctggaaacatgtttccaagtaaaaattgtttttcctagttaaacataagaatgaggttctaccatttagtgtgtgatccttagaaaaacagtattttagcatactataagcagtatttttagagtttcctttttcttgagaactaattttaggtcccagacattcaatagaagatctcttgttcagtgaaagtgagaaatgacttattttatattcaattttaaaagtagaaataaaaaagttaaccataagctccttggtgtctacatttggtaatttgcctccaacaccaacaccaaagggattaggtggatttttcctctgaaggccacacactgccttacccttcttctcccccttgcctttccccttcactattcatggggattatgccgtggaggttagcaaatcacatgtgctgagtctacttttttttttttttaaagaatacaaaaccactttttttctggcaatggtagtgattgattccagggcacagaatatctccttggcctctgggtagttaaatgagctggtcacggccaggcttttgcccagttgttgttcctttacttgaaaatagctgcatcttgatttggcatttcccttctttcttgatttctacctatcatctccagcatgtctcactctctagactcttcctcactatcccgagattctccccttcagaaacacttccccttttccgtcctccgtaatctacatcctcttaaccagctgatacatggcattttggtggagccctttgtgttcttcaactggaagcaaactgtgaggatttcggcatctcatttccctgaatagtgattttttttaaccttatggctcttcatctaacttagacaaatgtcactgagttcttttttaataactaatgaaattacatcaaagcgggaaaaaaagcctgatttttgctgataagacatatacatgcaacatgagatatataatacatatagtgtcttctatatataaaatatctcctaatatataacctaatatgatatatagtattttctaattggttgctgatatatatgggatggagggctaactatatatatatatatatatatatatatatatatatatatatatatatatatatagttaccctctgtatccatggttatgcatcagtggattcaacccaattggttggttgaatctgtggatgcagaactggatatggagggctgatcatactatgcaattttatgtaagggtcttgagcattgcagattttgatatccacaggggttatcctagaactaatccctcatggatactgaggaatgactatgtaaataatatgatatataaaatatatgctaagtatatgctatatataatatgtatattctgatttgggtaggataaggaattaacagatggaaaaatgtttagtaaaaaaaaagttggatttttttctttaaatatgcaagtttatcagaaattcgagcaatttgcttacattttgcacctgtttttgaagttttaaaatgtaactacattagtgatgatttattaagagctattcatcatgatattttcctctgtataagtttgcactgttagatttttaaaaggaatattttcccatcccaaatctagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaaggtgagagcggtaatggatcatggactctagacatctatctgtgtgtctttgctttgatttccctgtttataaccctctagaacagagtttctcagcctaagcactattggcattttagagtggagaattatttgattgggggctgccctgtgtattgtaaaatgtttagccactgctatagaataatatgtacctagtagataacaatattccatgctaattttagaatgctgtcctgatgtttgggggctgctttatcttggcgtttatatctggagagtaatttagatccttcagggaatagccctaatttcatttcttgtctagaaggccatttaacaactatttatttctgaagtggaatccacagactttcaaaaagttaaagcattaaggtctaatgggcagtcaaggataatggaggatgaaatgaaggaagctaagagattgtcagttgaagagatctggtgatcacctagtgtggttcttccatttaccctctgagaaacctgagacctagagaggggacatgacttgccagatgtcatatagagaacatgtaatgggacctgtgaccacggagcaccttttcccaaggaaatagtttaaggcttatacttgagagggagtctagagacaatggactttgactctctctctggcattcaggctgtggggtcatccctatctcttgatataaacccagcaatatctaatacttcacatatcttgcttacaaagatgttcacctcagaaggaacaaaccttttggatttgtatggaatagacgtattttctctaataaagctcctgttggcttttcacagttgattctgaggtcagaattcagggggccatttttgggtgctgttgaggagatagagtgcccaggctagtgttgtgttgggagtttgccatagccgccttcttggtgaggcaggctttttttctgagctctgaacgtttgtgtgttctggcctatttgattctatgctttcactcactgcatttcttccttggtgaggcagaacaggcaaaacctcagctggaatcaacagtattaatcagtttgcccctggacacttagtatcatgaccagatgtttgcaactgttcattgtttgcacaggcaggaggaaatgggccgtagttccagattttgcctcaagaccttcttcgtggtaggttaggcagaatagaaggttattgactttctccaaccccaagaatattgcagcaatgattttactttgtctggtaccctgattgctttcaggatttaatgctcctgcccaacctgtaaactaatgtttttacaggagacattgattgacttatgagaaaaatcctggtgaatgttgatccagggctttagaactaatatgaaggactgattaatgaaaagcaagtctttaaaaatacaaaggcatcaccaacaccctcacaataacgtttatgattgtgtaatgtataatttgttcagtatattgatgctaatctctaattggctcttcctggcttgtgagattctttttcgtaatttagttagcatatctttttgaaaatattcacggggcttcattaaagattggaatacatcaagaatgcagcacatgctgtcatgtctcttactgaaataagtgacattcttttttaacacttgacaccagaaagcatttcaaacattatataccataaggataaacctttaaccaattaatgaaaatgtttgttttctaacatatggaaagttccacataactgagataaggcataaaatgttgtaccagaaagtattgccttcttcttttaattttaattctgaaagagtttgaaagacttgttcacatcttctccatgtgctccagtagttgaggagtaacagcactgagagttctctgttagtcatgtgtaaaattccctaaaatggcagatgatcctaattctgcatttgctttagtctgattcttaatccttttgcagagataatggacttctattgttttttaagaattgaaatataatagactgaattgtcttaaatggtactaataccctttttcttttctggttttagtggcaactgcaccccctgaaaaggtaatttattcattgcttgcaagtctttttttttcaacgctcaaagtgattttctattagaatatgtatggattttttagacttaaatatagtaacatctctattatgcatcatttggtttgagttaatatagcattcagttattccaaaaaaatttattgagccattgtcatagattgggactcttctcagtgttaggaaaacaatagagaacaaataggacaaaaatctctactttcatgaagcttcaattctcgtgagaagaaaatgggaaactaatgggaatcaagggcataaatagaattcaatgtcacctgatggcctggaccatctgtgaaagaaaggctgtgacatgcttagataatcatgtattcttagagcacatatatagttagtgaagtacttcttagttcaactaaaatttaacatacatgtttgaattgagtttgagtaagaacagaacttacacttaaaagttacaatcaaatactagaatgttgctttttgaaaagtcagtctattggcttttgggcatagatgggggctatgaattgtgagacattttagtaggaaatgtaaacatttactggatctaagtcctatttatgtaatattgttccttctctgaatccggctttctttctttaataaaaacatccattttcattaaatgaatgaactttatgtcagagaactactatgatatattgctagactaaattatcgttgcattttgaaatgggatctcaatgcatgtaacaggctttaattttctttttatctccttctgcataataattacatgaaaattaggtaattattaaatatttatacatttatgtaccattctttaagctgacaagaatgcattattagaatttagatgaggcaatacatacatgagttattttaaatagtattctaaatcttataattatgggatagagtaacatatatgtcataacataagtgctgaaataagaaaaagagacttacaattttggagtgatagcactcgtccagaaagaggttatagtattttgagaccaaaaaatgtataacagatatgcatactttttgtgtacttttgaagctcttagcatctctaaagatcagtcacagcgagtagtttgcaattttgttgattttgaatttagtcctggttgatgtatggaagtaattatttagcttgtaggtgggccagccagcatcctggcagcctcatcacgactcagttcttctgtctttatgattgaatttaataactctcattaaaaatctaaaaaacccccaaaattttcttgtatacttttactgcattttatttggggaggagatagtacgaaaaatgcaatcatagcctttgttgtcttggtacttaaaaaagtctcatgatgttatgtgatggatgaagaaaagaaaggatacccagagatgtgcaaaggtgtggtagaggggacagcaagggtcatgaaagacttggtcagaaaccgaattagggactgctttggaaggcttagagtaccaaactgccattgtaatcagtggggaaataccctgcttctcgactggaccgtatttgttaaatgtagaagtggtgtagattaggaagtctgctgcctcacggtgatgggggaaattctgtaaactgcagtagtggattaacacctgatcctggtctgttccttgttggcattggccatggctgcagggaatggggtgcaattgagactggttgaggtcatctctagtaagtaatagaaagctagttttaagaagacagaggaaatgtgggaaaaactattaagtgctcagtatttgtaggagctgaattttggtaggtctactcaagttaagaagaaagaggaagccagttagattattacaataaactgaaaatgagagtgagtccggcctagggtggtgggatctatggatatgaaaaagggtgaacaactgttaagaaaaaagtgtcaatggacggggcttgcaatgaaaaatgaaagagggaggactaaaaggtgactttaaacctggatgggacagattaatgactgtggcactggtagaaatgaagttggaatgagagcctggatggttttggaagggtaggctggaggtatctgtgggatatctaaatggacttaccctgtaagcatttgtgcttgcaaagttggatttatgatgagatatccaggcagactatcttagaaaaagcagaaaataggtgatacttgaagccaggagaagaggataagaggttaacagaggccagaggagtaagctttctggaagaggacagaaccaagtaactcgatgagtacttgaatgtagtgatatgagctccctggtcacatctggtgtgagtgaagtcacagatccttaactaggctaattgttcagtctgcctgagccctgcacagttgtaaatggaagctgagccacggatgatggactgcttctttgcttgaggtccaggggacaagcgtgggcaccaaaatgtgtgatgaagccccaaatccttctccaagccagcacatttctgttgctctgcctggctaccactgttcagagagctggagttgtaaagttatcagacgtgaggttaaagaaggccatagtaactgactggtttaaaatattttaacttaccatgtgttctttgttatggcacatctgctatatccattatttaatctgcaaactgtggctggtcatcttagtggggcagagccacatgtgaatgaggcaatagtcctcgttgggggttagttttgccctgttgcagaccaaatatggacccctgggccaagacatttacttacaagatcagactttgggcctcagggaaatggctgaagatatgtgcgtggattagcaccactgggaaaaatttagggctttccatagtagcaccacatcaaaggttcttttttttttttttttttttgtaatttcacacaattatacatgtaaggtcctatgatatttctttgcctttctaagaatataattaattacataaaaatagtaatatgtgggaaactaaaaataatttccactttcaattcttttttttttcttattctcttttaaaatacaaccatccaggaaataccttcattggatcaagagaaaaccaaacttgagcctggtcaaccccagctgtctccaggcatttccactattcatctgcatccacagtttccaggtagcctgtgttgatctgtgctgtttgtcagagtattctgaataaaaatgtaagacgggaaatttttgtctttgactttgtgtagtaaattactagacttcataactgaagttcagtgttaagtatagtaatatacttatataatgttagcataattacagcattgtaaggattgtagtgggaaagataggttttttttttttactgttttctgtgatcaggagtagtatacactattcagacattattgaaggttatcatttgatgaacgatcatttttcttggcttccgcatcactctcagatattcttgctaaatgttgaacccagagccttgggacatagaacagttctttatatctgacaaatgctgtgatatattgctagactaaattatgcttgcattttgaaatgggatctcaatgcacataacgggctttaattttctttttatcctctgcttcctcatatagtagtgattgaaaaaacatcacctcctgtgcctgttgaagtagctcctgaagcttctacgtctagtgccagccaagtgattgctcctactcaagtgacaggttggtgcagtatttttacattatatatcacatggaggagacgtggggctgagcttcattttaaatgtagtatccattatataagcttgctcatggcagggttagccatactagcaaatatttggaaatcatctaaatacagttaaaaaggaggagtatgtggaaataaattatagtatatatgaaacagaatatcacatagtattaaaataatgtttgaaaagagtagttaatatcatgaggaaatatggcataatctgttaataaatacagaatacaggctgggtgcggtggctcatgcctataatcccagcactttgggaggccaaggcaggcagatcacaaggtcaagagatcgagaccatcctggccaacatggcgaaaccccgtctctactaaaaatacaaaaaattagccaggtgtggtggtgcgcacctgtagtcccagctacttgggaggctgaggcaggggagtcgcttgaacccaggaggcggagatcgcagtgagccaagatcacgccactgcactccagcctggtgacagagcgagactctgtctaaaaaaagaaaaaaaaaaaaaaggactgggtgcggtggttcatgcctgtaatcccagcacttcaggaggtcgaggtgggcagatcactaggtcaggagattgagaccatcctggctaacacggtgaaaccccatctctactaaaaatacaaaaaaattagctgggcctggtggcaggcatctgtagtcccagctacttagaaggctgaggcaggagaatggcgtgaactcaggaggcagagcttgcagtgagctaagattgtgccactgcactccagcctgggggacagagcgagactctgtctcaaaaaaaaaaaaaaaaaaagaatatgatgtaatgattaccattttacttttaaaatttctacaaacacggaaaaagaaagaaaatgcatcagtgttctgttctcaccagttaatactggatcatggataattatgttctttaatatatttttattttcaaagttctgtataataaacatattattttaatcatgagtgaaatagcataaaatgttttatattctgaaacaaatgcaaaattctaaatgtccatatccttaatgtgtattgagctcttataaatcaataggaaaaatactaacaatagagaaatggaaaaataatataatcagataatttgtaggaaaaaacaataccaagaagcatgtaacagaaaatttcgactttcctggtaatcaaagaaaggcaaactaacctaggataataccttattcctatcaaattagtatgtaaaacccaatcaaatttttttattagggtgagattgagactctctcacattgctaaagggagtatgtgttggggttctccagagagacagaaccaacaggatatatccagatatgtagaaagagctttattgtgagggattggctcacaccattctgaaggctgagaaattccaggccaaggaaggctggtgttatagttctagtgcaaacccaaaggcctgagaagcaggggagttgatagcataagttccagtctgagtctgagtctgaaggcctggataccgggcataccagcgtctgagggcaggagaagatggatgtctcagctgaagtagagcagattgccttcctcagcctttttgttgtgtttgagcccagcacccagcagataggatacccacccacgctgctgagggtgatcttctttacacagtctaacaattcaaaggcctttttcttccagaaacaccctcacagacacacccagaaatatgtgatcagctatctggacatcccttagcccagtccagttgactcatgaaattaaccttcacagagtataaagcacaaattggcaatatgtataaaaaacttcagaactattcagaacttttgacccagtaattctattttaagacatcttgtctaaggaaataatattcccaaaggctgtgggtaggagtttatatgagtggttacctatcacagacaatgtataatacagaataaatagaaataactgtacattcaactacagggaaatagataattatgttacatctatacattggaacattatgttgccaccaaatatagtatttttgaagaatttttattgaaatatagcaggaagtagtcatacaatattgctaaatttaagatgaaggataaaaaactgaatgatatagagtattataccagtttttttaaagacatatatacactgagaaaatgctgggagaaaatacactagatattagcagtggtttttttttagtggcatctgagagatttaagtgttttattttagatttttttattttccatattttctaaactgaacagttatttttagagtcagcaaaaatgtcactaaggggcatcatcatcaactttaactgaatttatgataccactgcaggatgaggttgacaatgtgttataggagctaaatggaagagtttggagcctcctttagaatattccctcctcagaaacatgttatggttcctttctaatagaaatgttctcatatgttaagcttttggccacttagtgagtcagtagaacaggagcctcgcccttcagggtgcagctacagtcacctagccacggctccagatctagacatccctgcactctaaggggctgggaagtccctctttcaccacaggctcagaagtgcctgctgtcactccttggcctctccccgctgccagcgcctgctccagggtggagcaaagttgtggccaagcccaagtgctattgcaacccagccagttgtgcatgtgcttgggtgagtgttgacatgccagtcccctgtcgccttggccccctctggacattgggcaccaatgagcatgggagggaagctgagggtaagctgagggtagctcagtgtgggcttgcaggtgcccctcagcatgaatagcctgggtgtgtggacaacatgttgatggagggaggcagacaggttcctgggtggaaaggggtgagtcctcagtgaaaccccaccttcaagccaggaatggcctgaagcctgggggccaggctgccagttccaggtgtagtccacggtccagagtgaagacttcatcgataacagtttggccaatcagatggtgtttttctaggccctccatgatcacccatggaccaatcagcacacacttcctccattctgagcccataaaaaccctggactcagccaaactcacacagatgtcaggagtaccagctgtgagaaggagctacccacttcgggtctcctcagcttttcaggatgacgtgcccgcagaaaggagctacccactgtgggtatcctgagagctgtcacgtcactcagtgaagctcctctccaccttgctcaccctccagttttctgtatacctcattcttcctggatgtgggacaagaactcagagcccaccaaatggtggtactgaaagagctatgacacaaacggggctgaaacatgacccccccactcaccatgttgagggtgccgagaagggaagaagagctgtggccctttggggagcccaaacctaggggctccccaagccagggctgtaacagcctctttggtgctgtgtggtttctggcatctccgagctttcgggcagcactgtgtccgccatctccagatgctggtgcctgcagcagaagttactggcagtatatctggtccagccacagcctcacatgaagcctgcacctgtgccagcacctggagctgcccagtctgctacagcagctgggatgcctggctgtgtgtagtggctggaccccatgcttgcttgctcacacacccctcactgctccacacctggcttgcccttggcaagtgtgggatctgggctggcagcacaggccaagcacagcctgctgggctgagtgggtagaacaagctcagtgggtgcaagcaaaacttgggcaaagatgccaccagccacagaggttctggctggcaaagtgataccccaaggatcctgtgacaaaatgatggtgattttttttaatggccatggctaaaattgttattctctattctgaggtcatgtatgtatctacccactttattgagcacactgataagagactgctttgtgctgcaaagtatacaagcaaataatacactattttggacagcaaggatcttctaattgtttatagtaatgttaaaaagaaaaaaatgcagtaagacattgtaatttactagttctttcaaaatactgcatttcaattttttcaatgtgaagataaactctagttttgaatgggcatggctgacttaaatggacaaacctctttcaaactagctttgtagaggttaagttcagttaggtaaatgcagtttcaacatttaaatgtagctgtgtgaagggtaacaaattgaagttactcagcttcaactgaactgcagagctggttaaaaaaacaatgcaagtagccttgctataggaagttgttaaaacacaacttgttagaggcttaatttgagtttggcagaaatacagggctgacatctgctgtcacatgtttgaagcatgaatatatccttccaagaaacaagtgatgcagattttcttttcatgcaacagttgtaggtacttccactttctgtagtaaaagaatatttctgaaagaatccatagggggaacagtatagatagtctttgaaatgaagtggtttgcaactttagagctacactatacatagtgatctgcattagcacaagaagactgttttgtatcaaatataatttaactcaaaatgtgtatgttcccatcggtttcatatgggagccaaacacagatttaaggagcaatctcatcagttctctcaggaatattgcataataatgtttttgtctctaaaacacagaggaggtaaatattatttgttactgttagtttctcccatgattgaagacagggatagaacaatacgtaagagtctaaaatgaataccatcagctccacattgtttagtgattatatctttacgatggtgaaattggaagtagccttttcacatttagctaaacacactttgacatgtgataattataaagtgagccacatatctgcaggaaatacgtgtgatgttttccactcttaacagctgacttggtggctcgcaacattattggcataccattttcaagtgaattatatgtttcagcatataaattcttgatttagcatagtgtcttaatagctaaaggataggttgggaaaatcaaacttttatttctctggcagatatttacaaagtggaaacatctgtttcaattgttgtgggacaatctatgctcactgtggggcagttaggaagccagggcatttttgtaaacctttccatgagttaacatttgatgccttcctctggctcttcccaagctttctccatggctcttgcagactggtcagaaattattctttgactgagttaactgccttgtggaaacctctgtaattatcatggcccagacatttaaaaaaactatttgctcatcagatcttttccagaactcagaaatgacccaaaaatgtttgtccctcaagcatattaccagtgtcattactgcctcaataaactgtgtatgcggatagaaaatgaactcttttatttccatgtgaaatcatcatgctttagtatttccagactccattcattcattcattcattcattcattcattcagggaatcacatgatgaagaaaaaagctaaaagtcagtatagtcattttcatattttgctaaaagctttctgtttcatttaattttagaaaatagagtaaaaataccacactgttaaatctaccattggccttgttgctggtataaatagagtatttggttttccatcactggctttctgtcatggccctttttccatattctagatggactccagcaaaagaaatagaataaggtccttgacctggtgaagatgaggttttcagggagcagatatagtagggaagagtagggctgtcctgtgaaccaggtggcattatgaaggacatgtgagagagtccagtggggagcactcacttaatcgtctctctgcaaagccaagaaagccaagcatgctaaaaagacaagacattcccattcaccagcatacatacccctgacacaagaaatgagtgctgtctatgtgaggcttgactctggtgtatcagacagagcccagtttctagagtttatattgacacagtttgctcaaagaatcatattcttctacatgaactgatctactcggtgggaaaaggtttgcatgccgatgtgtgagtgaccacttaggaaaaatataaagcatcttgtctttgccctaaaaaacagaaaatgcagaacacttttcctgttctttaagacaacattctcaggacttgtgtactgtctatgtgctcaggaatgaaaacctattagaaaaggagagaaaacacaggggagatatgagggagacatgttttatatgttttaaagtataagtaccagtaatttatttttttacctgatattcaacttttttttttttttttttgaggcaaagtctcgccctgtcactcagggttcaagcgattctcctgcctcagcctcccgaatagctgggactacaggtgcccaccaccacacctggctaattttttctatttttagtaaggatggggtttcaccatgtcctggctggcctcaaactcctgacctcgcctcaagtgatcctcccttctcggcctcccaaagtgctgggattacagacgtgagccactgcacacagcctctgatgttcaactttttgataagtagtgaatagaaagcagacaggggtgttttgaaggtgtgatggttgttttctgtctgcctacaagagtggaatccttggctcacgcctgtaatcccagcacttggggaggctgatgtgggtggatcgcaaggtcaagagatggagaccatcctggttaacacgatgaaaccccgtctctactaaaaatacaaaaaaattagccgggcgtggtggcgggtgcctgtagtcccagctacttgggaggctgaggcaggagaatggcgtgaacccgggaggcagagcttgcactgagccgagatcgtgccactgcactccagcctgggtgacagagcaagactccgtctcaaaaaaaaaaaaaaaaaaaaaagaatggaatcctgcctggcaaaggatggaagggatctctgaggtcaaactgatgacagttacattaattaatcacttgtgtaaaaatgggaagaagtagaaatcaagtatgtttcagaaagtgtccctctttcctttgctgtatctcttagtaccctctagtggtgtcagcctaacattttcttacatgtaacgtgatcctgacagacatgttcagcgtttgcaagccacgtctctatatacttatgtatgaggtaatcaactaaaaatcaacaaacattttttatcaaattccaacctcctagcttctatctaagatattggattggtgggaaaggccattattactcattttattcctaagactaaagagttatacttcttcactatttctcctacctcagagctgacttttgagaagaaacactttagctatgttggcaatttgtggcataggaatatatcacattttaattaagcatcacatatatttgaagacttgttcacacatataaagaagttccattctaaggctgtccctgccaaatgacaaatacttggtaatcaccaaattggtattgtgggagtgggttagtgactactcatcaagcttttcatgaaaaccccagatttatagcctcttaatttgttctgaacccttgccctgaatatattaattcaccttctaatttttttttttgcaaatatggtcaacatgtctttctgctttatgaaaatgtcagagatgagtataaagataggtcaataaccacccgggaaaaaacccaagaaatctaaacaccagtaacttgcaaaggaagcttctatgtataatatagagtcgtgtgcatctcatgctgtttcactaaaaaattcctataaacagaagagaattcttacctgaaagtccatgagtataacctggtgaagattaccttttaccttcagattttaggtacatacaagttatatttttaaggaagacttttcagattatgaaagtgccaagacatgcttagtgtaaaaattttaaaaagtaccaaaaaaaatgaagaaaatgctaatcctaaaaaccataaaacttggatctacttccctccaaccttcttttctgtgtgtattgtagtataatggagattatattctatattataatttgtgcctgtgtttttttaacaaataagcattttcctatcttgttaatgattatatgctgtgctgtatgtataattcattgttttgtgttattattgccagtcacttaagtttaggcagtcatattaattacccatgtttttagccttttgaattatttttcctataatttgataatattttcactataaacaaatgtatcttcctgaaagtgaattaacataactagactcacaaaaggtataagtaatttgtaaatacatggggtgtgcatacatttctcatacatccaggtgactttgtgtaaaatgctgaagttcatatgcttcctttttcagatgacttgcatgagtagtctcaaagtcacagcacagtgaatactttatgaaaaatgaagcatgtggttttggtttcggagagcaacctcaaccccaatttaggtcatttccatagtgaatctgtgttaaagcactgttttccacatccttttactgcagaatagacagtgtgttattagcgagaatagcccacctgcttttcttctcattcaaaccacagacctctctaacaaagctgtgctcctaggttgtcatgctcagaggcgccaaactatttaccttggagggtcgcttggcctcattcataccagcctctcttttgagccttgtttactatacgatgacagataatagcccaaggtagtattggtataaatgtgttggtttttaaatatattcttaaatgacttcaatatgaacaataatggtaacttttattgagcacatataatatgccaggcattggctacatgcgttatttagagcatctctttcattctcatactttgaagttggaactctgattatttccattttacacatgtagaaaagtgaggcatagaatggtgaggtcacttgccccattctgcagaactgtaaagggcagcagcatttgtgcctgcactgtcttcaagccagtgcttctaaccaccagctgtgccaccttcactaggccattagaccttcttacaaaggacattggaaacagaaaatcttaaaggagtaattaatctcagaaggccccctttgagtccttgggtttttttttgatggactccacctaaccatggactcctaagaccctccctccactgtagtgtatgtctgtgagtagactgaggacttgaacagggctaatctgtacaggatatatagaagaagccagtcttacacagggctcagtaagggagtaagggaggaatttagcagaaaagatttgggaaaagattctactttaccagtagaaataaaatatgttcattttgaaattggcaaataagagtaagatacaccaagaagtttttctttgtttagaagtgggaggtctttggggggattaatgataaattttggaggagattggatgtatttgttgaaactcaaatatggcctgctaaagaatggaaagttacaatgtgtttcttatcaatagataagaaatctcttacctattggtgattcagactctatcatctaagatgaactacaatgaatagaaactcattaataggccattttggaagctgttttattaataattgattttcttacaacttacaacatggcctttttctgagtttcttctcacttcagttcatcttaaaaatggctttactaggaactattgatgtccttggataggactaactaatccattataaagtaatcacatgaatttatacttgatgtcagaggtcacctttgtcttctaaatgtagagctggcaataatttgctagttggtcaggaaactcaaagtaatactttgagagtagcagtgaaatctgttcatttctgtgggttttttcacattattttatttacttttaaagaaatcaatgaatgtactgtgaaccctgatatctgtggagcaggacactgcattaacctaccagtgagatatacctgtatatgctacgagggctacaggttcagtgaacaacagaggaaatgtgtgggtaagagacaatttgattgactaaattattaaatatcaaacatttgaacattaagaacatttttttcttaaaccaacttaaccattttgggaaagtgttactggtttaattttttgaaagtttatcccttagctaagggagctcaaaaaaaggtttgctaaacaactggaattctcttacctctttgttcaacatttgtttacctcgcaaatgtaatatatttacataaaggtgaaataatttccaaaagctttttgggtaaagtaaacaaaatatgaattacagaaacagctacctaaaaacatgtatttagcaaaaacaaattaacattagtgtatactgcagtaaagaattacattcatttatgtacataagacttgatttttttaaagggattttaaaattgaaaatccatatatgctggcctgaaggtgtcagtcaatttagaaatttagggatctcatatatgctccttttggaaaaaaaaaaagtatctcagaaagatatgcagtagagttaaataaatcattttaatgtgactctaaatttaatttctctttttttttttaagaaaaagaaaattcagcactaaattatgaggccaataggaagcaacaaaggaacatatctaattaatacttctttagtatatgtgaattttgctgtttggtgtgtgtgtatgggggagaaaggagacagccacctggtccataatttggctatttccttgtcatttgtatacattatatgtgtcactttcagaacctagaatattaagttagaaaggcaacagagatgacctaatccaactccatccacatgcacggaggaagagtctctttcatggcatttctgactccctactgacagcaaattccattgcttggatgtctctcgttatcaggagaatccttctgtgttgacctgaaatctgcctctttgaaacaccagtgtcatggttttgtagttttagcctttgaagtgatacacagtaggctgcttctctcttccaggaacaatccttcaagtacgcgaggagaaagatcgtgtctccttttgctgttgtcctcagttataaaggttgggtggtacccagggaatagtatgatggtattttacagaacagggaaactaagttcttgctacacagaactaatatttttatatgtatttttgttaacagatattgatgagtgtactcaggtccaacacctctgctcccagggccgctgtgaaaacaccgagggaagtttcttgtgcatttgcccagcaggatttatggccagtgaggagggtactaactgcataggtaatggcagcattcttcctgcttacaaattcttagatctgagtttttagatcccctaagactatcatcagttcagtgcttatccagacaacccagaattttttattaaacaattatcatgacagcagtctgctagatcccaggtgatataaaaatggatttttttcccctaacatttttgaagaaagagtgtcatatatgtgcatagacaagatacattaaatgttacttttggaccaccctgcatgaatcaaaactggatgattttgatgtgtgtcaaacaaatcaaagggaaagtagaaatcagttactggccaggcgccatggcccacacctgtaatcccagcactttgggaggccgagcctggcggatcacctgaggtcgggagtttgagaccagcctgaccaacttggagaaaccctgtctctactaaaaatacagaattagccaggcatggtggtgcatgcctgtaatcccagctacttgggaggctgaggcaggagaattgcttaaacccaggaggtggaggttgcagtgagccgagatcacaccattgcactccagcctgggcaacaagagcgaaactccatctcaaaaaaaaaaagaaatcagttacttcgttattatatttgagctaagctgggagatgggagaggtttgaaacagtatttggaacacaaaactcaacaatgctatctgctcttcgtagatgttgacgaatgcctgaggccggacgtctgtggggaggggcactgtgtcaatactgtgggggccttccggtgtgaatactgtgacagcgggtaccgcatgactcagagaggccgttgtgagggtgagtcagctgagagtgttcagcacacatgacggtgatgtgcagggttggtaggcaccttgcctggttcttgtttccttcccacactcagtgcgtgacaccagtttatccaagctctttctgcttcctagattcacaggctctttgcctcttcctttcactggctcttttgggattattttccatcttcatgctctcattatttttcacctcaatatctgcctctctggtatttggaatgaaatcaccatagaatgattaattgcatcatatttagtagaaacacagacttaattacagagtccggaccattcatctgggaacatgctgcaggtgtaaccagtgttgattttttgtttttgaccttttcacctacttacattcctttgtctccaatgctttcttttacatgtgttctggtactttctcacagactccccaagaagcatggtctgacaaactttggtcagattccaactgtgcttaataaaatttcctcattattgaccacagcaatgagctttctctcattataaaaatgttataaaaagtatttatagcatggtcacaattattatccttttcatatttcttttcacgtttgtgtccaagttgctctggttctttttgaaaccaatgtagtgaggccaggcacggtggctcacgcctgcaatcccagtgctttgggaggttgaagcgggtggatcacttgaggccaggagtttgagaccagcctggccaacatgctgaaactccctctctcctaaaaatacaaaaattagctggatgtggtggcacacgcctgtaatcccagctacctgggaggctgagaaacaagaatcacttgaacctgggaggcagaggttgcagtgagctgagatcatgccactgcattccagcccaggtgacagagaaaaaccttgtctccaaaaaacaaagcaaaacaaaacaaaacactatggcactttttttgcaattattttcatgaagaaatacactgaccttctgctaaaaacctgtcatggaaatatgagggtgaaggaacacgggatctgtgagggcacgggagcatggtgctggttccttggggttccctgcctggctgtcagcagagcctaatagatctgggctctgttaggtggggcaggatggactaggttggcacagccagccctcagctgtcccctggcttctgcctgttggttttcttcactgctctaatgacccaggcctggagggagagctaattagacattttttggcagcctacacttgcccctcctgctggtgtcttgcctctgccccttgggttctaatctagagagaagtgggagtgttttatgttgctggatctctgatcagcatggagttttgtaccctccccgagggccacgaggctacagaacaagcacaggtgtaaagtgtctccacgctgctcttccagggaactctcctctgctgaagagatgcagcgtgggagcagctcaccacgcccacagtaactgcctgacctgtagccactgactttgcccctttgaaacgtagtacatcatctgtaaaataggaaccatgaagttaactttccaggttttcatgaaaataacttcatgttgccataacttgtatgatgcctgtcactttgttagttttcaagaagttatagtttctttaaatctccccccatccctgactccttttgtgtttgtatagatctcaagcacctctgtagttgcggggagtgctttaaaaaaatggggtgtttatttgacaagcatttatgtgcagagcagtatcccccaacccccaacaaagaagtcaaatactgatttttttttccctttctttctttctttctttctttctttctttctttctctctctctttctttttttctttctttctttctttttttttttttttttttaaagacagtcttgctctgtcgcccaggctggagtgcagtggtgcgatctcagctcactgcaagctccgcctcccgggttcacatcattctcctgcctcagcctcctgagtagctgggactacaggtgaccgccaccatgcccggctaatttttttttctatttttagtagagacagggtgtcaccgtgttagccaggatggtctcgatctcctgacctcgtgatctgccagcctcagcctcccaaagtgctgggattacaggtgtgagctactgcacccggcccaaatactgattcttaagttctacacacgggtcaagaatggaaagataagatacttaagtaataggatggaaaggaatagaaaataaattggaaaattatgtacttaaattggaagcttgtaggagaatattcggtgatattcaatatatgaaaattatttgggagaaagatgactagcgttccctcagtaaataatatataattctatccccatgaaaagtcttgaaaagaagaaggagccaagaaacgcggctgttttcaaatttcatcatggactagaaccaaacgtccccgggcttctggcacacagaagattttctcagctgtcactaacgaagttgctttcaaatagcaccagtctccaaggagtctattgtagtttacagacattatctcatgcatccttactttattctgttaaggtattataaggcaggtagttcctaatttatagaagaggggaaaagccgaggtgagagcaggtagaaattcagggacattatcttgtattgctcaacattgcaccctatttattgggctagcctgtctcgatggcattctctgatttagcagttgtagttctatttttttgaaatatcccatccagaggagaatgtaatgctatttggaaaatgaaactggcaagcaccatctttttgtagaacaagaagtcccagaacatctgacctaaaaaaaccactatgtatcattggccattggcaagaatttttactgatagaaaaaaaattacaacactgacctggtgcttattttgttaatatcatctttaactttttcactttaagtatcttttcacatgtctaatggtatgcagtgggagataatttttaagtatttactagaatgtagacatcacatacccatggatatttagtggacccattatatatttctttctttttttgtttctctagtttatgtcctgaaaatccgtttatattttaagtacgattaaaggtcatatatacattgtgtattgggatacttaaacattaaatccactcatataaattcaagatccacctcagaaaaaacacttatttcaaatgcagctagaagccatggtgttaacacttattttaaactgttgaactctctcttatatctttttcctcattttattgtttgacaatttttaaaaatgcctcaagctgtcgtagttatctcctcacagacttaaccatattttaggagatttttttctccccaaattggaaagaatgatgattaatgacttcagttagctatgaatatgaaaagtaaggtgtatttttaccagaaaatattaccatatggtcatatcaccgtgttttctggaaaggcttggaagtatgtgatgagttcactctctcctcatgtttttttttttttccacctccaaggaattcctgtcatatgaaaggttttaaattattccaacctaggatattcttgggcccatgaagccaaagtgagaatttccctagagcatccaatgtttgcagagagaacctctagctgggtggatacatagcttcctcacactcacccccattctttgtatttctttctggaaagctgtgctattacttgaaaggtttcatgtccagaaattggccctagaggagctgccaactcccagagtggagaggccaggtcctgctagttgaagaattggggccaggttcttccttggaatgtatgcaaatattttaatccaggtatgcttgaccatgcattattgccatgtatttaagtatagacccaatgtctcacttacccaattattgtttttcccactgaaatgtagatataacatgctttcccccgctgccttcatcacaaagtaagattttgctttggtattctgataaaatgttcacgacctaggtttttgatttttcagatattgatgaatgtttgaatccaagcacttgtccagatgagcagtgtgtgaattctcctggatcttaccagtgcgttccctgcacagaaggattccgaggctggaatggacagtgccttggtaggtactatagtgtacttatcaaagatttgtttcttctgcatggcccattttctgatagagtggtgtaatgccaatggagccctctttcaaaatgaaaaaatgaaatcttacatcattctaagaaaagttcccagtaacttttaaccattgagaaaataagaaaatgacttagcataaaggatgtaagattctcgatggggaaaataattaggattgaaacaaactgatattcctaatgagataaatatccaaaaccaaataagatagtaaggtctacaggaaggaagagagatggagagcaaaacacttaaaaagagagaagaagcatctaccacagacaagtagaattaggtaacacacacacacaaattttcaacagaagtatcaaaggtagtgctttaggcactgaggaagacagagtaatgtatttgctttgattctaattacccgtgctgtagttagctctgccccttaatggttttcatttgtgtctaccatgtaatctttttccctaaaacttgaactcttttccactccataccaaaactctgaatatgtgagttaaacttttcattcattcattccttctttcctttctccctcaaatgcttaagaacttactataggctatgcatggtggctcatgcctgtaatcccagaactttggaaggccgaggcacgaggatcacttgaggccaggagtttgacaccagcctgggcagcatagcaagacctcatctctacaaaacattaaaaaacttacctgggcttcgtggggtgtgtgcctgtaatctcagctacttgaaggctgaggtgggaggatcgcttgagtccaggagttcaaggtttcagtgagctatgattgtgccactgctctccagcccgagtgacagtgagaccctgtctctaaaatatgaaacaaaaggcaaaacttactgtatatccccagagttgtactaagttctgggatatattgagaggaaaaactgatatgaccccttccttttggtacttactgtctggtgggggagactgacatgcactcaaacatctcacagataaatgcaaactcacagatttgagacaagcactagaaaggagggttctatgatgctgtgagagcatatggtagaacgagctgcccttaggaaaattcttgagttgaggttcaactggtgagggggtgggagggagaacatttcaggcacagtaaacagcatatgcaagaggctcgtggaagaagaagagagcagaaggccagtgtagctgaaggccagagaacacaggaagatttgctgcaagatgagaggacagaccactgaaaaatttaaagccctcttagtcctgttaaaactgacggtcttcattctcatagccctgggaagacatttaggtgttttaatgggggttgcagaagtactctcagttttaaagctttagtctcatcaccaaacagcatcagctcagactctgtagctggtacggagagctccgtgtcctgagcccctaggcccatccccaacccaagagtctctgctgatggagttgtgagatgtagtctttgaagaaaagatttttattcattagttttttatttgataagcaattgtttttgtaactggtgctgaccaaaaagtattaatatatatggtttcagttttcccatttggcataaatttcatacttgcctatcaaggttccatgcgtattctcattttcacatcctgataaataatccaggagcagagccggaactctaccttaaataactacaattcataatagtagtgtaaacgcagccctgattcatgaatttattagtggaatgtgactgatcaaattggcaagtgattgttcttcaatataaataatactaaatgaattcttatacctatatgtgcatatatatatatatatatatatatataaactttagtgatagaagcacagcacctcatttaaaactaattttactttgtcaaccagatgagtagaatcataagcagaaatattagatcactgcatttctcaattcagccaaagtcccacatttagccccttgttttgtttttgcgttgctgaggtcatgtatttcctattgttaaatggaggcagtgtcctttatctttctgctttgggtaaaattttaggctctacataatctacaaatgaagccactcccccaagatttaattgcagttccatccattgttcatattggacttgcagctcttctaaatttctcatgagggcctttgcaggttatactgaaatagattttccatcttaattttttatagtagtagagctttcaaatgtcgagaagttgactgtgacaaaaagcagatattgcagcatgcctttctacttacattgaaccaatgggtgggttggaattttctgctaaactctgaccatgttaatgactgcccagccctagctttgtacttctggtactctaaaatacctttcagaaggtgcagtcttgtcttaagcctagttttgagttgagctcatcactaacataactggatatatattcattcatttaacaaatactgagtgtctaccttgtgccaggtatttttccagaacactggggattgagagtgactaaaataggccaggcacggtggctcacgcctgtaatcccagcactttgggaggccaagacgggtggatcatgaggtcaagagatcgagaccatcctggccaacatggtgaaaccctgtctctactaaaaatacaaaaattagctgggtgtggtggcacgcgcctataatcccagccacccagtaggctgaggcaggagaatcgcttgaacctgggaggcggaggttgcagtgagccgagattgcgccactgcactccagcctggcgacagagcaagactccatctcaaaaaaaaaaaaaaaaaaaaaaagagagagtgaataaaataaagtttttctcccttcattgtagttatactctagtgcttacgtcgtgcttacaaataaacacataagcaagtacaatatataggatgtcagatgtgatgcatgacgtgaagaaaagtaaagtaaaagattcagagtctttagagatcccttggtggtcaggatagtcaaatgctaagttattaacatgctcttcctggctagtcatttgttttgtctctaactgttacctgtgattatatccttttagttctgataatataggatatattgatgaattttttgccccaattgttaatgaaaattctccgtgataacattaaagactttttttttttttttttttttttttttgagacggagtctcgctctttcgcccaggctgaagtggagtggcgccatctcagctcactgcaacctccacctcccggattcacgccattctcctacctcagcctcctgagtaactgggactacaggcgcccgccaccacgcctggctaattttttgtatttttagtagagacggggtttcaccatgttagccaggatggtctggatctcctgacctcgtgatccacccgcctcggcctcccaaagtgctgggattacaggcgtgagccaccgtgcccggtcattaaaaagtttcctgcaatcacaccattttggtgaaaaatcctacatttgtcatttgttagttgccatctgtagagatgataatgtctatctcacagggctgccgtgttccataaatgttagtgtctttttttctaactctcctctcactgagtacatgtttttacattgttataatcaaacatgtacaatgttttatataacatttcttaaatttcacattatgcttatagttttttttctaaactggtctatcttcacgttgatttgactctctttctattgaatgacttcattaagcattgctattcaacccctatattctgcagggattttataccagttacactttctgcttctttcacagactaaatgatgaacttggtgaaaccgttaatggcctctttgtattcatgacatgtaagctggatcttactgattgatgcttctccttgatttataaattagagcagaaattgttttgggcagaaataggcaaaatgttagcaggtgttttctgagggactacattttttccctagtgtttagctcaggtcatacaatccctcatcctcaatagtttattatccacttcaaatatctatcatttcagactgtacctaacacacatcatccctaatgctttttggcaactcttgttggctcttctgttaacgtagcttcttctttcaagtcgtggatttcattcttctctagagagtcacgttcgtcattcggcactgtattccttggacctgacattcagcctggagttgctgcccactcgatccccacctttaatgactatttcatcactctgggttctggccagttccaaatggctatttcaaccaagtcctttcttaagggaagccaccctgtcaggtactcaatttacaggttcttcttggcttgtggagatctggcctgattgaaacccgatgagagccatcccccaaggaaactctctaatatttaattatttaaagatacatttgatattgctaatgtagagatcttagttccctgaatttagacagagtttgggctacatgacctctctgaagcttagttttattatctgtaaaatggggattgaaatacttgctgtttaagctttcttgccagaatgaagtaagcaatatgaagcacctagtaggcatctgacatatggtggaaccccatccatgctacaaccctttttccccaactattaccctcctctatactgctcttgtcctcaaacataagagatgcagtaataactggtacttggtaaagtaagttatgtatcacattctttttttttttttttttttttctgagatggagtctcactcttgtcgcccaggctggagtgcaatggcgtgatctcggctcactgcaacctccgcctccagggttcaagtgattctcctgcgtcagcctcccgagtagctgggattacaggtgcccgccaccacgcttggctaatttttgtatttttagtagagatggggtttcaccatgttggccaggctagcctcgaactcctgacctcaggtgatccacccatctcagtccccgaaagtgctgggattacaggggtaagccaccgtgcccgggtcacattcttctatataactatattctctttggctttttgaagctcatgtcatatagttttttaattcttcttatgtcattggagcattctcttttctttctttctttttctttttttttttttttgagacggagtctccctctgttgcccaggctggagtgcaatggcgcgatctcggctcactgcaacctccacctcccgggttcaagcagttctcctgcctcagtctcctgagttgctgggattacagctgcatgccattatgcccggctaatttttgtatttttagtagaggtggggtttcaccatgttggtcaggctgttctagaactcctgaccttgtgatccaccttcctcagactcccaaagtgctgggattacaggcgtgagccaccgcacctggccttttggagcattcttttatgaatgtaaataattttgtggttcctgttcaatatctcccatccaaatactaactgggcccaccctgcttagcttccaaggtcagactagatcgggcacgttcagggtgatatgtctgttgactccttccaacttcttagtgttcttacttagctggaatatacttcttgggagccatgatacttctctgtagggtcattagtgattcctaacaaatgttcaggcatctataataatgctgctatttccattcctgtactttattgtctctgctcaccttcacaaggcagaatatgccacctattggatatatgcagctagccttttgggggttgtcttgctttgtagttcagtttgtgatagaacttgagacccggtaacacaaaattctgagattttgtcagtgtaatctttcttttttaacccctgattaagttgagaatgactttctgactcccatttaaactctgtgaatgtaggtcttgggtatttgaagaatttagtatcattcagtctacttgacaactgattagctacagtcttaaccaagacctggcacagagaacttgaagaataaacttggacagaaaacatggagaactcattgttctagaagttcttttcacactaggctttattttcagatttgaagattcagtgttaactttcatggcttatatgaatattcatagactaatccaaaattgaagacttggtacagcagatatttgttttatagaagattgcaactgagtacagcatgtacctttttcatattttatgtgcaaacattagctttatccctacattattatatgctaaaggatgcttctaatcaatcactaagctatttattgagctgttgtctgtgtatctatatgccagagaagattggcagttataaaaacacccacccaaatgtccaacaatgatagactggattaagaaaacgtggcacgtatacaccatggaatactatgcagccataaaaaaatgatgagttcatgtcctttgtagggacagggatgaagctggaaaccatcattctcagcaaactatcgcaaggacaaaaaaccaaacaccgcatgttctcactcataggtgggaattgaacaatgagaacacatggacacaggaaggggaacatcacacaccaggacctgttgtggggtgaggggagggggaagagatagcattaggagatatacctaatgttaaatgaagagttaatgggtgcagcacaccaacatggcacatgtatacatatgtaacaaacctgcacgttgtgcacatgtaccctaaaacttaaaagtataataaaaataaaataaaaacaacaacaacaacaacaacaacaacttttgaaagcaggcagcatggtttgtgggaacattaattattataacaaaatccttctcattgtatagtttatgaaggttttgacatgatggcatcatttgatcctcacagtagtcatctctgtagtacaagtgtggaaattgattcccaaacaagtgaatgggctaactaaaggttataggtaataaatgtcagaactaggatgtgacctctgatcttttatctctaaatccagtgttttgttctgtacaatgtctcatgtacccttcgtgtacacgtaagaaaactaaagaacaaaacaatataatgaagacaataaggaaaataaaagagcatagaaaggagaaagccacatgggctggaatcatcccttgcaagcagcagtaacaatggcttgaggattctagagtttgagacagcaagtctgcaccatatgtagtggcagttgagttttgctgaaagataaaatgctcctttggaaaggtgaggtaggaagccaataatttggtgggattagtgattggatttttctgagatcatccttggctctttatgtaggatgtgcatagcattcattggttcttctccagttctgcaaagccgtgatgattctttgaggattatgtaacaaatgtttgtcagcagctctgctgctactaccacatattttaacttcatcagaattgacagagggggtgtgagattctgaggatctactatacctcaaatgcagttgaggtggtttcatcacactggctggaccaacatctgtctctcattttgccatgcttgcttttctgccaaatatgttcttccatcttctttaatataaaagattatgtgtgaagaatagttgaggagtcgctggagtaatgacacatttggggtaggggataatcctgtgttttcatgtagctgtagtgctagaataagatgctttatccctatctcaagtggtactcactcactgaagcctgtattggtgattaaggaacaaattgaatttggatagccttagagaaataattggctatgttgacatactcatctcattgaaagtacaggaagtaatacaggtaaattactgctccgggacaaattctagccaaccccaagcagctgctacatgaaatgtaagtgagcacaggctggggagaacatgactgggtgacatcagccactgaataccctctgtacatggtgggctgtgcccaccagggaggggcttgagacagtctggtatgttcccaggatattaggaagggaaattttaaattttaaaaggttcttcacccagatgaattacaccccaaggcaacgagacaatgagccaggtgggattactggccagctgggagtcatctctgtgaaattgtggagaattgatagttaccagaggatacggagagagtaatgttctcatttccccgcaaaaagaaaagaagttggaggccaggtgcggtggctcacgcctgtaatctcagcactttgggaggccgaggcgggcagatcacaaggtcaggagatcgagaccatcctggctaacacagtgaaaccccgtctctattaaaaatacaaaaaattagccaggtgtgctggcaggcacctgtagtcccagctactcaggaggctgaggcaggagaatcgcttgaacccaggaagcagaagttgcagtgagccgagatcgcaccactgcactccagcctgggtgacagagcgagactctgtctcaaaaaaaaaaaaaaaagaaaaaagaaaagaaggtggagtctgggaattactgaccactgagcttcatgttaatcttgacaaagaactgtagaatgcatgattcaaatgatgagatgaaacattttaaaaaggaagtgatgattataagaaccagtcaggattcgttaaggataaatcatgctagactgtcctgactgcctttcctgatacagtgattagatgagtagaccaggaaattctgtgggcatggcacatctagttttcaacaatgtacttgttagagtctctctgggcactgtagatgagaaggatcaatttggattgggtgataggattgtaagatggatgcatacatctttgaactatctgcctaccaagtctgacctgatacctcggcaagtttcttaccctgggaggtttaattaattcattgagtggcaaatgccaaattgttatgtctcaaaagcccattggtaaattgtttgagatttagaatccatttttcttttctttctttttttattttttaaagtgtcaaggtcttgtccaggctggagtacaacagcatgatcacagctcactgcagtctctaactcctgggctccagtgattctcctgcctcagcctcccaagtagctgggactacaggcacgcaccaccacactcagctaatttaaaaaaaaaatttgtgtgtggagacaggggcttgctgtggtggccagactggtctcaaactcttgtcctcaagcagccctcccacctcagcctcctgagtttctaggattatagacaagagccaccacacctggctagaaccaattttttttatcaacactgttttttattatatttcctaacagataaaacgcaaaggcctgttgaactcattatgtatatgcactggaagaatttgggtaatatgaacattctgtaagaccatatcttagagtaagacaaattttgagctctaccatgaaaaccagaggcataatcatctccctctgcttcagggaaaaggcaaccatggggtggatggtggggtgggtaggcaccacctgcttccttcataacccattttgtgttgctgtaacggaacaccttgagactaggtcatttatgaagaagagaggtttattgatttagctcatggttctggagactggcaaattcaagatcagatggccacttctggtgagagccttgtgctgcgtcttaatatgctggagaagtggcaggtgaagcaagtgcatgcaaagagagcaaaacacagaggcaacctcactttataacaatccactctcttgggaacaatttcattcccacgagaactaacccagtctcgagagaaagacattcatctatcttaatgaactaatcacctcttaaaagcacgacttccctatgctgccaccttgacaaccaagcctcaacatgagttttagcagggacaaaccattttcaaagcatagcacttcttatggcattgatgggagatcttcccaagggttggaagctagaactgtgggggccaagccttctgctatcattaccacccagggccccacaagtttgtgtccttgactaaactgaagaacactgaaagtcatggaaggtttttaaagtagaggagccaacaccatttatcagatttgtattttagaaaaaagtttattctgtctgcaagctggataatggattagagaagccaagtcttagacaaacaaattaaaagactgtggcagtaactcgggtgagaaagaatgaaagtaggtgatttgagagatatttgaagggcagattggtatgcctgggcaataacaatgtgaggaaagagggagagtaaaaataaggactcaggtttctgacttgggcatttgagtagataatggtactagatattggtgtgaaaaataacataaagaaaagacagaggaggggtcagttttggccataaagactcagaggtacctgggggacatcaaggagatgtccagtagacttaccagctggatgcatgcttctacagtttaggagagaaatctgggccaacgatataatgctgaattaattttacaccatttgcatccaccaagtgtttttacgtgtggttcctctctggagaccttccttctttgtagagattctttagtgatattttactgtcttgctattttctcaggagcatagtctcattaaggcaatgtactttcagttcaaactgttctatctacggtgattggcttgacagaattctggttccatgcaattatgtctataataagtaaagaaagaataaacacatcaggctaccctagatatttcaaggcattctgcttcatcattaatcatgagtagcctagaaaaatagaagttttataagtatctcctaaatggtaatctgcagtgtctgttaatttactttacctagagaaagtatggtcttagaaattgattttgctgttatattctacagccttataaatcactttccctggtgcatgaataattaaagagagcaatccatacatttctgagcttgttaacatttttgaaacaaaaccagatactaaacatgacattttcctgttgctgtctggaatttctatgcctggtgtctaggctcattcccattatttactttggctccaatgcttggcttcttctttcaagttgtttgccttcagtgtttacagaagtggattcccacaaccaaggaaagggtggttaatgagtcagtctggaagtgctatttttgttatcgtggactagagtcagctcaccataattagtgatattttgtgaaagcaacgcagagcacctaggcagtgccatttccttggctcttctcagtatgtgcagggaacacacccgtgtgcacactcacagatacgtgtttgccacattttagtacaactccgtttctgcattccactgtaagaaagaatacagtcttaatacagtgcaaatgcatgcaatctagactctgggtttgtattgtcagtgtgcttgtgactgccttaagagggtagaaagctttgctgctttcgtggtgtagtgagcattgaaaagtgaaacagatgctgtcacgtgtcttttcctccttgtttgcctggcttaggcttaagatgctttgattatgttatagacccctataagattaagcctaattgtgttattgtatgtgtagttttagcattttgtgatttaagtttttcctctttaagttcttgcttattgatacctcactagtgtctgtcactgtgacatacggtggacctacccagggccattcaaatggagcacagaacttacatgtttatttatttttgaaaaatagtaatatgtagtagggacttaatattttttaatgaagtagattttagatgattattttcaatataaatgctgtgttagcaaataataaaaacaaacatcaattcatacattctctctttctttaactgtttctatcactagatttaactttgcctgtgacagaaacttacagtcaggttaaaaggataggcttgggttcacatctcagaaccaccattttctatgtggcgttgggctggttattgaacttctctaagcttcagttccttcctccataaaatggttggcccataaggattttgttcggattaaatgagatgatgtatgtaaagcttttaatgcccacatgtagcaagtgcttgataaagattaggtgctattattattatctacctcttcagcgtgtgccctaccttcaaactgcccagtaggcttgtgtttgtcccttagattacttggtttttatcatatggattcactgccattttagagctttttattggactctttttcacctttctgttaaaacttctctgtgatttctctgggtcatgagtcatatcttttgcttttgtgaactctcccatcctattgaattcatcaatttccaaaatagacctcaacccatctttggttctttggaaaatgctttcttgtagagatgttgcactaaatctcccgtctcttccttcctcccccctacaacaagccatctttacttcttgaatttattcacagagcatatttggttccgagttactttcagaaggtaagttaaagtatagaaccgtcatccatttagctcacgacaagctgctttttctcctttgggctaatttgaaagtttatctttaagaatctgcctggtcttctgaaggtctactgtttccatttctaaccaaatttaactttatccatgttttctttttcttctttttttgttctttccattacgcaacattcttcaagatgtggacgagtgcctggaaccaaacgtctgcgcaaatggtgattgttccaaccttgaaggctcctacatgtgttcatgccacaaaggctatacccggactccggaccacaagcactgtagaggtaaatactgtgatcaagtttcccatttttatttaaacttcatttaaatatagattagagcaattagccttagaaaagggaaccctgctacctgtgtttattttgaccgagcgacttagagcacatattggttggcttggctgaaagtggctccttgctgtggttaaatacagagcatatctatttacataaagggaaacgatgtatttttagagagtgtctgtgagccacagatcggttcatctaaatttttttttctcattataaaagcaatacacacagttgcacaactctgtgaatatattaaaaaccattgaattgtacattttaaatggaattgtatagcatgggaattatttctgaataaaattgatatgaaagtaaccaatatacactcattttagaaaatttagcaaatagagaaaaaagaaaagtaacaatcttacataatgtcattaatgaatattcatatttcgtggatattgtatataaagatgttctatgtataattttatatcttgctttttgccatttaatagtatacctaccataagtgttttacattccattcataactttttttcaaacgttatttttagaggctgcacaatattctagtatattcctatatcacagttttcttgctcttctttaggtattgaacaaacaaaaaattttcagcttctcattagtgaacaaaactggtacaggtcttttttttttttttttttttttttttttgagctgaagtctcactgtgttgcccaggctagagtgcagtggcatgatcttggctcattgcaacctccaccctccaagttcaagtgattctcctgcctcagcctcccgagtagctgggattacaggcacacgccaccacgcccgactaatttttgtttgtttgtttgtttctttgttttgggtgtttttttgaggtggagtcttgctctctcccccaggctggagtgctgtggcatgatcttgactcactgcaacccctgcctcctgggttctagcgaatctcctgcctcagcctcctgagtagctgggattacaggtgcctcccaccatgcccagctaatttttatatttttagtagagacagggtttcaccatgttgggtaggctggtcttgaatgcctgacctcgggtgatctgcccacctaggcctcccaaattgctgagattacaggcgtgagccaccacacctggctaggtctcttttaaaaataaacttttgtctgaactttagaattatttccttattcataaaagtggaattattgggtaaaattttttttttttttttttttggagacagagtcttgctctgtcgcccaggctagagtgcagtagtacgatcttggctcactgcaacctccgcctcccaggttcaagcgattctcctgcctcagccgcctgagtagctgggactacaggcacccgccatcatgcccagctaatttttgtatttttagtaaagacgaggtttcaccatattggtcaggctggtctcgaactcctgaccttttgatccacctgcctcagcctcccaaagtgctgggattacaggcatgagccaccacgcctggcaaaaatgttctgaatttttttactatttggttttttttttaattggcatgtaataattgtccatattgtacatatttatggggcacacagtgatgttttgatacatatattgtatcatggtctttttactatttttacaggagaacattctcatttcatatatatatttattttaattctgaaaaggcttaatttttttatatgttcattccctttagcgattctctgaacacttctaatttttaaacatttattttatatacttaacatttatatttgtttttaaaatttccattaatatcatttctcatttatccggctttttatttgtttaatcaatgtatacgaactctttatatatgtaatacatatataaacgtatgtacatgtggccggacacagcactttgggaggcccaaggcagatggatcacctgaagtcaggagttcgagaccagcttggccaacatggtgaaaccctgtctctactaaaaatacaaaaattagccgggcttggtggcatgcgcatgtaatcccagctacttaggaggctgagacacaagaatcacttgaacccgagaagcagaggttgcagtgaactgagatcgtgccactgcacaccagcctgagtgacagagcaagactcaaaatagagtctcaatgatgataataataataataataataaatatgtgtacattacgtatacatttttggtggtacactgttgtaatttctccaaggcttccctaattttcctttttatgattttttaaaaattttttcttatggccaaatctgtggatttttttcttttctgcttacttttacatctaaaagtatgttctagcaaagggtaaaagaggaaataagtaaacattttcttcttaagtgtcttgatgtaagtgaaggatgtagggtgataattaatttctcactatggtaggcaagtagtaaatgaataccctggtatcctgtaagaatcgaggcctcttccactggcagtagggaacatgcaggcatctggatttgatgccttgctccaataatacaacagagcaacagtggatcttggccactcctagtggaacatctaacgtgggcacacctccatttctcctggtcccttctcttttggctcacatccacagtttcctactgattccttaagccaggtatctcctcagaccaaattaaatatgagaagcatctgaaaggtattatttcttcccccatacactggatcaatggtggatgaggatctcaagccttaggagtcatggttaatctttgattgctatatctagtttattttcatatcctgccattttatcttctttcatcctaatctgcctaatttttttcatctgcttgttgataaaaactcttgtaatctgtcctcctctttcatagtccaaacttacttgtcacagttgcattcttcagctagcattctctgacctatccaaatcaatgtcacaactgccctgtgaagattcttcacagggcagtacttggacccaagtacttgttcaagattatcctgcctttcatattcatcttcttcctcactgcttacctgatgtggctcttccagtggttcatggtatgaccttgggtgaataatctcaggtttccagacattgtgtcatccctaaaattaggggatcagactctctaatgggatgctcaaagtagcacatgttgaatgaatggctcattaccactgtcttgctcttggctgttgccatcccagctgagcctgggaaagattggttggggagacaagacaactaacagcaatctaatatccaagattataatatatatataatgtctaaagtctagtatttagttttgtttttttaaaaaaaggcagcatatcggatgctagtcctgatgcgtagaagctgtgtgagcttggataagttacggtatcttacttcactaagccttacttttctcatctgcaaataaaagggagcaataatggtacctgctagagttgatatgaggattgcaggaaataatacagggacagagatcatgtagagagaatgagttaaagcaggggcagagcatgacatggtggtggtggtgtttgctaaattagaggcataaacaaagtttcgttaaagccaagaagtgtgtggctaactctgcttgtgtgcgtctgggaaagcttcacaaaggtattgctatttgaacttagtcttgaagtactgaatacaaaggggagtaaaacttggcaggcagaggaaacagcatatgccaaagcttagaggtgagaaagggctattacttccacttggcatttaaccttgacctctactccgattctaatggcgtcttcccattacagcctgggatgcattacctcattcttcccacatgatctctgtccctgtattatttcatgcaatcctcatatcagctctagtaggaagcattattgttcccttttttttgcagatgagaaagctcacacagcttctacacgtcagagctaggatctaatatactgctttatttatttatttatttatttatttatttatttatttatttatttattgagatggagtctcgctttgtcgcccaggctggagtgcagtggtgcgatctcggcgcactgcaacctctgcctcccaggttcaagtgattcttctgcctcagcctcctgggcagctgggactacaggcacgtgccatcacacctggctaatttttgtatttttagtagagatggggtttcaccatgttagccagaatggtctcctgaccttgtgatccgcccacctcggcctcccaaagtgctggtattacaagcatcagccattacacccggccctgccttttcaaaacaaaacaaaacaaaacaaaaacaaaaaactaaacactagactttatttggatttcacaagtttttccagtcacgtcctctttctgttccaggatccaatccaggatactacactgcatttagttgtctagtctccccaatgaatctttccctagttttcatgatcttatctatcttaaagagtataggccagaatcctgtagcttttccccactctggatccatctgatgtttttctcatgattaaactggggtcatgggtttttgggaagaagaacacagaggtgaaaggctctggtcctcacataatgtcaggtgtacattcacatgtcgggggtgtgtgatattcttggcacaaaagaaagaagacatttgtccagcattcctattttattagaaagctttcttttggctcagaaatgctatccctcattagaaaagaaaaatatttttatccctagaattaatctatctttgttcccttggtcattttaaagacccaaagatcaccttgtgcaagataactgtgttgcctcaagttattccaagtgtatgtgtcattacttgtcatgaattactcctgacattcttagcaacataaatgagtcagttacgtaagatgtctggcatagcctgatagtccttggaatggagggtctatctctgttgcagacatcttcacatgggaatgcttaatttgttgtcttctatgagaaagtcaaaaagattccaaagcactaaaaatgttgtcagatgttatgtgagatccagccagctacaagaactattgttggtcttcagttcgtgaactgacatctcaagtattttatagaatgtgctaaaagaaaatagtgacgtaggctgatctttgctggcaaccattcctaaagctaagagacttacagtgtttgaaaggtataaaataatctttaaaatgaaagttaccttgtttattttctctatggacagacaatattggcagccaggaattatttataaatcaaagagaccaagaacacaattggtaaaacaaaagtttttaatcaactaaagtaattgctatgaaatattaaataaaataagaaacaaatttttgaactccaattacattaatactttgagctatttcaggaaactatgtcagtatttcagtagcaatttcaactatttcagggagggataacctgatactttgcttatatctggatacattttaaaagttaatgccccattagaggttaagaaatgaaactttgcggctaggtgtggtggctaacgcctgtaatcctagcactttgggagaacgaggcaggcggatcatgaggtcaagagatcaagaccatcctggccaacatggtgaaactccctctctactaaaaatacaaaaatgagctgggcgggaggctgaggcaggagaatcgcttgaacccgggagacggaggttgcagtgagccgagatagcgccactgcactccagcttggcgacagagcgagactctgtctcaaaaaaaaaaaaaaaagaagtttggctcaggagaaacaggtaattgtcaataatacttgagtgaaaggcctatacagttaattgagttttcctggcagacacttttagatgcattttaaataagaaaatttgaagaaaaccacagtcatacattgatctataggacatggtttttaaaaaacaaatccctctattttatttattactccctttagattagggctcctttctcctcctgtgagtatagggctaaagtgttttatatctattcccttcggtaatcttcacaacaaacctgtcatgtaggtgatgaagatcagttgtacctaccatgttttaataatcataaactcttataagttggctagccattcagcagaacattctgaggctgtatttgcactgacaaggcaagacagaattatctgcttaggtcggaccaatataatggccaaacaaaaacatctggaagactctactcttaccagacgtgttcaagttattgatgaagccagtcctttgcttcagttgtataacttcgtatacatgacattttctaggacacttattaagaattatcttctttctcagttagtgattttatcttgtcaaagcatgtttaaaaatcctcacttatcactttctcctttggtattcagcagtcatcataatactaccatttctcttggctttccttgttactttgaaaatgagccagagttctttatacaactgtttggccttatagttcaacttctagacaaagtagaattatctgtttccttccataactgcctatgtttttggttttgtttttcaaattcctagtcgagttttccttctgacttctttcatgcaactaaacaggtctgcaaactatctgagcgacattatattgcatcaggttctgccttctgtttgcagctctaaaatatttcatgttgtattccaagacactgatggtgaggagtatgattattataaatagcttattgatttattgtctatttttagttatttctattctatagatcagtatactgaggttgatacaacagcatgggtggagtgataaatactaaagtgtgtagtgccagacataagaagtactattatttttgttacactaatcccagaatgcattgcagggagcactgcattctcctgggtagtctctttttcagaaaaattgccgttgttgtgtttgcagatattgatgaatgtcagcaagggaatctatgtgtaaacgggcagtgcaaaaataccgagggctccttcaggtgcacctgtggacaggggtaccagctgtcggcagctaaagaccagtgtgaaggtaagagggtagtaacatgaactactgaaacttcagcttaaagcacctggtctgaaaaaggtacgctcaatcaagtgagtttaccttttaaaaattacccagataattgcattatagtgccagaaagccaggacttaaacataagttaggaaagtcaataaaacaagattgaagacagttaaatttgaaaacctatggcattagctatcaatggctaggcattagtattaagaagaaaaattattgctttctgtgtaattctttactacagaaggtaatttccatttaaacatgtaaattaatttaaagtttttatatacttggatttcagcaattagaaagtcattatatcgggctgctttatgctgtggaatgttaataaccttaatttttgtatttaacgttgaaaaattttgtcttttaaaaaaatcgctaaagaagatttctcaataaaactgtaataatgtcccccttagagagaaagtttgcaaaatatgttctgttcctacagctgatagtgaggattctggatttgctagggttgaccttagactttttaaagaaacatttcattgaattgcacacagaaatacttcacttcccaataagtatgtgcttcctgaacttgaagatattatgatctcacctgtgtcaaccacaagtgtccagagttcttgagaggaaacgccatttcttatttaagaacagaatccacactgtataaggccattgtttcataaataaacaatatccacgtcttcatgtatactctgaatatttgagaagcaaaaaagtctcctgagatagtattacaaaagcgacaatacatgatggtcattacttgtatcaacattgtctttctagaatttacactgatccaattgagactgattgaaaatgtttttgaagcaccacttccacagtttctttgtattctcttgctcatagacattgatgaatgccagcaccgtcatctctgtgctcatgggcagtgcaggaacactgagggctcttttcaatgtgtgtgtgaccagggttacagagcatctgggcttggagaccactgtgaaggtaagaattgctcctgatttcagaatcataaaatgcccagatcggagggaaatctgggcatcatctcagccttgatctttgaacctcatctcttgatttcatagtgaagacattaggtccctgcaaagtgtcttccccggggtcacacaaataattcaaagaagggagtagagtccagattatctttgcactgcttggagctgtcttttagacttgtgccagccaaaggcataaaagaatcagtttaactttaccagctatagatggtttatcctgggtacatagttctgaactgtaacaccttatttatgcagaaccaacttctaaatgttccaaataagtaaatacaacttaattttccaggcaattagaaggtttttcagagccaaacatcaattcagtttttggctttttgcataaaatatttctgaaagatatcccacatgtccagtatcgtgcagtcatcaaccactttcactacttgtttggctaagaagctctctgcagtggttgggtgactgaaccaggcctgcttatggagcggggaatatcttctcccagtgggcttctttttcacttttaccaccggtctgtcacttgtgacctttctctgcattcattgtccacctaagtaacaagctttttcccagcccacctgaggtttcactgcatttagagcctgtcagttgtgaaaccagaaatatgcatgttggcagggttgtgtctcccatgcagggtccaagtttttgaaggagggtctgaaccccacctttgagagaagtggatgagccttttggtgaatggtttcatgacacacacatttcagcagccccagatcctttttcactaccagtccagtggattgggaaagatctattgtcatttacagcatctacatttctgaccagagaacttggcagaagcagtcacaagtggctgagccccatatcctcctgctgctgggagtgtaaatgacccaaccctcgggaaggcaattttggcagcgttttaaaggccttaaagtgtatactgttaatgaatcagtaaatcaacttctaagattttatcctaaggtgatcatgttcctcaaagagttaataacaccagtgaaaagttgtaatcaatatacctattgaggccagatgtggtggctcatgcctgtaattccagcactttgggaggccgaggcaggtggatcacctgaggtcaggaggtcaagaccagcctggccaacatgctgaaaccccgtctctactaaaaaaatacaaatattagctgggcgtggtggcgcccagctaatatttttacacacacacacacacacacacacacacacacacaaacacacacaaacacacgcacacacacccctattgagaaataggtcagataagtgataatataagataggactatgtatgaaaaagttgtgttttaggaactctctaatatatgggtaaatgataatgattctagatagtgacatcccaaggtgggagggttggtggtgttggagggagacatttatggaagaatctattctagaactaagtaactggtaaggtatattctagggcagtggtccccaacttttttggcacacagggaccagtttcgtggaagccagtttttccctggatggggttgaggggatggtttcaggatgaaactgtcccacctcagatcatcaggcattagttagattttcttttttttttttttttgagacggaatctcgctctgtcacccaggctgagggcagtggcacgatctcagctcactgcaagcttcgcctcccaggttcacaccattctcctgcctcagcctcccgagtagctgggactacaagcacctgccaccatgcccggctaatttttttgtatttttaatagagacgggttttcaccgtgttaacctggatggtcttgatctcctgacctcgtgatccgcccatctcggcctcccaaagtgctgggattacaggcgtgagccaccgcacctggcctgcattggttagattctcataaggagcgtgcaacctagatccctcacatgcgctgttcacaagagggttcgccctcctatgagaatcgaatccagctgctgatctgtcaggagatggagctcaggcggtaatgctcgctccctgctgctcacctcctgcagtgccgcccggttcctaacaggccacggacccgtaccggtccatggcccagggattgaggacccctgtgctagggcactaaaaatgtaaactgaccatcagcatctcctctgtcctgattcctggccaagccaagaaggaactgcaccattgattaagtcttgggtaactgatgttcattggagggcatgttcctcgctttgtctcttttaatgtgtaagcattttaacagaagtctaaggtttttattccaaaaacatccattgcatgaaaagtcaaacaaaagcttttagcaaactcgttcttcattattaatgtatataagatatgactatgttccgtaagaaagcttcttttggaatatataatcaggcccttttaaagtcaggactagtttctctagtgtactgggttataaataggactggagtccatccaactaatttagagctccctttgaaactatgttagcacctcagcctgctaattcccaactagcaatgtttccgaccctccccagtgatatttagccataattaactaaaccgtgactgttcacacgcctctgacagctgtgcaaggaagagccatctttcttgttggcttttatgtttacacgtgtaattttcccctaatggttctggcaaagaccttgttttcttattgtcctgtcatcctgctggcctcctcgtagagtcagactcccaagtgttgtgcctgcttctgtgcgctactgactccagcatgcttggtagctagtcattctgtgataatgaacgtgcctcaattgtcctcattcttaggagtctggagcatctcagctttcaaaggctctgcctgtgacttgttccctccaagcacagtctttaatctcgtgtctaccttaacctttccccaatccctcactaaggttgctccctgcagtcctttacaaagctgagaagatgactcattacttacaatgtctttccctttccctctgtgccctttgctcttggtcatttatttgtggacaaaattttaaaaaggtggaaaggtgggatagtatttctttccaaatcagagtcattcatacattcacttatgtatttgttcaaatatttatttagtgtggagcttgtgccagacactgttctaggcatagggcaataaaccaaacagaaatttcttcccttttgtagcttacattgtagtgtgggagataacgaaaaaatacaataaatggctgggtgcagtggctcacgcctataatcccagcactttgggagttccgaggcaggtggatcacgaggtcaggagatcgagaccatcttagccaacatggtgaaacctcatctctactaaaaatacaaaaaaaaaagaaaaattatctgggtgtggcggcgtgtgcctgtagtcccaactactcaggaggctgaggcagaaaaatcactcgaacccaggaggcagaggttgcaacgagccaagatcacgccattgcactccagcctgggcaacagagcaagactatgtctcaaaatatatatatatgataaataagtaaaatatatagttcgttaaatggcaataaattttacagagaaaatagagcggggtatatggggagtgttgaggaagggtggtgattttaaataaagaggcaagtagaggcctcgctgggatgataacacttaatcatttatgggtagagcattcagttcaagggaatagcagatgcggatgcccgaggaaccagctatgtggagacctgaggggcaccacgtcagcactttccacttttgatgcccaagatgaatatttgaaggaagatatctgaaaggcaattgtatctatgcatttggaatttaggggtgagttctaggccatgaaattaattgggaatgagtgtagctagaagagagataaatcccgggccctccaacatttagaagtgaggaaatgggtaagaaccagcaaaggagattgaggaaaaagtggcaagtgaagaaggagaaaacccagaatccaagagaagaaagtgtttcaaggaggagggagtgatggattgtgtcaaatgttattgctaggtaacagaagaaccaaaagttaaccatgggatttttagcaagctggaagtagttggtgacctcaacaagctcagtcttggtagaaagatgacagtgattcactgttcctgcccttaaaaccttttactctacttctaggaaaaatatatattttcgcactaccccaggtggtggtacgaaatagtaccatgttgtgctctcgtaatgttcaaccttcttattgctttgaagacagataaaggccttgcaaaaaaaaatttaaactaaacctaaccctaacatatgctcagctttctaatgtatataattatttataaacactttaaataatgctcttttccctcacattcattatttgtcttagattttggaaaataaatgagaatcaaattgctttaaagtagcatgaacagagccgggcatggtggctcacgcctgtaatcccagcactttgggaggccgaggcgggtgaatcacttgaggtcaggagttcgagaccagcctggccaacatggtaaaaccccatctctactaaaaatacaaaaattagccggccgtggtggcaggcgcctgtaatcccagctactggggaggctgaggcaggagaatcgcttgaacctgggtggcaatagttgcagtgagtcaagatcacgccactgtactccggcctgggtgatagagcaaaactcagtctcaaaaaaaaaaaccaaaaaccagcatgaacagagcaacatgcttccattatgctgaggcaaacatctaggttatgaagtgttttttcttgtagaaattcatattcccaggattctcttatgatcttttttgaattgagttttttatttaatgtcactgatcaaatatgcttctcctcgcttcattatctccatttcctacaaagcaaagaaagaaaggttaatggaaaaactgattgtcagtcgggtgcagtggctcacacctgtaatcccagcactttgggaggccgaggcgggtggatcacaaggtcaagggatcgagaccgtcttggccaacatggtgaaaccccgtctctactaaaaatacaaaaatcagttgggcgtggtggtgggcgcctgtagtcccagctacttgggaggctgaggcaggagaattgcttgaacccgggaggcggaggttgcagtgagccgagatacaccgctgcactccagcctggcaacagagcgagactccatctcaaaaacaaaacaaaacataactgattgtctactttacacccattaaaatagttgtagagctgtcagagtaaatgtggaacaatcggagttctcatatgtttcctgtgggaatgtaattgctacagccacttcagataacagtttttcaaaacttaaatataacctaattccatgacccatgcatcgttttcctgggtatttactcaaaaaaggtaaaatcatatgttcacacaaagacttatgattttagaaatatttatagaaaccttattcacaatggcccagatggaaacaacccaaaatgcttatcaaaaggtgaatgagtaaacaaattatggtgcattcatccaatggaattctacccagcaataaagcacagagaactactgatacacacagcaacttgggtgaatctcaaaactattatgccgagaggaagaagccccaaagcacaaaaggagtgagagggaatgtattggggatggaaatgcctgttccttgactgggatggtggtcacaaggatgtgtatacatttgtcaaaactcattgagctgactcttaagtagatcaatttattttatgtacattatacttcagtaaagctagaaaaacacattaaagaaaaagttgagaacctgccttagttgagacaaattcacatcacctgtgttttatgttttagggtcagtacccggaagcattttaattctgggtgaacagtcattataataacgtggttttatttgatagaaagaagtgataaggcactctcttatttctcttttgtttgccctgtgaatagtacagaagcctgttaattggttgattggattctaggagaaaaatgaaattcggtatcaccgtacttgaaccagacagccgggcgtattagacagatggcaacagtctccatattcacttcttcctggaatctctcatattttggcagcaattacaattatttgcaagaaatgccataaaatgccaagttctgagaaaacaaagaaggttttgtttcttagctttcttcgttgctaataacttaaatcctcacattcacaacagaagagggctcatggagtacattaggaataatgtgctttgactaggggtaaacatggtaatcagcagcccttgagaaagatctgctcgcattcatgcggtgaaggggagccattaattgtctttcattctcacagtcaaaactcgttattggttatgtataccacttttagttgcgcatttgctatgaatttttttaaacatttttaaacattttttaaaatccaggctacctcaaacctgtttgttacagctgctgaataagtgacttaaactaggtttttgatcttgctgttctccttctgttcaaaagtccctcttcttccgactcccccatattctaccctactgtgaaatttactataagtaaatttacagatatgcttctgttacacaaaagttttattttaaactttatgatattctttgtctaaatgcatatgacccctaaagttgatgctactactttgtcagataattatattttgtgacaattcttatgttacattggtttggacttataaaacaatgtaatattttatgtttaataatacaatatcatttgtttattttattgttaataatacaatatagtttgtttctttgaacaaacatttctcttggggacaaagaccatgctgaaaacttttaaatttttttctataatgcataatacagaagcttgtataaatagatcaagtgttgctcaagatacacttaataagtatttttgaaatattttaagtctttatcatcaccaacaatataatcaagtaaattattatttgctacagaattttgacttttcctcttccatttaatttcatttgatgtttaaaagttccatttcttggccaggtgtggtggctcatgtctgtaatctcaacactttgggaggctgaggtgggcggatcacttgaggtccggagttgaagaccagactggccaacatggtgaaaccccatctctactaaaaatacaaaaattagttgggcgtggtggtgggcgcctataatcccaactactcgggaggctgaggcatgagaatcacttgaacctgggaggcagaggttgcagtgagccaagatagcgccactgcactccagcatgggtgatggcaagactccgtctcaaaaaaaaaaaaaaaaagttaaaaagttgtcatgtatttaaaattatgtattataaatgatgtaaaatagtgtacctttacatgtaagagaaatgtctaattttccgatatgtgatttatttagtctttaaaaatttttaaattggtttttagatatcaatgaatgcttggaggacaagagtgtttgccagagaggagactgcattaatactgcagggtcctatgattgtacttgtccggatggatttcagctagatgacaataaaacatgtcaaggtatttcttgctcttttttccccagtcattatttacgtaattcttcaattctgccatgttgccagatgatagtctgtggttttgccatgtgatttatatgtaaataatttatgtcaatttttgatattaaaatagctgtcttgggtccacatcaagtgcaggaaggtgttgctttgtccagcatagtgtcaactgaaactcacacgagtaagagctgtgtcctcactgcgtgcttccgtcacctgtactttactgtttattccatgctgtaaccttggtactgggttctaaattatctttatagcatcttttatgggcatattttattttgtctcataggtggtatttatctgtccttttctgactctatttttatccagtgcccgccattgctttttttttttttttgagacagagtctcgctcttgtcacccaggttggagtgcagtggtatgatctcggctcactgcaacctccacctcccaggttcaagcgattctcctgcctcagcttcctgagtagctgggattacaggcgcctgccaccacacccggcaaatttttgtatttttactggagacgggggtttcaccaccttggccaggctggtgttgaacacctgacctcgtgatccacccgctttggcctccaaaatgctgggattacaggcatgagccactgcacctggctcaccattgctttttctcttcctaaaaagcctcactaataatttggtcaaaatcatgaagaagaggatcttatattttttcaatgtgctgtcatgtttaatcttccaaactgtacagtgcatgaagggtactaatgaaaacacagcaacacaacacaggtactaataataacaatcacagcagctgtaactgagcttcttcagtgtgctgagtactgtaggtatcttggtatctcttcgaattcttacagcaacttcagaggtagcttttcttgtattcattttgtgcatgagtaactgaggctccgagaagttagggagtatgctgctctctaatgagtggtaaagttgagatttgaacccagggtcttttcccactactcttccctacattgccataccaattattgttacatttatagccaaaagaaagaagaaagtgaaattaagtgatttctctcacaaggtagcccattgagtcatttcaacaccatagctaaaaaaattaaattctctaggttctgtatcccaacatttttagctatacctgacttgccccacaagctttcctctatttactagtgttagtaaacccatgtttatattttccatggaaaattcacacttattttacctttatatctgtttatttttgatacccaataaatgttatttttttcttattgtttatctaccattatggaactgtgtagtgtatcccaaagcataaataaataaaaaaaattgttggagttactttttacccactattactgaatatgtatgatttttttaaaattctggattgccataagttatatctcatctcacatgtcccaaataacagtcttcttgtaggagaagatggtatctactctctaagatagtggcactggaattatatatctatattaccggtcacacccagccatgtgtcagagatatgaaaaacacggacctttgccacaaggtttttaaaaattaattcctttactgatccaaagatttaaatatacaccttcctgcacttgatgtgtacccaagacagatattttaaaaatcccaagatttaaatataccatgtacctcatttgagatcatgtatttatttgccatcctcatgcaataaggtgaaattcaattttttccaatgcagaaattaaatgtgcttggacttaatgcaaaagagaaggaatatttgaattataaatatatgtgagaatatttccactttgggactattaccttttaacaaaatgaatcttgatttatataaaaataccaagagatggaaaaaaaaaaaaaaaggaaaccaaaccctgactcttgtttttattataggctttttggcttaaaagtatattttcttttctaattcttctcgtcacaatttgttttggccaaatacaggcaaaaccaaatcttaataaaaatggaccaagatttcatattgcataaatttaacttctagagttcagtcacacggaactaatttagttatctgattcattaattgcactacttcattctctcaatatattaaatttgtgtctgtggtttgatatcacctctcaaatatgtgactactccaaacatagagagttttattgactatcaatcattattaaattgacttcgttctctgtcacatatattcctattttccagaataagttaatatgtctgaaaaatgtaaatccaaataaatgagaagcatttctgaagtaggtcttagtactgtttaaagaatagtgtctgtgaatctgttttatcacccaccacctcctgttagaagctgtatatgatggcatgtatatactcacctcgttttgaattatcccttttcgctctttcactagaggcagttttgtgatctttcactctgcctgaagttagtagcctacttttctctaatcccttgatcatgtcagcattctgtggagaggtgtagatttcagagtttgtttaaattctgaaaatgtaattgatggcaatgctaataaccatggacatgtttgaataacagtgtgtgataggcataaactttaaaccttacctaatgttctgaaaatacttctatattcagtaaggcattttcagttggaagcgtgtttaagattttctttcccatacaaaactaatgatgatatacagacagtatggaaattccatgttaatagtctctttagaaatgtggcaggatacatttgagattcagaatgcagttcagtttcatgttttgatttacgcatgccaaattatgaatttctgtggaatcgcggacccatgaaagaaacccaacttaaatatagtctggctttcagcttgaagttactagcagcatagtttagaaatgcctcaataagtacaatccaaattgaatgcatatgtttccctagttccaaatattcatgttgttctttcttagcagtttcctggaaaaaaaaaaagtctaggaattcatcttcagttcccgtcatcaaactttttagacaattatttgtgttaatcagtgacttttttgatgaaaaaactttgtgcacattattccctatgcaaagttgcaaagcaggtagtttttaaagggccacactgaggcataggataaaataagaagaggggtctcaggtagctattagggcttaataagatggatataggtcctgagcttgatccccaagccagtggaacttcatgccaccttcttcctcagatagaggtaattcttgggcagcaggttggaaataaagagtggatctgaggaccaaaaggaggtcaaacttcaaaaaggatggccaatctaagatattaccaataggtagagaacaaacatagacaatgtcagagattttatcaaagaagtaaagaatttcacagagtaaaatcatattgagaaatacataagtagaaaatgattcattgaccttccttgaaatatctaaaaactagtgacagtaacaagaataggagaattgttaagaaagtatgagtaattcctgttgggtttcttatttttattcagcgatggacaggccaaataatctgaattatgttgcagatggaaggctaaagagttcaagattaataaaggaagacgtttaaaccaataattgccagaatttctgttgcacgggaagatcaacaagtcaaaaagaagagcttcaggagattctggctgtagggaaagggatgactttattgaggaccactgggtcagtggctaagcgtgttgtagcagccaataggaagaacatacattctgtaccttttccctgtccttattaagctttgcagtattcatgtgggttcctgtactgaagacctcttttgtaagagataaagggagggcctacgagacttggggaagataggaaaacgaccttagtggaggtatgcctcctgaatgctgctgctaaggacatgggatcatttttatgacccccaattaactaaaagaaccttcaccagtcaccattcagttagcggagaaggaaaataactgagaaattttgtggtggacaaacattcataagaccctgcaatgtacccaataggagtcaggaactcagagcttttcagctgagatcgtttatcaaggagccatcagtgtaatgagggacacagatgagtaaaccaacaattaggcagttgcatgtatcagaaccattgtgaacaggtgaaactttctctaggcgctttatgttgtcatcttgggcactgttagccaatataattagaactggtttgaaagagccttttacttatagtaaacagtccatgtgttatcagtgtttggaagtagcccttgaccctggccacggggagcacaattacactgaggacaagctgagcataaagtcgacaacacaagtgtatggcatgatctgttcatgagtcttcttaatagtagttattgctttttgacgcttcattgtgtggtaggcactgccctgagccctcattcgctgatttcatcatcggaaaccatgcaaatacgaattttcatggtctaaaagtccttctcagccaagcatggtggctcacctctgtaattgcggcactttggaaggcggagacaggaggatcacttgaggccaggagttccagaccagcctgggcatcatagtgagaccccatctctgccaaaaatttaaaaaatttgccaggcatggggccagtaccttagtgccagccactcgagaggctgaggagagaggattacctgtgccctggagtttgagactgcagtgagccatgatcatgcactgcactgcagcctgggcaaaagagtgagaccctgtctctaaaataactaaacaggccttcttttacttgtattttatttctattacccatttccaatgagttatagattggagtctatttcatttatatattcagcagacatttgtgaagtgccatttatgagccaaatactataaataagacatgtctagccttgcccttaagaagcccacatcctagggatggataggcaggaatgtaacaaggtactacagactataacagctgtgtgcatggcaatgggagagggcaaagaaggacagcattctcaccaatgaagagcatctctcagagttgtggagtattcctcaagccccatatgtctaaaataagggtagctttgggttgaacctatgaaattgctttttttgcaggtcaaaaatgattgtacattggctatttcctaactcaacctaaatagtttctctctcataactcagcttgtcctgtggttgatttatggacaaatggtatagttgttccactaaataaatgtccagccatgtcataatagatttatttgccatctgtttgatagtatatgggaatgaaaccgatttttttcaagtttttaagactctattttaaattacagatattaatgaatgtgaacatccagggctctgtggtccgcaaggggagtgcctaaacacagagggttctttccattgtgtctgccagcagggtttctcaatctctgcagatggccgtacgtgtgaaggtaagataaaccatacgaaatcatattgttgtgtgataaaagagagaggagattgctttcacttatacaaagacttgaagacactaagaggtactgcataattcagagcctcaaagcatgtatgcatcaaagtaaaccatatctgaaagcatagctcaggggttgctgggatttacgaagaggataacctaaggttatgatgataaaaacactcacagatggctccacgactggtactgaattaatgagtggaaatgtgcaaggactgataggagacatgtaggagacctaaaggaaaactgtggcaacttccctttcccctgggactctgcttcttttgattgtgcttcatgtagatcgtcttgatcattctgtgtgtaaaaaatgtcttgcggctgggtgcggtggctcacaccagcacttttggaggcccaggcaggtggatcacttgagatcaggagttgaagaccaagcctggccaacatggtgaaacctcatctctactgaatatacaaaaattagccaggtgtggtggtgggtgtctgtgatcccagctacttgggaggctgaggcaggagaaccactgtaacccaggaggcagaggctgccgtgagccgagatggcaccattgcactccagcctgggcgacaagagtaagactccgtctaaaaaagaaaaaaagaatgtcttgcttgatttttctgtatcactgtgaacagatcttctagaattcttcccctaatatccttatttccaaggcagtatatttacttacctaccagtatttattatctcctaaaagctaattaagttgtaagatgttaagataatgctcttggcttcctacttacaacctctgtatgtttgcaagaatacagcactggttattttcataagatttgtgttcttgatgataatttacctgaaccattttaaaagtaaactgaaaagattcccataatcataatttcagttgatctcttttgagaatctagattattgaaactcagctatattttaaagaagtaaattgcaaaagttttgttctgggtctaacatagtgcccagattctttgctctaaaaaatagtgcaacaggaagtatctgctctccttgctagtaccagaatggaaccaagccgtgtgccagcaaccaggttcatctgaaactaattattatattgggaggaataaactgatcttgtaaagagcagaagattgttgaaattactctcctgctgagcagacaaaacatggatgccagatttgactagaactgggagagagagagttcagggtggattgagcaaacagattgaggggtttggaagggataggaagttgggaaatggaagaaagcatcataataatgtgggtgatgagagatttagaagaaatccctgcttcagtggttcaagttttatgtaaattttatatttggggctttgagaccagagcttttagcaaagacactccatgaatgcatacattcttctgcagagattacagtattcctcagcttgagggatagggtgcaagcccatccgagtcactgaggaaacagatttgcagaattcctaagctctagaaggatgcaggtttgcttctttgcttagctctaaatcatggatggtaaaggcttgcttcctaagaaatggtctgtggtataactactgatggttgtgccatgcaaaattatattcagaaaaaaaaataagtgacctcaagtgctccctagtcaaagctgttgttccaaaagaatatactaaacataaatatattcacaattattttgtcttttgcacttactaatgatttaattctgtacttttttaacacagatttctgcaacttgagagttgcataatcactgtaatttagttgcagctctaattttgttggtcatttacttggcaaagacttgaatttaaaaatgtggttttaggaaacttgtaatgctttataaattactgtactcattgagtatactctttgtgacacctggtctgtactgccttgactccagaacctggacaattttataagtaatgaaatacaagttagaatattatgttggtattatacatggtagtataactagaactctccgtaattattatgcatgttattctctttctggagtaagttctgcatgaattttattttttatgggcttaatccaatattctaaattggtccaaatttccctttgttagactcagtctgacacttatggcagtagtgctatgtcctgatttctacctctggctgtgctgcaggacaaagccagctcatgtgatcagtattcagcagtgaggctgatgtgtgattgaaatttagcaatggagcagttgtacatagtacttgaattaacactgagaagtggctggcattcttatctcatgtccatttactgattttcttctgagcttctgtttgaggagctgaagcctcgttgacaccagggctgacctgcccggctctaagcagggctaaataactcccacatagctgaaggaaggagggcccttccctgatttcccgtgacttggagaagtgtcagcatctggtcgtagttaatgaaccacaatgaagaggcaaactctgtcaacatgaattgtctttaagtgtagcatggcagcttctatagcaataaaaatggcaccactggctccttcctttctcttacatgtatagattgagtattcctcatctgtaaatccaaaatctaaagcactccacattctaaaactttatgagtgcagatgtgatgctcaaaggaaatgctcattgagcattgcagattttagatttttggattagggatgctcaacaggtaagaataatgtacacattccaaaattaccaccaccccccaaaaaaaatcccaaatctgaaatacttctagccctaagcattttgggtaagggatactcaacctgtatatggtactctgggatagatagctgggagaggaaggagaaacaccgtggttctcccatgtaaggtaaagaatggtgtaattcacagttcaagtgaagtgggaagtaggtggtgggtgggcagctatttgtcatttattcactcacgtaaccggtatttactgagttcctatctggttccaggccttgttccaagggtaaaacatacaattcttgcctccatgaagccgacattccactaggggaattggggataaagaagccaatggtatgtgtaggatacattaagtgtttataacacagcatagttaccctttctggatataaataagtgcagagtgtaacgtgtcatatataatataatacacaggatatttttttcaaatcccagacttagatgtcaggaaattgcaggggaacaggactcttctgattgacttctgctacacttccctttcctctctcagttatagttcatctcctcctgccaccttcctttcacgctatagccagagcttttatcttgtgtattaaaacaaaggaaactttttctttcactcaactcgttgttttatggtccatttgatcatatccatttgtttagcaaaaaatcataattcttttgcctttttatttctgcccttttttattgtggaattttaattcacatgaaaaatactcatcatcaagcctgggcaacatagcaagactctgtctctacaaagaaaaattttttttaattagctggacatggtagctcatgtctatagtcccagctactcaggggactgagacggaaggatcgcttgagcccaggagttcaaggctgcagtgagctatggttgcaccactgtactccagcctgcgtgacagaaccagaccctgtctcttaaaacaaaaaatctgaccaggcacagtggttcacgcctgtaatcccagcactttgggaggccaaggcaggtggatcacctgaggtcaggagttcgagaccagcctggccaacatggtggaaccccgtctctactaaaaatacaaaaattagctgggtgtggtggcaggcacctgtcatcccagctactcatgaggctgtggcaggagaatcacttgtacccaggaggcagaggttgtagtgagccgagattgcgccattgcactccagcctgggcaacaagagtgaaactacatctcaaaagaaaaaaaaaaatccttatcattgcattcataagctgatttgagattcggtctcttcatcatcagtagaatgtgtgtgggagaaaattagggaaacttaatggtaatcagattcctaggggtcaccacgtctgtccccatggcccatggggaaaaacctcctgatctctgactttgtgtcacctcttttccatgcctccttccttgctgcacttggccaggaacaactgcgctctcccagtcgtgtgcccaggctgagcaagggcttgtgtgactgccgtggagtccggcacaccccccatctctaggctccctgtgcactctatcctgttcacatgatacagcggccatgttcatctagcagggaccccaaggagcccagccacacagagggagcaccagcagcttataggacctggcacttttccctctggtgttggccaggcttggttagtcatggctaattaggcctccaaaccatggccaaaatcactccctgaagtattgtcttttagaaagcatcctcattcattccttcgtttgacagatatttattaagtgtctacctgtgtgccatccactgttctaggtactggggccttgtcagtgaagaacagcaaaagatccccacttacttagaggcaataactaatagataactaagatgttagaaagtgtgataaaggctgggcatggtagctcacacctgtgatcccaagcactttgggaggctgaggcgggtggatcacttgaggtcaggagttcgaggccagcttggccaacatggtgaaaccctgtctctactaaaaatacaaaaattagctggttgtggccgtgcacacctgtaattccagctactcaggaagctgatgcacgtgaattgcttgaacatgggaactggaagttgcagtgagccaaggtcacaccactgcactccaccctggtgacagagcaagactgcctcaaaaagaaaaaaaagcgtgataaactctgtgaaaaaaaaaaaaaaagaaaaggtagagcacaatatgggggacctgaagggtagagaaagaagtggaaagctgctttgatgctaactggggtggtcagaatcggcttttctgcttctgtaagtgaaagaaatactgaaattttctgagtgaagaaatgaagccatatgaagtgcctgtcatgttcaaactggtcttctactggcgaagtgataaaagcccatcaataaataggtaagggagcatgagatggcagccgaggactttcttgcagctgtcaacatgaattctattgtccagacaagaatagaaaatcagataaagtacaacgccaagagttgtaaacacttgatgtaaactatggactttggatgataatgatgtaagagttcatcagtcataacaactgtatgtaccagtctggtgcaggagactggcagtggtagatgctgggggctggtgtgaggaagacaggatataaatgaaaactctctgtgtaatcttattgggaacctaaaactgctcttaaagtctttttgaaaactcagacatatttttggcattaccttttttttattggaaaggaaaaatgaaaacctttcattttattaataattctatattccactcctgtattttcttctcttggatgatgatggtgatattatttctcacttttcaaaataataccctggactgagtatgggatcagcagcttctcctcctagttttcaaaaatgattctactatttgattgaaaaattgagcactgcaagactggaagagggcttcttgtcacatctagcctgaactctgactcccacagtatacccaaagtattcaggaatcaagtcctattgctaaacatctatagagactctaaccccataaccttcttaggtatttactataaatcactccttgcttacacattcatctgaaatggaaaccggtaaaaattgccaatgcgttgacgtgtactgaaagtagtgatatcacaaccgagagaaggtggattcaaactctcaggctaattttgtattcattgggaaccagaaaacacaagaaagacaacattgccaaatcaaaaaagtaacaaattgggagcagacgtggggtttgttttcacacttctaggtacattttctatgaacgggggagaatgaaagcataaagccgtggacagtgccccaaggcagttggtggttttgtggcatggatatagaactttatatctgtcaccaaatagaaaatgcttttgaaaatgactcagccaagtgggatgctgaagaactctgatgcagtaatgtgttacatgtggtgtgcttagcccaagattttcaggtttttaagagttttcgggtctgaaactgaaaactgtactaagagatgatgattttagtatttcttagtagagagaattttaacaacagaatccactctcttccatgtgtaaaaagaaaaaggatcatacaacattctaggtaaagaaagaaagtggcttccagctataaaagctactgttcacactcactcttcctgtgaatgtacttctgcagaagtgagtgaaaatgaatgtttaaatcattagggagaaagctgaggaaatttttctggaatgagttgcttttggacttgaaatgcagattttccatgcattgcttgattgtcttccatatatcaacatttgtataaagaaattcataatagtagcaaaaaatttgagatctcttcctaagcctttttttttttttatcactgctgaccttttcaaaccccagagctatggaaatcatctgttcatagaaggagaagtaaacacttgccttgcagccaaaaaataggcagaagactgccagaaagtgaagtctgtgactaggctagctgaccttgcataccgtatgctgacatccactcatgctctggtgctgggcgtcctacatctgactcctttgatgtcaacaacccgagtcctttttagatcatggaaggttattgtaagcagtgtttttgtacttgagacctaaactgtaatgcttcatacacatattccagaaacagttactttttagacatgtgatagaatattaagcaactatcttggtctcccactatgagtggactggagatacattatatatctgattgcatgattttattaaaacagtagcaagaataatgtataatagcattcactgagttcttattacaagccaggcactatgctaagtgcattgcacctgtcttctcatttaatcttcacaataaatctgtaagtaggttaagtattaattggtttaattttggctgcaacaaacagcttagaatgagggcatttattatacgaatgagaagtatagtacaagattgttacctcttgcctcctgtaggtccgtatttaaatgctgtttccttagtgaaccggtttctgaccgttctttctcagattcactcaccgtgtaatgaatgaattaattcacttcctgttcttttttccttttgctttttttatttctttaccaccttattctacttctttaccttgtttattgttctttgtcacactccattgctagactttaaggccagtgagatcgggattgttttctgtattttttacagctctgtatgccattgggaatacagatgctactcaatttatgatagggttatgtcctcataaatggaaagtcaaaaatgcatcaaatacacctaacctaccgaacattatagcttagcctagcctgcttctagcacattctaaacgtgctcagaacacttacactagcctatagttaggcaaaaccatctagtacaaaaaaaacccgattttataataaagtgttgaatatctcatgtaatttattgtactgaaagtgaacagaatggttatatgggaactcgaagtacagtttctactgaatgcatattgctcctgtaccttcataaagtaaaaaaatcgactaggcgcggtagctcacacctgtaatcccagcactttgggaggccgaaacaggcagatcacctgaagtcaggagttcgagaccagcatggccaacatgatgaaaccccatctctactaaaaatgcaaaaaattacccagatgtggtggcacacacctatagtccagctacttgcgaggctgaggaaggagaatcgcatgagcctgggaggcgagtgagctgagatcacaccattgcatttcagcctgggtgacagagcaagactccgtctcaaaacaaacaaacaaacaaaaaatcataagtggaactatcctaatttggagaccatctgtaattagttggggcacaatacgcatttggcaaatgaatcaagggaggaagggacagtctgtagctcatcctggagtactaggaaacattcttaataagattactccaaactgaatgtgatgtacacttctgtgaagccttccctattttttgaagacttaattctctaatgcacaccctgcataactactgggtgtagtagtggctaagaagttatgctggtgagtttggctacatgggcttgaactcttgttccagcacttctaagctgtgtgaacttggtgagtgcttcagttccctctctgtatagtaagaataataatagcacctacatggagttgatgtgtgttggcaagtatccgccgagaatggagtagcccatagaacatactcaatgaatgtgagctattgttactattttagcatttcttatactggtaccttagttacagcagtccttccttatctgcagttttacttcatgtggttttagttaccatggtcaaccacagcctacaaatattatagtattttgagagagactacaatcacataacttttgttacagtatattgttataattgttataacaattgttataattgttataattttaattataatataatcacagtatattattactattaattcttactgtgcctaatttataaattaaactttatcataggtatgtatgtatgtatgtatgtatgtatatatatggaaaaaaacacagtatatatatatggttcagtactatttgtggttccaggcacccacgggggattttggaacacatcctccaccaatgaaaaggaatgattgcattgtcattggtttccttattatgtgagcatctaaaaggagggaaacatttaacaactattttatttttatattgtcaatgcttacaacatatataacatgcagattaaatacatacttgtgaatgaaattgtatggtatttccaagttcatgtcctgatattgatgaattactgtattctatcttttttttttttttttttttgagacggagtctccttctgtcacccaggctggagtgcagtagcgtgatctcggctcactgcaacctccgcttcctgggttcaagtgattctcctgcctcaccctcctgagtagctgggactacaggcatgtgccaccacacccgactaattttgtttgtttgtttttagtagagacagggtttcactctgttagccgggatggtctctatcttctgaccttgtaatccacccacctcggcctcccaaagtgctgagattacaggcgtgagccaccgcacctggcctctatttttaaaccccatatttattttaaatcatatagaatatagtgtagtaattcatttatatataatttgctttaattcttcaccctttgttttccctgagagtttcatatgactcttttccattcacccacaaagtagttccagctttaagtcattccctgtatcaagggctagtaagctgacagccagcactgatgcttgtttgcatttgagcattggagctcttatttctagaggtacactgtctattttctgtggttttataactgatctttcttggcctcctatttgaatatagaaagagaaaaattagaaaatatagaaaaaagtgagaattttttggctgattttatgttgcctctgaggcctaagtgtcaaaaagatgaatctggggtttgatatgtttggcctgtctgtagggctttctcccagtcctcactggcagcaccttttagtgtaagaaaagctgtatgaaaagagaaagcgtacagcatggatctaaatttagaagacatttatttttcttaatcccagatataaatacgtaaaactattacattaattccgagactatccagtggttatatataattatgtaaagacaaagtaatagagccttttaaaaacttagaacagtgtaaaacaaaatgtatatttcacatttatcttttgtgagtaattggaagaaatttacaaatgaagttaagattttcccttaatacctaaagaactgtttctgaacatcgtggaatttatttataatggagctaaaacactccacttttttgacattgttccttatttcatagtaaactgtaattctttacctacaggtgtagaaaggtggattttgggggctttcttctttttttcctttaaaaattttagaagtatttcttttctataacaaattcaaaccttcctcatacactttttctgttttataacactgtcagcccatggtagaaagaaataggaagaaaatgtctttaaatttagaaatatactttggttctctttttctgtaaagaatcacagatgacttatagtgtttatagtttttgcttttgttaaaaaaaaaaacagtgttttgtgtttcattaaatatatactacttttcagtctaattcagaatattgctttaaaatgtcccagatactcagttttgaattttcatgtataatatcaaggttttattataattgaacaaacatctggcacacacaatggctttctcacgcagcacctctcaactccaccccgtttctccattcatggagtggggaagatacatgcccagcacaaactgcgtgtttgcaaagctgttaatgacataaatgtcctttccagatacaaaacctgagctttgtgagctccctcaatgaggaaaactgtttgaaacaaaccactttccccattttcctggtcattcactgaatgagcttgttgatacagttcgaaatgtaaatgctggcatacttttattggattaaaaaaaaaacaatctaaactgacttcagtcatgaggatattcattcttgaccttatttgggatgataaagagagaatcttctatacatttaccctgcttttttgtcttcaaagcctactgaaaatgagaatgagggatataatttatttatttatttatttatttatttattttttggaggccgaatctcgctctgttactcaggctggagtgcagtggtgcaatctcaggtcattgccgcctccgcctcctgggttcaagcgattctcctgcctcagcctccccagtagctgggattacaggcacgtgccaccacacctggctaacttttgtattttcttagtagggaagggtttctttcaccatgttggccaggctggtctcaaactcctaaccacgtcagtctcccaaagtgctaggattacagacatgagccattgcacctggctgatataatttaaatactttaataattcttaggactcttggctgttcaaaaaaatcaagatgtttaaaaatgcattttagattttactcctctgtaaaaaaccatttgctgtttatttttaaacgtttgaaaggacatgtggagtggggaaaggaaccaggccttggagcccactctcagtggttcagatagactctgggaagggggtgagtccagtgaggaccctggagacctggactgatccagacccagtgtctccttatgaatgctttacagtaaactatgacctatcttttgaacatgaaataggtcttacttccgtcttctatcattttttaaaacattcataattccaaagcctgatgtcttagaattattactaggattgcattctcttctgaatatataacaatgctgttatacttctaagaaaacgattttttttaatgacataataattctccatcaccttctacaagactaaagaacaatagaatactgaagacagaggattcaaataactcccatgacatagagtgggtcatgtacaaatggagttgagtttttaaggaaagatatagtaaattacatatgtttcttatttttgcttatattcctattttaaaaaaagtagcttgacttcattttgcagttggagaaaaataagttatagggtattagaatgtcttccaataagcagataggaagtggtggtcaagatgactactcagagtgccttaatatttcagtctaatatatatgccacaatacctgtaacccatgggaaatagaaaagcaaagttagcttttgaaatggtaagagagtctctaaccaggaaatgcagcagtgtggattatctctttttttttcagtaaacattcaagttggtgtttaaaatgcatgtagagggccgggtgcagtgactcacgcctgtaatcccagcactttgggaggctgaggtgggtggatccgaggtcagcagttcgagaccaccctgaccaacatggtaaaacccatctctactaaaaatacaaaaattagccaggcatgatggcacacgcctgtaatctcagctacttgggaggctgaggcaggagaattgcttgaaaccggaaggtgaaggttgcagtgagccgagatcacgccactgcactctagcttggacaacaagagtgagactctgtctcaataaataaataaataaataaataaataaataaaataaaaataaaatgcatgtagaaaagtgcctaaatcataaggccaccacttgacaagcatttatagtgagcatacctggtaaccagccccctgaacctccctcaaacttcctcgtgattattccccaccctcatatccaatactcatacatagcacttaccactatcctgacttcattattgtagattcgttctgcctggtgtattagtctgttctctgctagaacactgctaggaagaaatacccaagactgagtaatttataaaggaaagaggtttaattaattcacagttcattgctggggaggcctcaggaaacttacagtcatggtggaaggcaaaggaagagcaggtaccttcttcacagggcggcaggatggagtgagcgcaagcagggaaaatgccagacacttaaaaaatcatcaggtctcatgagacttactcactatcatgagaacagcattggagaaaccgctcccatgatccacttgcctccacctagttctgcccttgacacatggggattatggggattacaattcaaggtaagattttgggtggggacacagccaaaccatatcacctgcttttgaacattagctacatgtaatcataatatgtactcctttgtgtctggcttcttttattcaacattgcatttgtaagcttcgtctgtcttgtcatgtgtagtagtccatttattttcattgctatatagtatttcattgtatactacattatgtatccattctactgttgatggtcatttggcatgcttcctatgtgaggctgttgtgaataaacttcctgtgaatattcttgaacatgacttttcatgggcataatcactaatttctgttggatatcactaagaagtataatttctgggtcataaaatgtatgtatgtttcactcacatatatatagccagtttttcagagtaccagtttacactgctaccagcaaagggttaagagtctcagatccacattatcatcaataattggtattgtcattcctcttaaggtttagccatactgagtaaaggtatctcattatggtctcaatttgtgtttcccttgtgaagatatatctttaacaacttatcatacctttattggccctttggatattgtttctgttatctaattctgcataagaaacttcttccaaatgaagtgctcaaaacaactattttaatggcaacttcaggtgaactcaagttgttaattttaatgaagtccagtgttttaattgttttatttcagatcagtattttttatgtccagaatctttgcaaaccctaaagtcattaaggtactgttatgttgtcttctgatagctttattgtttcacattttaaatttggatttgtaaggcccctgaagtttttttgcatatggtgagaaataggggtcaagatttcttcatttcctaaatggacatcaaattaggtcatcactgtttattgaaaagagtgcctttttcccactaatatgaattttttttattaaccatagagtcagatatatatgaatatatttctgcattattcatattatttaataggtttatctgtctttgtaccatttgtacattgtcctagttacagtagctttataataaattttaatgttttctgctgtcagttctaacttcttcaattctgttcttgagattgtcacagctattcttggccctttgcatttctatataaattttataatcaggtgatcaatttttacaaaactctgctgggattttgattggaattgagttgaatcaatagatcaatttggggaggtttggcattttacagtatttagtcatctaatctgtgaatacaacacacccctttattagggtttccttcatttgtcttagtgttttgttggagatttttgtataaagtctttcacagcttatttaagacttattcctaggtcttcaagatttgcatgtggttgtgaatggtattaaaatttttttacccttataattgtttgttaccagtatatagagctaaatttgatttttgtacattgaacttgtatccatgaccttgctaaatctgcttgttaattctagcagtttatatgcagatttctttgcatctcccacatatacaattatgttgtataagtaatgctagttttattccttctcttctggtaagcatacttttatttccttttcatgtcttactgtactgtctaggacctctactgcaatgttgactagaagtggtgacagcttgcttgtctctttcctgatatcagcagcaaagacatttaatatgatgcttgccataggttttttttttcttaatagatattctttatcagataaagaagttcccttatatatctagtttgctaatgttctttatcatgcttggttttgaattttaacagatggtttttctgcatctgttgaaataattacattattttcttctttattctgttaatgtggtgaattacattgactggattttaaaacaagataaaaatttgttttccttatagcagtctaagcttcagtaatctagggctgataatacaggtctataatacagggacccagacaatatctttttttttttgctttgttcttccggactcaggttttctctatcatggtctcaaaaaaaaaaaaaaaaatccttgaagaattcaccggtaaagtcatttgtgcctggaatgtttgtttttgtttccttttgtttttgtgcctatgcattataaacatttttaaattgcagttaagatttcattaatagataaaataatattcaggcttttgacttttcatgtcagtttcagtaagttttgttttccaaggaatttatccatttgggtaaaatttcgtttttatttgcacaaaattatttataatatcctcttctctgtatatatgtagtgatcttttttaaaatttcagtaatttgtgcttatgtttcgctcttgatcagttttcctagggttattagtcatttcaaagaaacaacttatgtggatttgtttcctttgttttctattttattaatttttgcttttatatttattattttttctatattttttatatttacactttggggtttaaattgtctttatttctaactacttgaagtagatctttaaatcattagattatcaatcttctaatatttgtatttataggtatatatttctttctaagaatggctttatctgctatccataagttttgatatgttgtattttgttatttacataaaatatttctaaagttcattgtcatttttttcctttgaccaatgaattatttagaagtatttcacttaatatccagatgtttgggtattttctggttaactttttgttactggtttctaccttaaaaccactatggccagagaatatactctaaatgacttcaatccttgaaatttgttatggcacagaatattatcaattttagtaaatagtccttgtctgcttgaaaacaatttatattatgcggctggacctatatgtcaattagggccagtttgtaagttgtgttgttaaaatcatctatatccctaccgattttttgtctgcttactatataaatgactgaggagtatgtaagaaaactacatgtatgtaagaaaactcggctagattaaaaagcattttaaagggttttatgtgtatttttttgttttgagagttttgggttttatttgcttgtttgtaattgcaattgttgagaattgcagtgacctcctaacttaaatatgtgtatactattaattaataattatcagtagcattttatcttacataatataatttcaagcaaaacacttcatcttaaaacaagattttattttcattcagaaaaaataaaacgttgcaagttttcaatattttaaaaatatttatgaataggtattttatttttgtttgtacagttgtatttcactcaaatgtttattcctgttagggtggaatatatatttatacacaagcaaaataattaaaatacttatttaagtatcctcaaatagtagattgcaagtatgtgatttttctgattttaagagtaacataagccaggtgtggtggtgggtacctgtagttacagctacttgggaggctgaggtgggaggatcatttgagcttaggagtttgaggccaggccagcctggttgatgtagtgagacaccatctccaaaaaaaaaaaaaaaaaaaaaaaaaagagagagagagacagagacactctcattatagaaaatttagaaaattctgagaaatataaagaaaaaaatcatttatcaaccagtgttaattaatgttaatatttgacatatttcttaatagtttttagcatttaaaaatgaaattatatactttatttatttaattttttttttttatatggagtcttgctctgtcgcccaggctggagtgcagtggtgctatctgggctcactgcaagctccacctcccgggttcacgccattctcctgcctcagcctcccaagtagctgggactacaggcgcccaccaccatgcccagctaacgttttttgtataggattaatgagagggaggaggagggaagactgttttgactgaaggatctctctaaagaaacagcatttgagctgagctcagggcaaagcctctgagacagagaacttggtgcactcaagggagtggaaaaggccatgcctggttctgagagaggaggtgtagtctacagcaatcccaccgtaaatacacctctcatctgatcttgaaagctgagcagggtcgggcctcattagtacttggatgggagagagaggctcagcaagggtagagctagggaggcaggtacagaatttgcaacttcccacaggaaatgtaaagagtttgggtgttattctaagtgtaactgaaatagactgatagattcggagcaggacaatgatatactatatttcatctttctaaaaagatgcacattttttcacctttaatactggggcacttcctacagttgaagtgatttttaaaaagcagtgcaaaataggttaatttgtagagtttttttttttctttcttagtggttcagaaaataattttgttctttttaatgagtggagtcttctatttgatttaattcagtaatttatattttttaagtacagtgtttctgttttccaggttgctttttggcaatggggttagaggagcaggagaaaactcaggatatcttctaggatattgttataatagctcaggccacacatattggtagctcaggctagagcagtggcaacatgatggagagaaatgaatgactccaaaaatgctctggagatagagcctagtgctagattagaacatagagttgaacccgatgtaggacatggaggagaactgttgaagaggggtcataggtcctggctttagcaagttggtatttggtgacactatttgctgacatggtaaaaaaacgaagcaatttttttgtaaagatcaagagtgtgagttggttatattaaattagagttgcctgtgaaatatccatgtgggtgtgtcccatagggaattggatcaagttaattctaatgttcagaagagaagtctagtctggagataaaaactggaagtcatcagatctagaccgcatgtgaagccatcagaatggatgagaccaccaagagagatcatagaatgagaaaaaaagaaggtctaggactaagctctgagaaatgccaacatataggggtcaagtaaaagagaccctgtaggaggagtccagggagtaagaggaaacagaggatatggtactgtagaatccaagggaaaagagttcttcaaggagagagtggtcaaccgcattgaatacaactgagagctctactaagaggacaagaagaatcctttgggttttacaaaatggtgaccttatcaggtgctgtttcagtggaatcttgaattcaggagccactcaagaatgaatgagaactgatggagtaaacacagcatgcgtagataagtcaagaaccttggctgttaaaaaggagtaagaaatatggaatgatccaatagagagggaaagaaggtgatgcaggggcagaggccacatggacaagcgcagacagcacgtggcaaaggcctctatgccattacccatggaagaaaactgaagaggtttaagcagagaactatttgattggactgtttcattaggtaaattattctgtcattgtgggagatgaatttggggtctttaatgagtgtctgaaagcacaaaactcagtttggaagccattgcaggaattcgagtgaaagataatgtgtccttgaataaggctggagaggaaaggagagactggagatacaaccaaaagataaaatcagaagaatgtggtgactggatgtggagcagtaatcaaggatgactcccacatttttgggtaactaggatgatatatgtgatttttaggatggtttccaacaggatatctttaactgtagatggtgaatacctgttgtctacatagtggttgacaaaaatggagcagtgttgttttagtttctctggaatataggattgaggcttgtctgggtaatttttacagaataatttaagtaggctgggcatggtggctcatatctgtaatcccagcactggttggccgaggtgggaggatcacttgagccgaggagtttgagatcagcctgggcaacataatgagacctcatctctactaaaaattaaaaaaaaaaaaaaaaaatgccaggcatggcagcatacacctgtggtcccagctatttgagaggctgaggtaggaggattgcttgagcctaggaagttgaggctgcagtgagctgtggctcactgtgagagccatggcactctctctcacagtgagagcatggcactgctctctagtgtgggcaacagagtgagaccctgtctctaaaataaataagtaagtaagtaaattttttgaaagtagtacatctccatgctggggaaaaaaaaaaaaaaaagatgtctcattggccagccttcttttctagaaggtaattatgggaaagttgaatttcaaataatttgttacctatgtcatttcttattgcttatcttaggctgctagctttcaaaacagacttgtgaccatcaaggtccccgtgtttttttcctgcccttctctgtcaagggatagcatggtagtcagactcggcccagggatgtcgtctgctgtttctggcctattcccatctcctagaacaaagttattttccataacacatatgggctatattccccagccttgtcgatgttgccagacctcagtggaccttttttaaaaggatctttccatatcctattgtattgcctggaccatctcccaatccagtttttaatttcctattggctaaattttattttctttctttaggccttgtgctcatcttccgcttaatgctggcttccctcctgtgctgtgagagagaccttaatcgcttgtgggccagcagccatgccattttaaaattcttttgggcagctattcagctggtttaacatctttcactcccacttgttggctgagatttactctctcctagccggcttccattcctttcagaaaggagtgtgagggctgcatttccattgtaagccccttttctttggatctgttttcctaagattctggcaccaaatacttaaccaatctcagttggttaagaagttctgagctaaaatagtgggccattttcttcttatgaagagttccaggagcaccgatgctagacatggtcctgtctaagtcctgggacctcctgagacttgcaaccatgggtgcctgatgtgctttcttccaagggtctcctacaaaaatatcctcttcatggcccacagtagctctagtgtctagatttcaagtatgatgatatttcttgtattaaaggacagagatgcctaagtcttatttaaggacaagaagacttgataaaactggaagccagtaggtgatgagtcaaagagtaacagatggtgtgttctgacctccatcttcatagtgggcaaactccagtgtgctttttgggctcacagtttggttagttctcttcatcatctaggactaaccttttttaactatcatcatggtgacaggtaagagaatgtgatggctagaaccacagacagattcagaggattcttctgtgaccaggccctgttcctctgccagctctcccgctaactgactatgtaaccttgaggcaagtcacttcccctttctagccctcagttttccggttattaaaatgaagagattgaactggataatcttcaggtttccgttaagtcaaaatggaccatatgattcatctaaaaatgttctaagacaggaagcccgtttcttcacaactctcagtagctttggagattttcctatgaattatccattaccaaaaaatgacacccccattcccactatccacttctctggagcgtcctggcagcagacggaaagctcattagtgagctgcttcccctaatagatgagtacgttttgctcagaataaggaagaaggaagtcaacaaaataagagaaggagatgttaagaaactaagaagaagcactttcctaaaaatgtaaaaccaaaaactgaagaatatatctgaaaaaagagcaccaaatcattttactaatgaaatagacacaaatacccctttctttccaatatacatcattttcagaatatgtacagatacacatagacttttctgcatgtaatacaagacacctaatggaaccattgagatttgttgtgaatttttgtgttgagttcttaaaattaaaacgattttaattttttggttcttaaacaagatttacatgaccccaacctcttttagaaaaccctgccttctttccatacttgttatttatttcatagttcactttacataaatgagaaggtgacacaggtgtctggccttacacctttatttgagaattcgggagtgcatgggttcgagttctactctagtatgtagactccctgaatgcagtcagtaggtttttaaaaacttttggttcattgagaaaatgtcttaagtaaaaagcatctgggcaaggaaaatggatctgccaagtagatcaataaagaccctcaaaagcgtggatctattagtcattgacaacattgctactttttaaatgagccactggtagttcccgtcacccagaactatgttctatttttctttctgacatttatgtaattttttattgggaaattcacatcagggatcgattctccttggtttgcataattctttcttgactttatttccattgaaatatcaatatttatatctgccttcttcagtaaagtgtaaatagcaacacttgcgtgatgaatcagcaacttttataataccacacctgatttttctggattgacaattgacagttgatcactagacaaatcacgcctgtaatcactaacccattggatagtattaccaatgatatcatgcatggcccttacagatcactaagcaaaattgcttggtagttttaacagaatcacccttcattaagtgaaaacatatgatatttggatgattcaaaatatagtttcatcttccaaattcaactttagcaaaaaaggatgactttcacttgttcgtttagtcttgctgggacttctactctaatgtaataaattttcttaacatttagctttatttctctagaattactcgtatttgtagcagttcttttcattgtatgtatatacgggactaacaatggaaaaatatctcagagagctcacatcatcaaagaaaattctaatgaaataatgttttttcttgtagaggtcattaaagtgaaacaaatgtcctcttattaagctattacctcacctcattgttgaaaacatgaaactgctgagaattacattatatcatttttataaaatattagttgctgaagagctagtttccagcaggcattccacgttattttttcctattcattcaaatccaaaatattgctcatctaaactttctcggttaatcactgttacagtaagtctgagactgcaagacgcccagtaattcataaccagcttggggcttgttcaccttcaggtcaattatttggttcctgtgcacagtaacgagaaatcatcatctgctataattgcatagaattaataaaaaggaaagcaaggatgttccttcaggaatctggactgaaaagccaccaggtttctagtacataccttctctttctcctccttagctgtccttccactcattttagtagggaaataagttgctgatgaggttaagttaaaggttcctcaccctgagaaggagccctcgataagcacagcagtggcacaaaatgctctgggactggagaggagaggccctgagatctgcttgtggagtagttaaaggaggtgctgcagaggaggtgtctcttgggctgactcctgaagggccaagaggcatttctaagtaagtccaggggaaaggggtggcatggagattccagagacggaaggagtggcatggagattccagagacggaaggagtatgcaccaagtccatgaaaaattaaagaccgtaggttttcaaagacctctagtatgctaattgagccagagtgcaaattgggaaggaggttgtctggaaactgtggccagacatataggcaggaggcagatgaggaagggtgctccatgccctactaaggagtgtggttaccctttagccaagaggagattctgaacactctgagcaagggaatggtactggtgagtttgcattttgcagagagcacattggcagttttaggtggagaatggatagagggagggaggcaagactggagatgggaagatgacccaccaagagtatgagtatcaggaaagatagtaaagacggcatgacagggaaggacagagaataggagaaagtgaagggtgatattaagatttctggcttgggtgacagattggatttgctgatgaaggaaataggagaaatggagttgagatgaggaggggagtgataataaattcgtttattatgaatatatccaataggtattagataagtggttctaaaggacagaggtaaatttttgagagagactgggaaatcatcagtatgtaaatggtaattgaagtatttccgagtttctttccagcccttaaatcctgtggttcaatgaataacataaataatctctttgatgtacgcccatctcagaaagcctacctttagcagtggcctgtgttaagtgatttggtgacgcgatgcagttcctcctcaagttgtgatcagtaaatagtgatctcagcctcatgctgacattgaaaatcaatcagaacagatttattgagtgtcttttttgtgtttactgttgtaagggagattcattttttagactggaaataatttcattgatttgtcctttttttttttgagacggagtttcgctcttgttgcccagtctggagtgcaatggtgtgatctcggcccactgcaacctctgtctcccaggttcaagcaattctcctgcctcagcctcccaagtaactgggattacagtcatgcaccaccacacccggctaattttgtatttttagtagagacggggtttctccaagttggtcaggctggtcttgaactcccgacctcaggtgatctgcctgtctcggcctcccaaagtgctgggattacaggcatgagccaccgcgccgggcttcattgattttttaattcaagtcaccaaggtcaggaaatggagtttagtaggaagacagtgaatacagttttaggcttgataagtttaagttcatggcagaagatccaatggaaatgattaagaaatgtgcttgcaccccatctctactaaaaatacaaaaaaattagccaggcgtggtggcgagcgcctgtagtcccagctactcaggagactgaggcaggagaatgacgtgaacccaataggtggagtttgcagtgagcagagatcgcgcccctgcactccagcctgggcgacagagcgagactctgtctcaaaaaaaaaaaaaaaaaaaaaaagtgctccgtagaagaatcttggctggagaggaggatgggggatttatcccaaggagcatggtcactgaaactgggagagtgtgggaagggtggaggagaggagtgctgagcacacagcagatttcaggcagggcgggagccttggcagacacccactttcaggctgccaaagggcaaggacaagctcaaggcagaacaagaagaatattccgtcactgaacgtgggaagagagtgttcaaggagtgggcattcagccagactcggaggtcaggggtgactgaccggaagatgatcatgagatttagtgatgagctggtcactggtgctttttctcataggagtctcagtggcataaagagttaggaagtaagattctaggtcattgaggaggaggaggaggaggaagaggaatagtagtaataataataaagttgacatgtactatattggatgtctccctacgatacatgccaggcagtcttcaaagcactttgtacgtgttattttgtttaatgctcacagtaattgtaggaacttaccaatgttattaatattattcatattgatactattatttccatttacagatagactgtaataggaaataaagacaatgagtatagacaatcctttgtgacattttgcagtgatacaaaaagtttaattccccccaaactaaattctgtcaagtgaaattgaacttgtcattttctttagcatttgttgtctgatttcattatttgaacataaaagtacaatcttcacatatatttggatgctgttacattttcttaattgtttctccaaatcttacattttggcgtgactgttaagtccagggcagagagagcagagtaccaggcgtggctggtgtgagatgtggcagtgcccaaggagaagaaaagcacaatgggcgatgatatgatcaggtgaaaactattttcaagcaattttaacatttttgaaggcagtgagggtaggatccaggggaggaataactgaagatgttggagaaggatgagcaggtgggaccttgaggcagagactggtcagggcgggagaaggagccccacccagaaaggagaagggatgtaggttttttgtttgtttgttttgagttgagaaaataagtttaaaagagaaaatgcggccaggtgcggtggctcaagcctgtaatcccagcactttggaaggccgaggcgggcagatcacgaggtcaggagattgagaccatcctggctaacatggtgaaacaccgtctctactaaaaatacaaaaaattagccaggcgtggtggcgagtgcctgtagtcccagctactcaggaggctgaggcaggagaatggcttgaacctgggaggtggagcttgcagtgagccgagattgcgccactgcactccagcctgggcgacagagtgagactccgtctcactcaaaaaaaaaaaaaaaatatatatatatatatgtatatttatatataaaaataataaaagagaaaatgctcaattttattaatagtaactctccccaaactaaactctgtcaagtgaacttgaacttgtcattttctttaacagttgttacctgatttcattatttgaacataaaagtgcaatcttcttcacatatatttggatgctgtcattaacattttcttaattgtttctccaaaaacttgcatgtggcatgactgttaaatccaggggcagagagagcagagtaccaggtgatgggtggtatagatgtggcagtgcccaaggagaacgggaaggaaagaacggagaaggaaattagtaaccgtaagaataaagaagaattctatctaaaagtctgttgtaactttgcaattgaggcatcacttttataagaacatttttattaatgagaaaaaaaggcagaagatcactctcatcacgtttatggagaacaaaatgaattggcaagtcagccaatcagctggagcagcctggacggttaggaccttgaatggctgtaaattggtggcatcaaatcttttcttttggcactgggactgactggctaccctgctgacttcatcagactctctcttgacttcctgaggatgttgtgtagtctggatcaaggttatccacaaggttaagtaaactattgctcatttccacctgtaactatcagatgcaaatactattagcatttactgcaactaaaacaagtgacaatattttcacatgttttctctgtaggaatataaggtcccttggaaataaagagtcgagaacgtttaggtaatactgggcgtggcacttgcagccatcatttcagtctaaaaacatttcctaaggaaaagtactaaatgtttttttcatagaacccaacattttggctgttaaaccattttcatcaaaacattttatttatatgtaaaatattttaaaagctgttttctgtgtaaacatgttcatctcatcatcacacactaatcaggatgtgttgagtgcctctgtttatccattaatatctggtgtttgtcagcctgtgtttgttttgtgtctgatgttccatgtcttttttgcagatattgatgaatgtgtaaacaacactgtttgtgacagtcacgggttttgtgacaatacagctggctccttccgctgcctctgttatcagggctttcaagccccacaggatgggcaagggtgtgtgggtgagtttttagattttttcccaacgtgtttcacatgtccctagggaaaagaaatcacagtgaacaacaggagcttttaagcaggtaatttgggtagagctttatcgtaatttgattttgtcatacaatttgaggatgtgcaaaaatatcctatgttggctgggtgcatggctcacggttgtaaccccagcactttgggaggccaaggttggagaattgcttgagaccaggagtttgagaccagcctgggtagcatggtgagatcttttctctatgaataaaaattttaaaaaaaaaattagccaggcttgatggtggatgcctgtagtcccaactacttgggaggccgaggtgggaggatctcatgtgcccaggagtttgaggctgcaataagccgtgatcatgccactgcacggcagcttgggcaacagagaaagaccctgtctcaaaaaaaaaaaaaaaaaatcctatggcttctgaaattgttagggacattaagaaatataaaagtatgactttacatttaaatgaattttaacaagaacatctgtttaaactctaactgagtatgcagaactctagactcccttcagcacaggaaatagagtctggtgtgtggtatagattgtctgtctttgaaatgcatccccttagacagtgcgtttaaggcaaagtattgccaggagcttcagtgtccaggaatgatacctgtaaaaggatgctttgaattgtgcaactgtatttcctcagtctgttccgggattgacagggctggaaggaatcttgaatatcatcatatgtcctggaatatggtccaacaaatgctcacacagaaaataatttgtatttcattgtctgaccaagatgtgatttcttcacgtcaaactcattatgaaacatatttgcaattagagcaattaaatgggaaagagaagaaaggttatcaaattcaagactttatagatagcaagacttttctttttctttattcttagagaaaaatagccatgttcactacatggcaggtggaacttgaggagtctattgcctatttggtttgaaaatttgcaattaagacattagttcatttgccatccatattaaacttggaaaacaagatttttaaggtttaatgataatgtcacttaataactgcttttgtggaattatgaaattcagttaattctcaaccaaaaattatttacaaagcaatggtgtggtttcatgcataagcagtagctagtcaaaaacatagataattattcaagaattattcacaacaagacatagttatttaataatatagctaagactatcctaatcttagttcaaactcctgctttggccacctttccaccaaaatacagttgtttgacgtttggataatattttcaccagttgggtcttgtgatgtggcccctacttttcatcttaactttaccacttccttcttcacctgttgtttccagcaacgtcagactggttgtggttgcccatgtcactgtgcaattatttgactgttgttcactccttctgctgggaatatcctcctgacctctccttccctgagccctggatttttctcactcgttcttgaagactgaggttcagtgtcatcttccagacaccatccctgctccattcctcactctcaagctgagctgtgacctctgcttccagagcaccttcagcaaattctattatagcacttacaacctttgggggaataatttaataatgggtataccacctgcagaccgcttctgcaaggctatgacctctatatgattgaaaactttctcacttctccctgggcagggcacgatgcttggcttattataggtgctcagtaaattttgtttaactaccaactgtttaaatatcagatgttgaaccatacctggaaaccatgtcagctatctggagtccacatagctccagagcccctgcttaatgttcatttctaaccagccagatgagcacaccaaacccatgctgacatttcagcttggcacacaaaacaccacccttagagaaggaatatttgttatcattttggtgaactcaacaaatgccattttatttgtgtttgtatttattatttcaaaaatatttactaagcacctatgatacgcacttcacactgggtgttctgtagagctacagggatgagtgagcacctgccccattatcacctactcatccttcagctatttgctccagtatcatttctctaacccacccccacatttaaggtctgctgttccatgctttcactgagctctgaacttttcactcctcacactcactgaagcatgtacaattattttgttcatttccctaactcgtctgtaagctccatgaaggcaggagttgggactgctggctcatcattgttaccccacatataggccgtacaggcctgccccacagaagtaagctaggaaatatttcttgattgaattattgcagtctgatgggatagagtttattagccatgtcaataatacatgttggaaagtacaaagttccactggacatttacctaaaattgatcaatgtgaactggcaatttcttaagtttttctggtctcaatatgactgtcggttgattaaatatttcaactctgctttatgttatggtatttttcacaagtgaaaccagttcattggatttatatctctttatatataaatgaaatggaaaactgaggtaattatccaaataagtcaagatgtataagctttttgtccaattaactgggtataccaggtgaaaggacgatttttttttttctggaatgatttagataattgctcaaatttttaactttgattaagccatctcaaagtatgctcatgaaagctgatgtttatacacgtttaatgcataagacatgtgagcatttcagactttaagtcaggtgctttactgaattggatacccatgaataaaatattgcaggaggaaagagggtaaaaagcactatgggacaacatcaaacataaaattagcctttctttagggctgtgtacttgcaaaatgttgaataaagtgtacttgtcactgagattccttcactgtattttaattatgtatatttaagtacagaagaaaaacatttagcaaaatagaaattacacagtggaacatcaacagaatttgaaaaggtgtcatgagatcagtgattagttattggaccaatttgtttcacatgaatgattaatgtagcctgatgagtatctataggagtctttccttcatttctcaaaggaatatgtaatctgaattctattgataattatggatgctttggctaccagagaactgtattttcagatatttaagtatattttaaaagtttttaagtgaacttaattctgtggttactgaagtgtcagtgattctaactttgcttgaattaagaactgagagtaggccaggcgtggtggctcacgtctgtaatcccagcactttgggaggccgaggcaggcggatcacttgaggtcaggagttcatgaccatcctggccaacatggtgaaatcctgtctctactaaaaatacaaaaattagccatgcatggtggtacgtgcctataatcccagctactcaggaggctgagtcaggagaatcacttgaacccgggagacagaggttgcgagtgagctgagatcacggcactgcactccagcctgggtgacagaatgagacgccgtctcaaaaaaaaaaaagaactgagagtagagtgttgcgtcatttaagacttcattatgttgaaaagtcaggaatgataaaactagatggtcagtgggcacatactagttttgcagtacaattccagagtatcttttaaaactagattgggaattggctgggcgcagtggctcgcgcctgtaatcccagcacttttggaggccgaggtgggcggatcacgaggtcaggagatcgagaccatcctgcctaacacggtggaaccccgttgctacttaaaatacaaaacaaattagcggggcgtggtggcaggcacctgtggtcccagctattcaggaggctgaggcaggagaatggcgtgaacccgggaggcagagcttgcagtgagccgagatcgcgcctctgcactccagcctgggcgacagagcgagactccgtctcaaaaaaaaaaaaaaaaaaaaaaaacctaaattcggaattgtcttgaattttcatagtcctttcgtacagaccaaatctgacagctctaccttaaagagccccttccctaaaagagcagaaggggtttgactgctctctggggatcgccttcttttcagcaagacactattagccctggcacagctggtaaaatagagagctgtcgtgaatgaggcacacatctcacttggtctgtgctcccttttccagatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacaggtaagtcccagtgacactgtgcaagggaatgacaggctcctctcaaagacctgcacccacacagctttgggataaacgctgggagtgagataagaagcagccagatgtcctgacacagtgctgtctctggaagcttccatgatcttctgtgcctgccttgtcagtggaattaagatgtgggtgatgactctttgggctagatggcctctaatgttctatccaaaccagagatgcctccagtaaggtaaaggatccaaaatgatgaggacatttgctggggattgcttaaaacttagagagctatcagctcaggatttaatatggcaccatctcattaagttgcataatcctccatacgttcttggcccttagagaaatgtgtcttgacacttctctaaattaaaagcaacatataggcctcttaggatctacaaagacttccacttggaattcttaaggtgtttttccagaatttggcctagagagtagctatgtttgcattcgcttaaaatttgatttaggctgtgtcgtcactgtgcaaactgaaatagagagttggactgttttccagataaattaatcaacttcccaatcacccttttaagtttgtgccatgtagctatagcttggttgtattttagggaaagcaaaggcccaaatggtcctttgagagccaagtaaaatgaaacatagaccatttttttttctttctcagtcagttttatccatgcttccataatagctttcactactcctctggaggatacacttgttctgtgtaaaatagctatctttgcaagtaataggaaatgaaatatgaaaatattttcacccacacatatttcctcagttattaaatatagaaaggtgaagggtatagaattaaatgaacaggctataattcaaaaaccttgtgaaagagaagagacaggttattactggtgggaggatttctcttcattcaagtgaccaccacaacaatacatattccataaagaagagacttttcattttaattggatctacaatagcaaaaaacaaaccaaaaaacaaaaaaatctggttggccactaacagaattggttaactaagtgtctttttcttatttttgtttggttccatagggtagcacctcacctatagtgttattttgaatgaattaattcatatatcataatatatagccattaaatggtctgggtgatgcttagatagtcatgataaagataaatgtatgtgatacaatgttaagtgaaaaaatacaggatattccaatgatcacactctgtagaggaagggagagtgagaatacataaaaaggtaattgttggaccgaaccaataactaattgagcttattcatttgtatagctcctggcagcttttccttttatcatgcctcaatttgtatagttgatggtgaactttgattatatggagtcttaagactgtcttatgacagtcttcatttttaaaaaattttctagcagtatcctgagagactgagtttagccataaacttcagcagaagccttctgtctgatttcatcagagtcaataattgatcagttatttgaaaaaggtgattaaaaactagaaatcataaaaaggtaacatcttctaaatttaatttttaactcaaaggatataagtacatttggccaggtgcagtggctcacgcctgtaatcccaacactttgggaggccgaggcaggcagatcactgaggccaggagttctagaccagcctggccaacaaggtgaaaccctgtctctactaaaaatagaaaaattagccgggagtggaggcatatgcttgtaatcagtaaggcagaggcatgggaatcgcttgaacacatgaggcaaggttgcagtgagctaagatcacaccactgcactccagcctgagcaacagagccagattctgtctcaaaagaaaaaaaaaaaaagtacattcatacaccaatctttgaagagaaaggctgtggtctttttttgtgtagaggttcatttgtggagtttgtgtggctatcctgcataaaccccatctgttatgtattacttacactttctttgtagaagggagtgagaatctaaagcctttttcaaaacaaatgaatgtaaaatccctctaaatttttacagtttttctcaattttttacacttgtccacacctaatttgacagcatttcttttactgaatcaactttatctaatctttctaaagctttaacttgccctagaaacagctcttctggttacattcatattgtactggttgatgtaatatttaattaaattatgtaagtacagtaatcaatacactgacacagaatgtttgagtgtatacctaggtgagtcttggtttgtgtactgcacagcctgtaggagcagaagtgtgtggacctctgcaagaatagccgtctggctctgagcattctcccttccatgagcatcagcagtgatattttacagagggcaagaaaacatcagttaacacaagttggttaaatgtaggccagttaagagagtttgtaccctgtccagtaaaagaatctgctattccacagaccaaaacattttaaaccaaatttaaataaaagtttttagactaggattcaaattaatttcattatatgcataatatactgaagctgagagctcatccgtcctgaaaagtacttaggaagggaaagataaatttccagtataggctatcacatttttattcagctataaaactcccccaggacaatctatattccaacaatgagcagtagcatgataatctgatgtggtatcatactgaaggcagaactagggttatggggtaggatattaggaaggcaggtttcaggtcagtatccagaagagctttccagtaactaacaagagctagtcagcaaaaagctgccccagaaaatactggagtgcttcccgcggaggcatccaagaacaggtgggatacccactggcagaagagcacccacttccagcagggtattgccccagatgaacctttaaggtactttggaactctaatgtcctagggtttttatttctaaactttcttgcttcccacatatatattttttaggtctgccttaatgttttttactgcctgggcctttggccactaatttacattgctgtgcattgcctaaaagcatctgaaaaagaagtaactaaaaaatgtccataccaggccactcatcacatttaagaaggtatggatatgaaatatagtctgatgctattatttccttagtgcctgtgataattgctcaataaaaactttatgtctttgggcactctaagggaagcagtaaatatttaatcttggcaactgcagccttcagaccttacccacaaaatgctgttcttttccttgattggtgtacagaggaaattctgtggtaggaactgcatcttattcttaaaacagaaggtataatgaaaagaatacaatgaaaaatatatatatattataatccatacaggtattctccactttaagacaagcaaacaaaatcaggaagtataaagcatataggttggggtggttagttatattataaagtaattcttcactttactcaataatttatcataggatttctttaaatatcagttttcgctaatacagttcgctaatacatcttattcccacatcatgagctatatcctagacttctgcatttagaaaccaccttagtgattttccagctcaacttttttatttataggtaaagacactgaggcccagagaaacatctgaaatgtcattcttaaggttatatagctaatgaatggcagaattggtccaggaacccaactcaggatcttctcacttcaccatttctaattttagggctgaggacaacaagacatcaaattcttctcaaaattggcttttctcattttgtttttcattattaagataatacacattaatcatagaaaattggcaaatacaaaggtaaatttttaaaaagtctcctgcagtatcaccatccaatatctgtcaccatgttgacctctggactctgaaaggacatccatattcccctgtctcaacagaaccgttttccatttgaccttcagtgcactgaaatcaggccctctgacttttcatctaagtgagccgtcagtgagcttctatatggtaaactccttagtctcatcccagagtcgtcttctgaaacatttgacagtggtttttcatcttttcccccgtctttgccctgtgattgatttcatgacattactgttccctgcatcctcctgcatcttggactagtcttttcctgtctcattctcaggttcttcttctcctgtccattccttaaataataacatcccaggcagttacatgcttagctgtcaaattatttatgttattcccctgggatatttcatctgctttggagtcaaccattacttatatgacattgcctgctaagtaaatatcttctgcccccacctctgttgtgagtgtcatgctcctatttccagctgcctattggactttttcttccagggtgtcttgtaagcctctctggctgacagttattcaaacctaaattaatcaccatttcctctccttgtgtctatttatttatttatttatttttatttttgagatggagtcttgctctgtcacccaggctggagtgcagtggcgtgatcttggctcactgcaacctctacctcccgagttcaagtgattctcctgcctcagcctcctgggtagctgggattataggagcataccaccacgcccggctaatttttgtatttttagtagagacgggatttcaccatgttggtcaggctgatctcgaactcctgaccttgtgatccacctgcctcggccttccaaagtgctgcaattacaggcatgagccactgcacccaactctgtctatttattaattgctagacatcgatactagaaattctgaagtcatacttttttttgtctccccattcgtcatccaagcagtccatcataatatcctgccagttctacctccagggtgtccttcaaatctctccctgttgcggatgctacttccctgggtcagtctttcagcatcacttacctggatcattgcagtagcctcctaccttctctcctcgcctctctcatcaattcctgctccacactgctgccagagttaatgttttcaaaacatagatatcggtttaaatcgttcagtctttcaactgcttaccactgctttatagcatgaagtccaaatgcattagcagggcagcaataccctttatcttctgtaatgtaaatggattgtttagctttccgtcctacactcctcatacctacatccaagcccatgccctgctcatggttaccccaaacaattacgctttcccaagatgatgactttgccactactaactcttctgcctactgtgccctcccccttgtaagcctttcttttttttttttttttttttttttttgagacagagtcttgctccattgcgcaggctggagtgcagtggtgtgatcttggctcatcacaacctccaccttctgagttcaagtgattcttgtgcctctgcctccctagtagctaggattacaggcctgtgccaccatgcccacctaatttttgtatttttagtagagacagggttttgccatgttgaccagcctggtcttgaactactgacctcaagtgatctgcctgccttgtccttccaaagttctgggattacaggcgtgagccactgtgcccgtcttcttgttggcctttcctgaaatatctctcaagcctttttaaaagtctgcttgactgtcaccgagttgtcacacattccccaaatccccaagatggaattacaggattctgcctctctgctctcaacacgccttgcttttgtggctaacagtctctgcgtcttattctctctgcatccactgcaaaacagctcactgctgagcacggcgcctgatggatggtagacactcggtaactgttgaataaattgcctctccacattagaagcacatgtccctttcataacccatccctcccattcctagctacttctacagaataaaaataatttttcatttttttaaagatttaataggggcacacttaagtggggaaatgtctattcacacttccgtgtaggaagtgctgcttcagattgcttgagttaaattagaagaggttaaattaaaagaaaaaaagaacatctccccactgtcaaggaacacagaatacaactcatcttggtagttctgacaattgaactcaaatagcatccctgttcccttcctagagaggtacactacaggttttgtgcatgtacgcctttttttttttttttttgagactgagtctctctctgtcacccaggctggagtgcagtggcaccatcttgactcactgcaagctctgcctcccaggttcacaccattctcctgcctcagcctcccgagtagctgggactacaggctcccgccaccatgccctgctaattttgtttttgtatttttagtagagacggggtttcaccatgttagccaggatggtctcgatctcctgacctcgtgatcctcccacctcagcctcccaaagtgctgggattacaggagtgagccaccgcgctcggccgtgcatgtacacattttttaaaggcaggaagccacatgtgacaatcagtcaactgttatatttggcagagtctgttttttaaaatgtgtttagttaacctgttaaataaatttaacattgaaagacttataaaaattatttctgattggaaaaacaagacttttggtaggaaaaaaatattaaagaaagtaagaccacagtatttataatgcaaatattgtaaaaggccataaacctcctgaggtcgtattgtgtttttgtaatgaatctataccatatatgtaggtaaggctgaggaaaatacgttcatttgtttaaaaaaaaaatatctagtcaagtttcttcccacatccagcgatgacaatgagaaggtatcatctttttggtataaaagccaaactgcttttttaagattttctgcttgctatagatagtacctaaagtcatatctgagtttctgaaaagagatatcagtgttttaatgaactgacatatcaatcaaagtgacaaactaaaactatacacacacacacacacacacacacacacacacacacacacacacaccattgtatcttcatttatttttatttttttgagacaggatctcgctctgttgcccaggctggagtgtagtgtacgatcatggttcactgcagccttgacctgctgggcttaagtgatcctcccacctcagcctcctgagtagctaggattacaggcccacgccaccatgcacagctcgtttttaaaatttttttgtaggacgaggtctcactatgttgccgaggctggtctcgttttatcttcttaatactacaagatatactcacactgttgcattagaaatgcattttggatcctagaacttgctataaactaaacctgacgaggaatggtttgtacatttccttttaaacgtttccatacactttgtgtgtcactttggatgtgctttactcatgcatttatcctcgcaggccctcatgacgcccgagtgtcaggaatgttatgggtttgtgttgtgtgtcatctgcttgttcccccatctccatatgtgcttcctattctgactcatctcagtgtactattctctcgtttttctttctctgcagtacagctatcccttggtatttaagggggcttagttccagggcccccactgataccaaaatccacagatgctcaagtccctgatacaacacggcgtagtatttacatataacgtatgcacatcctcctgtatacattgaatcatctctagatgactcataatacataatactatataaatgacatgtaaattgttacactatactgttgttttatttgtattatttgtttttgtatgttttttattttttcaaatatttttgatctgcaattgattgaattcacagatgtgaatcccatggatacagagggctgggcccactgtactttatttggcttccaggagccccttcattcatccatttctgctcatttttcttccccctgcttttccactctagagtaatatccccgactttttcttctcctcaccctctcactgtcccaggctcattttctccaatctcttgtaatgccttcactagatgtcagctccaccaggcagccttccctgatagccttgtctacccatccctctgcagtgaggcctaggtgtgcgtgtgtgtcctgggagtgaagcctccagttcactccttaagacctctttaagagcaagaactatgtggagagatcctcttttaaagtgtttttatttttgtgcttttttttttctaaacttcactttgactgctttggcatgttttaccatctgaagttatccactttctgttaccgaacaccaggggtttggtctaggttctgcagctcactgcacagaaaaccaatcaccgagaccacaagtatttccaaggaagaaggctttaattgggtgctacagccaaggagatggtagctcagtctcagatccatctccctgatggactaaaactaggggtttatgtaacagggaagaaatgtaacaatgtgtaagaaaacaggagcaagggagggacagggaagcaatcgtgatgaatcaggggtcagcatctggttgtcaggatgtggtgatctggtgagtttcagttctttgatactttctttgagaggcctgaaagtcatttcctgagaaaggaactcagataaaacagatgttaagtttcaagctttaagatcagaaatgtctgccgggcgaggtgactcacgcctgtaatcccagcactttgggaggccgaggtgggtggatcacgaggtcaggagatcaagaccatcctggctaacatggtgaaaccctgtctctactaaaaatacaaaaaattcgccgggcatggtggcaggcgcctgtagtcccagctattcaggaggctgaggcaggagaatggtgtgaacccggatccactgcactccagcctgggcaacagagtgagtctgtctcaaaaaacaaaaaacaaaaaaccacatttctcattttccgagttcttgtgtgagaaaactcgaaacaaggcatatgaatttctaagttttccttgacatctccttgaaatattacagaattctttctcattaaaacattaatgcctgtagcatttttaaaataaaaaaggaaataaagtgtcctgggtaattctgctgaaagtaatttactgaacatcatcacacacacagagttttatccattgatctcttttcaggactataggcagcgtttctttgggggtaactatttactcatgtgtattagcagtgttactcttgggtcattgtaataattctgactgttaggaaaaggtacagagaagattagctcataaaaaccttcagaacacattgtaaatggaaagggagagcccatttaaaaagctcatgtccactttgaccaactacatgttgtagattttctcaccccaacagtaattcctaagattagacatgtatggggaaacactaaagatggaaacggccctacaagcaaatggcccacaccctctttaggctgatgaaccaagagagaaggagctcccagacagggcttggtataggtggtgccttcagctcaaacctactccttcctattcagagccaggggacatgattgcactatttgtggccttgttgctgaacccccagcagcagagattatctgcggccctcttcccatttatctcaaagatgaaaaaacacagagaataaagggcaaagcagaacaaacccatgctatgtgagataagaacctgagctccaaagaagggttttggggaaagtagtagacataggccacttggaaccgacattagttttctcttccgggaagtgaggatgctgtatttaccagcaccttctatctcatatagttaccctctggatcacatgaaaaggcctctgtaaaagttcctacagaaaaaaacatagaaaatgtccaaaaccgaactttcttgttgttaccggccacacctctagaataaaatatgaaaaacttgatctttttatgcaaatgtgaagccagcctcttcatgcaaattgaaaacttaatctgaaaatactgaaggaggagtaatatattttttagaagtctgtggcatgagatatgtagtacagctaatcttactcaaaatatctttaagaaaaagagtattcattttttagtgcttgccactttctatagctattgatttgaccttttaaaattagtttccaatatagaaaccctccacccctggcagcaatgaactaaactcatgtaggagtttctttaagaaattacattatcacatatttactgaccagagttttatcccaatagaaaaatgctctaggaagttaattacttaaagactaggaagatagggaaattgtagcttttcccagaatgacctttgtggactagtttttagaaaataatttgcatttctttccaaacagggtaagtcaagatgagggcttgactaaccctcagtttcagctgtataaacattgaactttcaaatgtcttagaaaataagaccaaaacttataacaaccagtgtaaaaaataattatagttacattattgattatttcccttatgggaaataatctctttctccaaaaaggcaaagattgttttatttcttagtttgtatgatgtgagtgtaacaaacattttagtaaacaaaacaatgtttaccatatatgtatttgtctatatatatgtgtgtgtgtttaaaatgcataaaattatatttaaatatatttcaaattttaaatttatatatatttataattttgacatgctttggactcgagaagcctatagtttctaattacctgtgagtataatcttcattgaggccttattacaaagtattccgttttgtaataaacaccatgacatacttacaactttgtacatgagggaaaaaaatctgaggcttcttttagcacaaaccatagaataaacccgattaccaaaaccctgttgcttttttgatttgtatttctcactattatttattaatagctagctacatttttggaccagctgaataaaataattgagcggaactggtagtagtaacaggctgacaatttattcaccatgttgagggagagattctaaaattttctatagggctcataattgatttaataacaatttaaaatacgtactcttagttttcctaagtaattccatgtctaagagcttggaggcccttctaacgaagatccgttccgttaagagtacgcaaagtgaatttcagtcctctgcacacttgaagcaagctagaccagatgagggaagtggcaggttttacccaatttcacacacaaggaaatgatttaaaaccacttcgtaaactgctgcatagaaatcagcatttgagtttttcctggacgcttgttctaggtttgcatttgtcatcagctattaatgctgacttacagtccaagctgaaatctgtcaaagacaaaataatcagagaattggccagaatcaactggatgagggatctttatattctcactgatgctctgtgttctgagaggagtatatatttcagaggtttgtttgctgctttgcttgcttttaatgccagaagaggaaagagaaagggcagtagcttttcggatagaattttatgagtttatattttagaaacacgtttactatttaatatattaataaaatttccattgtcaactaggccctgcaaaaataaacatataggaagctattgtaaaaataatttatttaatttccttgctaatataattatctactaacttcaaaacaaaggtaagtgtaagtatgtgtggacattaaactcttatcctcatcagtaaatgtcttccttttgaccttagagtttgagtcccaagaatctggaaatagtagagttctagtggcaatatttcattagaattaatctaagtaattattatgacagtagtcagcttcttatttgatgtggcattaaataaaaacagttaatacattcaaactggatcataggcagtaatttgaactccatagtatacaggagagaagggatgtgactactttccaagtctagtcacaaaatagtgatcattttttaaaagcacagacttgttcaaagatttcgtatctgattgaattcaatcaatttcattattatctgaaagtgggtggattttgttcttattgtttgtattctttcatatcgccttgttcgtgttttatcacacagagggttaagctgaatctgttagaatatgttttcctctaggacacagttgagctgggactagaacccagatttgaaattctaccctgaggcttagctggcactcattatgtcattcagtcatatatttgcaacaatttaagtagttagatttttcagtgatgaaaggttatttaataggctgcaggttacgacagtattttcctagttatcttctgtgcagtcttcagaaaagattgggagcatggttgattccaataactacctaagggttaaatattatgtgtgggctcagacccgtggtcaagtatttgggaaaatttttattgatttaagtaggtgttatagctcagtaacaaatggccctatgtttggcaagaaaaggagatatggaaactctactcacagccaaatctgcaagaataaaataattggttcacgtaaaaggaaatggttttgacagatttacactcttggggtatgttagaattccaccaaaactaaggattcaagtgcatttttatctcaaagtggaagaatctgacactgaaagtggaaagcattttctataaagcaaatgctattgacacggtcactctttcccccattgcattctctacttgttgtcttaggtagttctgatgtgtcctattgtcactctactttctctactccatttagatttagatgtagatgtagatcaacccaaagaagaaaagaaagaatgctactataatctcaatgacgccagtctctgtgataatgtgttggcccccaatgtcacgaaacaagaatgctgctgtacatcaggcgtgggatggggagataactgcgaaatcttcccctgcccggtcttgggaactggtaagaatccgcttagtggtagagtcacacttgtgtttggtcacatggtgtccctgggccttgaaatgataacactcattcccacagccaactcaaggcgacttaccttatagtgagtttcattcagggctagagccagcacctgcatcccatcttaatatgaatccttgaacttctcttcatcatcgtgtactttgacagtcaggttctttgtgatattttggcagaaagttaattcagttttattccactttaaaattaaaatcagtctttgttgctgacaatgatacagcattattcgtaactaaagcttgtgtattgaagctatgatttcgtgtaattgattcttactaaacctttaagatactatacatcacagtagtggaaaaataatagttataatttcaagtaaagcatgagtaagaaaatattagtgaacttggaggttttttaaattaaaaagtgtaagaaaacctatgaagtcattagatttctttgcacttaatccatcattttttgagattgtactaaatttatttgctggaattgccttaaagttactgagtctgagaaagcaaaactgaatttgaaacatgcattcatggaagatgttgaatcttttttttttttttgtctcttctaaaatcagctgagttcactgaaatgtgtcccaaagggaaaggttttgtgcctgctggagaatcatcttctgaagctggtggtgagaactataaaggtcagaatcaagtggaaacaaattttcagcacattgtgtacatgtcagatattcaagtgaaaacatggcttgggtttcacagaattagagttctttttagtcatgaaaactgattacaaagtccttaattctaccattaaaagaaagtccccatggacttgcagtcagaacacaaactgtatgatgctcggagtttgacattgggaggtgaacttctgagtttctgtctcttcatccctgagataggaataatttctcaaaggttataatgattaagatatatatctgaaagtacttaacaaattctgtacctagtagatacttactaaatattttattctagatgcttaatagaaatcatatcaattatgatcatataaatttgaccactgtttgtctttatggtcatcaacaaagctaaggttcttgtatttttagactttatcctactgttgtggggccttttaccagtgtgcacaagttcataatgagaaatggaagagaagacaaccaaagtagacatgttttatgtatttgatgctacggttatataattctaaaataaatgtgcggccttttaattttggtgaatatccacatgtatgaatatttcctcattaaccactcacttttgacattttcatgatagagatattaccttttatatacaaagtgattttttttcctttatagtttaatactgaggactgctaagtagctgggaaacacactgtaaaatcatttttattgtccatttttggaaaactagtgtttgaataatatggtataattcagtagctggataagaaattccatttgtgttcttttaaatacatctatgatttggtccaattaaataatgagaagatttggtttataatatgtgttgaatggtttccaaattcacaaatatacattactatgtttttgcagggatgtagttaaatctcacttcatattaaggtacagagctttgatttcaccataaattcatcttctcttttatatcaaaataaattccttgtcttcctattttagcagtgctgtaaatggttggaagaagattggattcagatccaaccagccatatgttctaggcttgactttgccattttccatctgtgttaactttaagcaagtcatctatggagtcttcaggttgtaaaatgaggactagatgaccttagctctaaaatgctagaactaatgctaataatagcagtaaaagcaatagataacacttttgagtatctgcttatgccagagcatataccgagtcctatccatggattatctcatttcatccttcctctcttattaggtagatgttcctattgtctccaatttatcattgagtaaactgagatagcaaaagctattaattctgtgggggaatgggtctgctaaccccctcagcaacttgtgctttcttttatcctcaagaaagacttgcattcaagttccaccaaactttattggaaactttctacatctcaactagtgaatgggccagaatatacattacagaacacatttcttaaaaggtatatatccttttgttgatgccactatggaaccatagaccatttcatcaaatatgaggtagcatctcagaaaccatatttacaaatacacttctcctataatgttttgggcattgcttctcaaatatcacagacaaactacatctgtttatgtttttatgcctgccaattaggccttattttaagaaggttatattgctgtttgtgtaggattctttggaatgtaaatattataatatctaacttaaagccccaaatctggttagactctttttaattgaaagatcaaacctaactcctttttgtatttctcaatttttttccccgtagatgcagatgaatgcctactttttggacaagaaatctgcaaaaatggtttctgtttgaacactcggcctgggtatgaatgctactgtaagcaagggacgtactatgatcctgtgaaactgcagtgctttggtaagctttagggggatatagtatggtgtactgtgaaaatatacagatggaaaaaataactatgctatgtagtaaaaacaatttccttgaatctaaatcatgtgttgaaaagatgtgtaaacgttttagggatctttttcttaagcacaattgaagaaaataaaaagaaaaaaccacctccatactactgtttgaatgtatttcaaacaaagagttaatattcactgtggaattatgattcaggccactggtataactgaagtgttcttttggtctgtggaacatcctgtttcatcactcataccgtgcaagtgacagccattttaaatactgacccagactttaatgcttaagcagaaaaccatatacactaggcagaaaaacatagcaaaaggaaataattttaaaagttatcataaagagccatttaatcttaaatttctaagcatatcctgttcatggatgttttctttccttatttaatgtcagcagcagcagcagcaatgttgtttttcagtcagagcagcttacatttttatagacagagccactctcttttggatgataatgtgtggttaattaaaatttggcagcacctggaatctggactaaatatagcaatgtgtaaagtttgggaagtgtatgaggtacaactgatggctgattttctttagtaatacttttttttgctcttaagatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacggtatgtttccaggagatgcaaacctgtgtccaaataactatcataagattttccttttaactaaaatgtgaactattggaaaatagaaaaatggattccttgggtattttgaaataactaaaatgagatacaatgagatacttacagaaatagtaataagatgcatatcatcagtatgtaggagatttaatagcctggacatactcattaagtatggactatggagtggctgagcagatggcagggttgttccatggcttagggttcatcatccctaacctgcagaggcagctgagggaaatgtaattcagggaaagataattaggtgcactcagcagagtggaggatgtggataaggctcagcagaacagagggtggagttcaacagggtggtggagagccccgaagtccactgacaaactcctgtcctccctgatgctactgataattggcaaaaagccgctgataattggcataatctgtcattcgcctcaggagactgctttggatgaagtcaattgaaaggtaggaattaaagactctaggatgaagggtcactagtccagggctttggcagattaaatggataagaaggcatgaatccaatagctgttacatggaaagaaatggtagggtttgacaggagtaaatgaaaaagtgaagattaggagagtgagaagcctgatggcttatgaaggacaagcaagatagtgggcattttatataaaagtaggaagctatagagaactattgtgtcgggaccggatgggcagctggaatttcaactgatggaatgacacccagttggagatgacagagaattgatccattgaaagaccagactggattcagacttttacttggaagtcactcttagaaatagagatggaaactttgagacttgctggcttccaacacagtgtttataaataggaataactgtgcgattttcatggaactatgtcttccctttcagaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcaggtgagcccatatccaattccttctgcaggaggcctttggggacaagttcatctcacctcctttgtagcctgacatttctcttctgtatctttgccttcactcctgatatcttactttcatcccgtgtgtgtgtgtgtgtgtgtgtgtagggcagaactgcataaacatttggctcctggtttacctctactcccgaccctgtcgttaatttttgaaactctcattccattaccccaatgaatgataaatgacccaaaaaaacataacttagcaatcagtggcataggcttagaatttatatttcctggcagttcattttttactacaattcttctcattcctaacagtttctacttagaccaaaatgtgtattagagacggtagaaaatcattctaggtcaaagtccaaattttcatgtcaatctctgtatgtggagatataagaaacgggttacaacaaaaagggaaaagtacagaaagtaattgaagaagtatttcaacaaatctcctttcctttcaagttctagatctatctgggtttaaacctttggtcaaatggaaaagatgagacaggctaagctcccagtttcatcccctctcccagtttggaggaggcctggaaggtgctggctttgtgcttcctggctaggctgtttggtgaccgttgagttgtgcactgattgctaatttcccttttttaccatcatagcaccttctcattaaaggaaagcactcgaaagtgtccagtatatccttttgtaaagttgacttgttaaagctagaaagatcatgtgcaagtagaaagcaaaggagtttattatgaatatattctcagaatggtcgagaggggaaaaattgcttgaaaagaggaaatgcattaatttttagttaattcaattagaatatttctttcaagctctttagaaaattagctttgcagcttagaaataacttaaaaccaacgtagcatgaaagagaaaataattgggaattcccgtaagaagaaaatgaatagccaaggataaagagcaaatacacaaagcactagatggcaatgatagcagcccagaattggaaagagggcaggtctggggccagttggcactgagtctggaatccagcactgccatagcagctgcatgacaaggggaaaataacttcaccctgtacagctcatttgtaaaacggaggcgtctacatctgtcctgttgggttgttgcaagggctgggaggatgtaggtagagcagggggtaattactagctttactggttgtttcgggccctggaagcagatgccacggggagataaaagtgaaatcactaagttaatgtgagttcagtgaggcttttgagtcattttctcacaatgctatactacctcaaatcttttttatttatgcagtggttttatattgtctaatttttttccaaaaatcacatgtattcctcctaaagtattaaaataatcaaagaggttatattcccctccacctaccccatcacagttgaactctgctccttaaagacactcacttttgacagttgggtttttatcatcctagcattttcttatatattaattatcattatatattgatattagttattgctgtatattaatatatttatatccaacagagtatttataactgaagtctatgtcatcaatctaagctacactttgcttgttattttgcacttcagcatccctgagattggggtcatctgataattatgacatataacaatgtccacgggttatttttcccaatttttaacatctgttatatcaagatacattttacaatctaggatctcttaaaatagatgaaagttagaacttaaaatttttttatattgatatatttaggggtgcaagtgtagatttcttacctgcaagtattccatagtggtaaataaagtctgtgttttttgtgtacccttaacaatagcgaacactgtgcccaataggtaatttttcaacccttaccccacttccagactcccacattttggagtctccagtgtgtattactccattccatatgtccatgtgtacccattgtttagctaccatttataagtgagaacgttcagtatttgactttctgcttctgagtaatttcaattaggatagtgacctccagttccgcccatgttgctgtaaaacacacgattttattcttggttacggcttagtggtattacatggataaagaaattttcttactgaggcattcctacaggtgcatatgtggaggttcattgcagcattgtttataaaaggaaaatcaggactggggcaagatggggcagggaaaggttaggggaggaagaaaaacaaatgcccagcacaagagatggctaaataaatcatgtacatctataaaacagattccatgcagctgtttaaaaattaccatcttttggccgtgcgcggtggctcatgcctgtaatcacagcactttgggaggccgaggcgggcggatcatgaggtcaggaaagatcaagaccatactggctaacacagtgaaaccctgtctctactaaaaaatagccgggcctggtggcgcatgcctgtaatctcagctactcaggaggctgaggcaggagaatagcttgaacctgggaggtggaggttgcagtgagccgagatcgcgccactgcactccagcctgggcgacagagcgagactctgtctcaaaaaaaaaaagaagttacatcatttgaatttaaattagtacagcctttatggaaaacagtatggagatttctcaaagaactaaaaatagaactacccggcgatcccactaactgggtacctacccaaagggaatgtctttatccattcctccattggtggatacttaggttgattctatctctttgctgttgtgagtagtgctacagtaaacacacaaatgcaggtatcttttggatataatgacttcattccctttgggtaggtacccataaacaatgctgcaatgaacctccatgtatgcgtctgcaggaatggcttagtaagaaaattttgacaaataaaaataccaggctaagtgtgtacactttaaatttatgatattattctggctggcaccatggcttacgcctgtagtcccagcatgttgggaggccgaggtgggtggattgcctgagctcgggagtttgagaccagcctgggcaacgtggtgaaaccccatctctacaaaacatacaaaaattagctgagcgtggtggtacacacctgtagtcctagctacttgggaggttgaggtgggaggatggcttcagcccgggaggcagaggttgcagtgggccaagatcgcaccactgcactccatcctgggcagcagagccagaccctgtctcaaatagataaataaaattatacccccaaaatactgtaaaaatttacactcaatttaattgactaggtttaaaaaccttcaagtattttgttatgagaaatgaatttttgaataatgtagcaatattctaaaaatgaattttattttaaatatttattctaaaaatatggatttcagaatattgcataaattgttttcaactaaagttttcaaaaaacattttaaaaagtagattagaacaaatacatatgaagtacatattatataatatttttggaaaaatacagaatatcaggggaaaaaagataacacatgccaaatttaaaaaaaaaagattagcttcattgctatactgtttctagtttgtatatccacagttattatgataaaatgtccaagaagaatctctagtgtacatggtcagccaaaccaaaatcagtgctttccaatccgttactttttaaaaaacaatggtagtttttttgttaactgtattgtaattttaacctccagcatacacattcattgacattaaagatgctgggtgggctggttggcgagaacaactacttaggctcttgaggcccctgtgaaggaccccagggttccaggaaacgcatgttgaaaactgctttcgaaatatatctgttggagtatataggaattagggaggtagccccaaaggaactttttttattttttgacagagtctcgctctgtcacccaggctgaagtgcagtggcgggatctcagctcagcgcaacctccacctcccaggttcaagagattctcccacctattacaggcgcgcaccaccacacacacaaaaataattttttgtatttggtagacacaggggaacttttcttttatactaccaaaattacggacctagaactaggcttatggatcatctattctgaatccagagagaagtacacagtgaaattaaacttttccacaggtcctatgattagttggcattcccttcattggcacctaatcatgtagtcacatttacacaaaaccatctcttgttgcaaagcacatgtttgctggagtggagtgaactaagaggagccccagggcatcagggttagcacatgtgccccagaaccaggttgccctgcctttgcatcctggtttggcaacttcttttccccatgaccttgttaattttctctctctgtacctcagtttctcatgtgaaaataatatctgcctttcagggtggttgtgagaattaaataatacgtgaacacttcaaatagtgtttgacacatggtaagttttcagaagatactaacaactatggctgccactaataggcgtctcagatcaaatgcattttcaaatgtaattaaaatccaaaggatcttataaaatctacagttacctaatagcatgtgaacataaattaagcgtagacaaatgcagaaataattgttcttaatgtaagactgtcttttctagaccactgcttcgtaaacattaatgggcatgtcagttacctgggggagcttatcaaaaaacagattctggtttctcacttgcaaaagatggggcggggcgcgagacacaggattctgcatttctgataagtcccaagctgctgctgctgctgctgcttcctctgaggaggaagcaaagctctagagccatctaatagcatctaactttattttgttaaaacctacgttaatgctggtagttatctatcataaaggaagcaaagaatatgtgaattttaaaactagtttgttcatagtttctgccattgaaccttttaaatatactgttcccggatatcttaatcgttgagaaggaccacgttgtctatctcttcatctaagcactggactaatcccagcctgtcagacatcatgcatcccattttccttaggagtgcagtactgctttggggaacaattcgttactgatggaatcagtgctggaggaatttaaggaataaatcgcaccacttgtcatcagctttaagcattaaagtgcagtgtaaaataaagctttggctccagagcgagctttcacacttctggtccaacaggtcacgggcactaattcttgctaaagcagcaactacatctgagagtactggtaggtgcaggaggtaggagtggctgcttaaatagtgttctctgaagttagatggcatcttgcatattggtaccacatgcaggggaaatgagtgtgatggattgtgtcaggggagctttacataaggagaattgcataattgtagaattcatacatttctggggctgcttaggatcccatttcaatgctccactacagaggccagaccgcagactgcactaggaggaagttcctgatttttccttcaccatggatgtatcatggactgactgtctccccattcagacttctggaggccttccttgccccattgcagcccctgactcctcttctccttcccctttcacagtacccgctgatcctgcccactcttaaaatgatttgggtggctaaactgttttgggaggatcctcaaatttgtggtctttattgtgatgtcatgtcagcctctgagagacagagctgtttgggaaaccaagtcaggaaaaacgagccattgtatccatttcataaatgaagacagagtggtcattgtttgatcttgctgagaatttctagcgctgtgagagaagaaagtcatagagttatcagaactttgaggcctttggttgcatatggagtttattggatatagattttttgttgcttggtttttctcagtctaagtgataataaaaatgataactaacatatacatagcacaatgcctggcattttcaacatgttttccatctactgagatatttaacttgccaagccatcttaggtatacagttacagtagtcctctgccttatctggtttcagttacccacagtcaaccacggtccgaaatattaaggggaaaattccaaaaataaacaactcataagttttaaattgcatgcagttctgagtagtgtgatgaaatctggtggtgtcccacccagcacgtggaccatccctttgtccatggtgtccatactgtgtatgctacttgcccattagtcacttagtagcagctccattatctgatagaaatcgatcgtatatataaggttgagtactacctgcagtttaaggcatccactgggggtcttggaacatatccctagtggataagggagaatactacccctcctttttctgacagaggatctgaggcacagcaagcttaagatgcctgtcagtggtcacgtaccagtaagtggaagcttcaaatccaggcacccttgctccagaatctacgttctaacctcttcagtgttactcgagtctctttccatgatcccaaagcacatcttaaatagtctcccttagaacagaaaagtaacaaagtgaagaattaaagctgagattttaaaattgtctcacacattgtgtgctaaaagaaaaactgattttagagctaacaatgagcataataagaggcaatgtgtcatcaaatctgtagccacagacacattggcaggaataacaaaaaactatatattcaatggactaatgaactaaagcaagtcaataattctcagtaaataaaacttttagtgatgcctatcacttaatctaaaatgattttttaatgtttttattttttgctactcttaaaagtataagcttaatcaccgggtgtggtggctcacacctgtaatcccagcactttgggaggcagaggtgggcagatcacttaaggtcaggagtttgagactggcctggccaacgtggtgaaaccccatctctactaaattagccaggcatggtggcgcatgcctgcaatcctagctactctggagactgaggcacaagaattgcttgaacccaggaggcggaggttgcagtgagcgaagatcgtgccactgcactctagtttggacaacagagcaagacttcatctgaaaaaagataacataagcttaaatgttctggaaaatgtacgtaagaatcacaagatagagggtgccattatctcatggaaatcaaaatccgttgatctgcaaatgaaagaaaattatacatatttgaacatttgaatcttaagtacccagggatcccagtgtctttttatattgttaaaataattagatttctgataagtaaattgttaaagtaattagacattgtaagtaaacggaacaaagacttgataaacgggacaactagtgtgttgggagaatgccacctattggcgatgtaatgtactacagcacaggtaatttcttgactactcaggtgtagaaagatggttttaaaacatgaggtcccaaaggaaacagaaggtgccacaaaataaattgaaaaatgttaacaaagtttaatgaaacacgaacattgatcaacatacagaggcatggtcctctcagtgttgctaagagagcagtttgaagagacagacttacacatctgaatcaaaaattctagttctgggactgatgaaagagcaaatggattttgtttaatgcctattgaataaaagaataaagcacaaaggcatgatgtgaataggcacttagtgaggatctgttgagtcaaagcaatgtcagtatgtatccaacttcctttgagaaaggtagactgtgctataggggaatagaagatatttgtcagttattcatactcctttaaataatgctaggaagaattatcattactgtatataaattatatacagcttgtggtttataagaagagataagtaaatgatctgaaatgaaatctaaattatttataacttacctgttttcagttttagttaaattacttacatgttctttattttattatttattgaatgcctactatgtactaggcaaacaattctggaacaggtgtaaagttgtatttaatgaaatgcataattagtataatttattcctaaatattatgtattttaaatctgcaaatgatactttaataaattcaccatttgctgtgacagaaaatttttcaatccttcctaatatctaacctacccaagtattcatatcattttgcaaaagtaaagaatttggaatgtcttcaaacaattcggctagtgatttcttccatatctgtgcatggctcttagacgctcccaaagatctcagggcaagaagtttcgtaatgcccttggaggtgtgaaggaagacagggatttgactcatggactaaacttgaaaaaatattgtaactgggccatagttgcaaaaggcctgtcagcagtcacggtttaaaggcttttccaagaaatatgtttccaaagaatgttaataatcactttggaacaccctacttgtgaaacaatgagtggtcactgcctttggtttaggcaatccagggatctctttctgcttttggtcctggctctgtgacattgcactgggcacattacttcaacctcctttatccaaagttgagacctcttcgtgaggttatgataattaatacaatcactatgaaagcatttatcatttcaatcatagatcctgaacattataattaaagaaacaataaccgctagtcacttacaatggaaaattaaaatcaaactagaaagatacaaaaggaaatcgagtggccgtcatgcgggcacagagaatatctataaaacaggcaagcgttccagttctgtgggactgaactcttggtatccatggaactagattgaatggatgttatatgaaatggccagtaagccagttatgttgttcctcattgaaaggactcttggcccggcacagtggctcacgcctgtaacctcagcacttgggaggccaaggtgggcagattctgaggtcaggagttcgagaccagcctggccaatatggtgaaacctcatctctactaaaaatacaaaaattacctgggtgtggtggcgtgtgcctctagtcccagctactctggaggctgaggcagaagaatcgcttgaacccgggaggtggctgttgcagtgagccaagattgtgccactgcactgcagcctgggcaacagagcaagactccttcccaaaaaagaaaaaagaaaggactcctgtatttatttagaaagctttctctcacccctcccaaagaaaggttgaaaatacttttactactctcaaaagattattgcaaaataaaattcattagtgaattcaaactgaaagtagctctttgatgtaatgtgatccgtatgttaatttcctcacttgaaatcctagtgatttcttccatatccatgcatggctcttacatgctcaagagggttaaatgtgataatgcatgggagaggattggcctacagtaaatgcgccatagcgaaaggcgttagcaattattatgaatcaaatccagttctaggaaatgagtcaacgttcatcatgcactgctccctggttatccagtgctagaagtctctttgaaaggggccaagaatcaaagacaatgagggataggagggtgttcagggaattgcacagacccgaatacccctgtgtacttgcagagaagctccacctgtgcccggccaggctcctacagtgtaagttaggaagtcaaagagaggctttatgcacacaaaggaccattatgttgagttgtttgtttgtttgtttgtttattttgagacggagtctcgctctgtcgcccaggctggagtgcagtggcacgatctcggctcactgcaagctctgcctcccaggttcacgccattctcctgcctcagcctcctgagtagctgggaccacaggcgcccgccaccatgcccggctaatttttttgtatttttttttttttttttttagtagagacggggtttcaccatgttagccagggtggcctcaatctcctgacctcgtgatctgcccgcctcggcctcccaaagtgctgggattacaggtgtcagccactgcgcccggcctatgttgggttttaatgaacattcaatgtactcaatttttaaatgttaaaacctagatattcctaagaatttgatttcaactttcacattttatcatcctatttataagtccaataaccttctataaaataagatcaattttatttgttgactgtttatatgtctcaaagaacggattaaacttaaaagttatttctacatataaattctattaattaaaattttgaacactttggtctccatctcacaatcctaataagcatttcctcataaatatttaattagctcttataagtctaataaaccaaacttaaaacacaacaaattgaattccctaataaatttaaataatgtttaccaacctaatcaaattctcctaatcctcattcaacttaaaatccaaaatctaaattcagttttgagttgaagttgcaaggcctgtcaggttctctgatgatatgattctcttaggcactaacacatgtacaataacaagaaaaagccctcaccctaagacgtgtcacagaaagtgttaacattctaagcttaattaacttcattatttctgtagcagaattactgtgttaggccagctgaggttagtggctgaaaaaattcaggaccctgattgccagttggaaatgagagaatgaaaaccaggacttgggacctgcatcctctcagtaatgagtctgccctgcccaccataggatgcggagcaccttcttgcttccgtgctaacgggatcccaggtgtttctcatgtgtgtttttttataatcagtatcttccattgcagtgactttcaagggaataataggacagaaaaaataaataggaccttttatccaactatacatgccctcccgtaggaatcagataccttctcctaaggggatatcctcaccccactgagattccctagtagatcaatagctgccagcaggatggggcttttatggatggtcagggcctcctttactaaactggggaagaggtactggatttgtgaaaggggccaaataagcaggaatgaatggcagagaagccaggtacaaaaagcagggacagtacgtacataagaggaaaaatactagatgctaaattgtgtgtttttaaaaaataaccatgtttgggcaggtgcattggaaggaaagaaagcaatgggcaaggaagccacattccagttatgatcctattgtagtcattgaaagcagaagaaaagcaaacatggtttgccgcaaggtgagaatagttaaaataaaatttttaaaaaccctgatagaggggaaaacttactccttcatttcttgctaaactgctgaagacagagctctggaggagtgtcctggaacaagctgccattcccaaaccccaaatccctggattgcgggtgagtcagcaagtatttggaacgccgaccagggaggaccagtggaccttgctagactgcactgtagcatgaactctctgttttgaaagctgattgaagctactgcctcagtgtcctcaccagccattagagaacagttcaaggcgagagaagtttgattaatgggttactcgttggtgacatgagcacttctgaaattttacttcttgtacagcttgagccttggagtgtcagttgtattcatggcacttttcctaagagctatactgcatggaagtgctagggaaagtatttggccactctctgttataaaaaatactctgaatagaaaataaatttcattatgataataatcttactgatgtcctattaaaatctttctagtttgagcgaaaggagagaaattcaggcatgcatgtaaacaatctgatcctaaaaagcaacacttatttttagttaacaagtgtatcagtctgtttttacactgctataaagatactacctgagatgggtaatttataaagaacagttcttcatggctggggaggcctcaggagacttataattgtggcagaaggcaaagccagacacttcttacctggcgacaggacagaaggagagaaagagcgaggaagtgccacacttgaaaccatcaactctcctgagaactccctcactatcatgagaacagcgtgggggaaactgccccatgatccagtcacctcccaccaggtcgggattacaattcaagatgagatttgggtggggacacaaagtcaaaccatatcaacaagcaatcatatttatctcaaaagtaaaagtcttagcagttttacctttctcctgtgaaatcagagattatgaataggcattccgttttctagaatcgcccattcagtatgatactaaatgatttggtctagtgaacattttactttcatatatatatatatgtgtgtgtgtgtgtgtgtgtgtgtgtgtgtgtgtgttttgtttgtttgtttgttttggagacagagtctcgctctgttgcccaggctggagtgcactggcacgatctcggctcactgaaacttctgcctcctgggttcaagcgattcacctgccacagcctcccgagtagctgggactacaggctcacaccaccacacctggctaatattttttattattattttagtagaaatggggtttcaccatgttgcccaggctggtttcaaactcctgagctcaggcaatccacccgcctcagcctcccaaagtgctaggattacaggcgtgagtcaccacgcccagcatactttcacatcttttaaataaaatttgctcttctttttttccttttgaaaatagggctagttgaagcatactctaagaagcatgaactgtgatgagtctgactttgagaaaatcactgtgcataattgcttaagcactgttctaagtttgaggttttgaattcaactaacgtttgaatttcttttgacctcttcttaacgaacctaataatacaactatggctagaacaaagctgctgactgcccatgtctgttaaacagtgacctcatggccagagcaggcaagccgggcagaggagggatgaagtaaattttattctccttttatgccgcagacagattgtgccccttatgattgggagaaaaacatctagaaagttcttagaatgaccaggttcttgtatttacaaatctgcagggagcagaagctagaaagtaattgttctgctaagcatcagtagccactaccttaagaaagaagcagattacaaaacattagctcattgggagggcttctgacacaacaaagccttctttatgcttccttctgggcttcaagtctcagtggcaggctgagctgttttgagcagttgtgctgattgtacactgctcatttcaagaaaatactaggttggtgcaaaagtaatttcagtttttgccattgctttttttttttttttttttttttctttttccaagacagagtctcattctgttgcccaggctggagtgcagtggtgcaatcttggctcactgcaagctccgcctcccaggttcaagcaattctcctgcctcagcctcctgaggagctgggactacaggtgcctgccaccatgcccagctaattttttgtatttttattagagagagggttttaccttgttagccaggatggtctcaatctcctgacgttgtgatccacccacctcggcctcccaaagtgctgggattcataggcatgagccaccgtgcccggccctgccattacttttaatgcattcatgtggtaatctgtgagccccttccaaagaaatcactgccagaggcagaagttgctaggactgtatctgatagtgaacagatccagaggggaaggaaagaggagggtcatctcagattgaagtaaatggcagaatacaaagaaatcataaaacagaatcaggatttcaagatagtccatcttttactttgcagtgatgtcttacttcctgttattgaatgaaatacattttcatgactagtcattgactatgtttagtgttattttcatattacattgattagaacttgctcttccaataatgttaatggatagtggtatatctttgttattcagaaccttgagatctgaacttctgaatattaagagagttttaaatattagaagagctttctctgctatgaagctttaaaaaaataagcaagattaaaatacgttaaaacacaattttctttataatttaatagcttattacttttagtaaaagaaaacaaaatttatcctggcttgacctttggaatatcataaaatttctgtaaacttcagtttcctcagcaaaataatacatgggaagattagatgtccacgcttacagtttgttaaattacatgtttgtcatcattctgaaaaatatctagatgggcaccacctgcaggtaacagcgtcatctagtggtgattaccttatattacagccacaggtttcaaagacaaattgtctttccaagagttttgcagcccatgataagaatgttttctgctcaggccagatgcagtggctcacacctgtaatcccagcactttgggaggtcaaagcgggtggatcacctgaggtcaggagtttgagaccagcctggccaacgtggtgaaactctgtttctactaaaaaaatacaaaaaaaaaaaaaaaattagctgggcgtgatggcacacgccttctgaggcaggagaatcacttgaacccaggaagcagaggctgctgtgagctgagatcacgccattgaactctagcttgggggacaagagtgaaactccgtctttaaaaaaaaaagaatgttttctgtttaaaatcatagaatatgcaagctagaaaggaccttcgagatcatctagtcttattgcctcattttgccagttaaagttagttgaattccagagttaacatattaaatattttcccctcctgtattttttgtttctcttgactttttaaaaattgcagtgaacttcacagaacatgaaattaagcactctaaagtgaacaatttagtggcatttactacgttgacgatgtaatgcaacctcccctttattcttaagcacatgcttagttcctgtttttaaacaattcttacttggttaatgaagaaaaaaagttctttgtatgtataacttaaaaaaaaaatttcagcttgtcagattgttgcttcagagtggtatttaaagagcaggaaaggggaaatgaagtggtttacctgtccttgcagctgaaaaaatatgaagtagatcagtttggaaatttaacatgctgaacactcttttcatttgcctctttgtttattgtgttgttcagtcttgtctcttatcaattttagaagcctcattcctgatttcctatgaaattgcttggatgtaagacttaatatatttcctatgccccagatacattggcaatcattattttaaggttattgtgtgtggcataatttaatactattacagtagtataaatgtttggatccaggttttaaaatgcaaaggaaccactatttttttggcatttctacccaacaaatctcttttttcattttgtcttgctaaataaacagcagtctgttgggaaactctgggagtaactaaaatgaggagggtaacattaggtgaaggttgggagtggggagaacgtggttggtctatggcccgtgagtctccttagagtattaacatttacaggagtcccacagaatataaaccttgccaagactttagacttcattacttccctgtcctcgacaagtacaatttaattgaacattaagcaatttgatctctttcacctaataaatcgagcaaattcaataaacataaatcctgctaatgatggagctgcccctggtggagctgagctcatcagcattcatggttattactctccctggaattttagtcacaaatgcttattgctgaactaagtgcttacctgatgcttaaggtctagggagtgtatttaataatttttttcccagggtttcaaaaggacagctggggagtagaaagaacatggtttggcagatagaccactttgggttcaaatccctcacctgaccttgggcaaggcaagttatgctattaaaaagtgtagttttcttattggaaacaaaaggagctaattacaattatttcatagagttctgagttttaaatgaaacagtgtatgcaaaagtagtgtctggtgcgtaggaacttaatagtgcgtgttagctaactctcttgtttttaattgttcagtagcctgcatctacagcagttagcgccctactgcttcttttttttttttttttttttttttttttttttttttttgagacagagtctcgctctgttgcccaggctggagtgcagtggtgcgatctcggttcactgcaacctccacctcccgagttcaagcaattctcctgtctcagcctcccaggtagctgggactacaggtgcacgccaccacgcctggctaatttttgtatttttggtagagacggggtttcaccatattgttcaggctgctctcgaactcctgactgtaggtgatccacccgcctcgggctcccaaagtgctgggattataggcgtgagccacggtgcccagtctagcttccctaatgctttcttatctattatacatgcttatgactctctctgagttaccttccttcctcttctacctggttaacctcctggctacagatggtgttttcaagctgaagcctttcccagctcttccaggatgactttagtcatcgtctctgtgatcctgataagttattgcatgtgccctgattgactatcatcacatctttccgtactctcaggtcccaccctgtccgtaatgaagcaatgaatgaatcacttttaatagagctaaggcaaagagtaccttaattccgtgcaataaatggagaaactaaggctaaaagaaccgtgtccagaccaagaaactaggaagtggagaaacaaggactagaacccaagtctttggattccaggtgtttgcagtgtatccagttttgcatcacaacaccacatattttagttttagggaaggagggttgctgcctgttcaccagagactgtaagcagtaatgtattccgggataaagagcaggacagacacccaggcagacatccagtctcacagtattgtggcaatacccaaggaggtctctcttccacctttctttactggtacagagtggaatgttctgtaaatggccaccgtttttctaatttcataacttttactaatttcatttaaagaaaagtgcccattggctgggcgcagtggctcacgcctgtaatcccagcactttgggaggccgaggcaggcagatcacgaggtcaggagctcaagaccagcctggccaacatactgaaaccccgtctctactaaaaatataaaattagccgggcatggtggcgcacatctgtagtcccagctactcgggaggctgaggcaggagaatcactcgaatctgggaggtggagattgcagtgaaccgagattgcgccactgcactccatcctgggtgacagagcgagactccgtctcaggggaataaaaaagtgtctattacaatgctggcttatcagtcactggaggagacagtcatttcattctctttatctcctccctctgtttcctagttgtgtgttttaaacaccattgtcgttaatccatgtttaaacctgtaagaaaaatacctggtctagaaattgtagtagcatgtgacccacttttctgcttctttttctcttttttttcttttctttctttttttagatagggtctcactctgctcaggctggagtgcagtggcacaatcacagctcactgcagcctggacttatctgggctcagatgatcctctagcctcagtgtgccgctatgcccagctaatttttgaatatttttttgtggagacagagtttcaccatgttgcccaggctggtctcaaactcctgggctcaagtgatctgcccacctcagcctcccaaagtgctgggattacaggcgtgagccactgcgcccagccctgacctgtttttcttaatgcatgaaaattggtccttgtttctcttatatttgaaaataacacagttcaaacttcagagcgttgcatttttagccctgatgtgtgcaaaacgaaattgcaacctctctaccatttctaaaaacagctgaatttaatttgcctcagtcagaactaaaactttacctcctggtctcctcacatgccagggtagcattgtgacatgtgactgtccagactgccctgcacatgtgtctgtcatcaagaatggagatttcttatagtaaggatatggtaatgttccttccattgctgccaacagcaggggccccacacccacaggctccaggggataatttttaaaccttttcttttttcaatttaagatgaaaagcaacagcatttgtcatatgaatcagccatgccagggaaattaatgtgatcaatggcctggatcttgtttagactacttagcgacggcgtcccatagcatcccttatgtatctttcatagctttgatcaagagctaagcatttgcgcttggggcatggggaatgcagtgggtcggggagggtctttgaggtgtgactgtttccatttcctgttcatttcacattggtatttggctagattccagatggacacattgtatggggtctcaaatgggattgcctccaaagtgcacctctcagggcaagccctgctaagcaaaaacttttcctttgcaccgagccccagacaaggaggtgactattgttcttgatgcacagaagtcaagggtgttttggagaaagagaaagattctaaggacagaaaatgtgttcatctccacatgttgagctggataaagtagcagccaagagtttcttgtgggaagttatggaaatagtttagggatctgctattcttgggctctgtactctcagccaaccacagttcatgcagttccccaagctggactgtagcagtgacctagtcatcgagataaccaaggccaagcacctccaagctgtaatgggttctgcttgtggcttggggtgcccagaggcccagcacatgctagaaatttgcctgtaccgagatcctaaagaggatgacttgcccaagtcctgatatttccattgctttcctgaaagatggtgaaatccacttctataaacctattctcttctgttaacttattctctatgtaagacatttctgatttaggcctatattaaaaattcttggacatcagtttttcccctgtactttgagttctgatgatctaatgttaaaatgtactattgttcatactttatcactgcacaaccaagtaatgaaatttaccaaggcagtcaacagttttgtgccttgtttgagaggaagtctaggaagacttctctatttactgagctagtttccctctacctatttaaaaactccaaatagtcttgaaacaagatttaaaaacacctgtggaccgttcttccattgctctttactgcacaattatttgcctgttgatcactgcttttacgttttgttaacattaaaatgtaaatcactcactcattataatactgtctttaaaaaaaacttcatttatttccaaatgttcactagggacttagtgatgtcacccacaggaaaaaattggattctccattttcttgatgcttcaaatttttaaaatagtttcacaacattatctcatttttttacatatcagtaacacagatgtagtcaaacaagaattcttgttcctgtgttacagatgtggaaactgaggcttgcccaaaactgctaagctgggaagtaagtggtgcagtcaggacttgagcctcagcttccacctctgaagcccatgttcttcccattaccccacgatcctggccaagaatcagggcagatgtgcatgatgggaagggcggcgtggatggattaggacagacctgtgcaggctcccagaaaaataattcaaaatacatttcctggtgatgacgggactttagcacatcttcagatacagaagagaagacatggtgcagaaaggatgttttgatcactgaccaaaactgtcttggagcttggaatgtgaatgtgttagagaaaagtgaagcagcaaagggcaacacgctctagcattttaagaggaaaaaacgcatggcaggggaagaaaggaaaggaaggaggatgtggaatatcccagaagtacctcccccaacccattaccctccactgcccgcttccctagccttggtctagtcagaagacttctttaggaaccatttggtagttccaaaaaacaacttagttttctttcttgatgcctttgggtacgtgcttttaaaaactaatccaaaattctgcaacataattcctacatacctacttagtttcagttcaggtccaccttttgcagggagctgttcctaaacattgcataggaacaggagcctgcccttcctcttcaccctcaccttcagtcctttcctctggcgttgctgtagagtgacagcttagagactcaagcccatctcatttctttggtggaggaagcatgtctaggggagtgcactggattgaaggtggctgccctggccagcccctgatcatggcattcgacatccccggacctcaagtctcagcaaggcttctctgacagccaacaggcatcagcaggatgctcagccatctctggatttcactttataaaataagtaccttggccaagcacggcagctcgcacctgtaatcccagcacttagggaggccaaggtgataggatcgcttgagcctagaagttgagaccagcttgggcaacattgtgagaccctgtctctacaaaaaataacaaaaattagccaggtttggtagctcatgcctgtagttccaactactcaggaggctgaggtgaaaggatcgcttgagcccaggagtttgaggctgcagtgaaccacgataccacaatggtgccactgcattccagcatgggtggcagagcaagacccttttttttttttttttttttttgagacggagtctcgctctatcacccaggctggagtgcagtggtgcaatttcggctcactgcaacctctgcctcctaggttcaagcgattctcctgcctcagcctcctgagtagctgggactataggtacgtgccaccatgcccagctaattttgtatttttagtagagacagggtttcaccatgttggccaggatagtctccatctcttgatctcgtgatccacccaccttgacctgcgtcatgagccaccatgcccggccgacagtttctttaaaaataagtaccagaattaattcatttttaacatctcctctagatcacaactgtggcttcaatataaaatatggaacaagtctgtctttcagatgtacaacaaatgtatataaaaaataatgggagaagatgacctcagctcttgaaacttgtaaacatttcagcaatcttgctctcgcaaagaaatccttaattctgcgttttcaaactttaagcagaactgacagccatttgtgctctctctgtttgaagtagttcttttcttttgagtcaagaatctttttccaggttcggctatttccttaatgaaattaatatttcacacagaatggtttcatgcaaaagtgctgggacgcctggagtctggatgttgttcctggaatgcttccacataaggagaattttagacaggggcagccagaatcctaccctatccagtggttcaaggtcttttctggcctcacgcttgctttgggcagttctcagaatgtgtgtgtgcacgtgtgcacatgcatacacacacacctttgattcgtcaccctcattcctccagtcatttaagtaggagctgataaaagaaagccttcagggttcacagtattgccttggtggggttttttttttttgtatgttgcaagaataaacacaataggggaaaattccaggcaaacgtggccattgccttgcgcgacaatagaggaaaattccaggcaagtgtggccattgccttgcatgacaatagaggaaaattctaggcaagtgtggccattgccttgtgtgactgccccactcatgtccatctggtcctggggcctgtagcctgcctgcacctcacagtcctaacagagctgttgacatccgtggagccccagaatttcaccaactgctagatgtatctttgggaagtgtattttgtggaacatactcagaacatgaggctgtcctttctacagctttcctccctagaccttctcaataactctgttcttaaatgtagacaagagcctgggatcatgaaaagcattgaaacctcagtaaccccgggacaaatggagaaccaaaatcctgtgcactggtgggtccttgggggaggagtaaaggggagtctaggagtcagggggccgtggggctgacccagtgtggaacagcaatatggcctcaggaggtgaaaaccacagatgggtctagctggggtacagagatggtaaggacaggaattccaaaggagctgagatcattgcaggggagacaaatgtgaaaactgtacactctggagcttcgtttctgacttcaaatcaggttctgccacatggcagctgtcatgtaacctctctgtgcttttgtttcctcactggtaaaatggagatggtagaacataggatggtgtgcgtcttttagtgcatcgatgtgtattaagtgcttagaacagtatctggcatagagcaagcattatatgactggtagctgttgttattaccactaccacggctgttcttattatcgtgattattatgactctcagcatagctataatgctatccatagagactgtagagttataatcgtgactactaaatttaagcagcatccttgcctggtgctgtatcatttttggacaccagagatatatttattcctgtctctagagagcgaaaaagcacctctctgtcagaatgactactttctactttaaaaatgtttttgatgataactcttgatggctttagataaagccatccttccaaaaggcctgaagcactctcagatggctccgttttgtcagccctttactgctctgggatgtggtctacccactgttaagctaatatttttgatcttcaatttggaaccttaattatgctgtacagcagtcgttgtacgtggatgcataaaattcccatcaaaagatattcagacactttccaggctcagtggtacgcaggagatggagacacacgtggaagggtgtgctggcagattcccgttgctctgagctgcgagggggtggggcaggtgcgagctaacagtggtggggcctcatgctgcttgtctactccttagatgactatgctcagctgtgtaacatccccgtgacgggacgccggcagccatatggacgggacgccttggttgacttcagtgaacagtatactccagaagccgatccctacttcatccaagaccgtaagcaaaataaccttgttcctttgatactaagttgtggttgaagattaatcagtggtcctcaaaatgtaatggcaacttgttagcaatgcagcatttctggtcccaccccagacctgctggtcagaaagtctagggtgggacccagccatctttgtttcacaagggcagtccttctgcgtgggtgagtctaagaaccactgcatcattcgtgagccgagatcacaccactgcactccagcctgggcaacacaatgagaccctatctcaaaacaaacaaaaagaaccattgcatttgatgaatagtcttgctggtggggatactgttatatttacttttcttaaagttttgagatggagtctcgctgtgtcacccaggctggagtgcagtggcacgatctcagctcactgcaacctccacctcccggattcaagcgattctgctgcctcagcctcccaagtagctgggattgcaggcacgcaccaccatgcccggctaaattttgtattgttagtagagactgggtttcaccatgttggtcaggctcttcttgaactcctgaccttgtaatccatccatcttggcctcccaaagtgctgggattacaggcatgagtcaccgtgccctgcctatcattataatttctataacaaaatcatttctcttctctttaagtggtggactagtttgagggccaaggtttccatgagagcccagttgtattgcagcctttttttcctacagggaaatgcaaatgttaactgtacaagttgatcattattataagtgttttagagtaggaggtaagagaagaattgcccttttggtcagaaatgactttttaaaatacattggtgaggggatttatggagtaagaaataatgtgtgccaacttttcctggattagtgagcacagctttcatgggggaggtgggagtgtgtatctgcaaattgtgatcccctttagaacgtaaatgttgtgtgaggaagcctacaaacacacaagctcaaatcagacttttcaaatacagacaatttgaagtctgaaacagcaggaggtccacaatgaaatattagtagatagtagatagtctcacttcaagaacgagaacaggaaaacgcccattttgagagcctcgtccacagctcacagaggggccatcctcacgtgtagcttcaccacaaatttttttttttttgagatagggtctcgctctgttgcccaggctggagtgcagtgccatgatcacagctcactgcaactctgcctcctgggctcaagcgatcctcccaccccagtctcccgagaagctgggactacaggcacgtgccactatgtgcagctaatttttgtattttttccgtagagatggggggtttcaccatgttgtccaggctggtctcgaactcctggactcaagtgattcatccgcctcggcctcccaaagtgcttataggtgtgagccaccatgcctggcctgcaccacatttttaagataggtaattgctgccgaccgaggagtttgacttaggactttagagaaaaatgcagtgaagcttttttctgtcctgggccctgtcacctgtgcacgaagcgtcctagccaggacccagttctggggcaacagcatgagatttctagctgaatttaggatctatttcagttctgcatcaagagcttttattttttttttccttctcttctctttctcttttccctttctctcccttcttcattccctccttgtccttccttcccctccacctttttttttttgaaggatgtagtgtattgatcatctggtagaattaaaaatgttttaaaatgtccatgataagaacattctattaatccagctaggctgcttaacacacgcctgtgtaactcccacccaggccaggagcagtgccagcctccagaaggcccctggtgccttttcccacccccctccctagggtaaccactatcctgactcctaacaccatagatgaacaacactctttcttttcatccacagcacataaccatgcagctctttatgaaatggaccagaatgcactcacagctacaagactgtgcacttagggtttgatgcttctctgtatatgttacgggtcagtaaacgtttacttaagaaaaaaggaagggagaagaattattaaggttgaaagaaagcccagcttgccccattaatcaggaataccaggttaagtctatatgcaactctgacaatcccgtggcttacagctttcctccctagacctcctcaataactctgttcttagatgtaagcaagagcctgggattatgaaaagcactgaaacctcagtaaccccaggacaaatggagaaccaaaatcccaggcactgatgggtcctgagagtctaaaagtcagaagcctctatggcattatagtttggattccaggaattttcatgttgaaatgtctggcttatgtaccttctttttaatgctggcattgctttaaagctcttttttttaattaactacacatgttaagaaataaacatgttggtgtcacatcaatctcttatttagcaacataggaaattgagatgcagttccaagacctccagcttggacgatgtaatggcctttacatttcttacaagttgcagagaaatatttcccccttcccagccagttttctgacctccagcaagggcttttggagcctgctgcaaaaatgattgtgttgggtagatagtaacatagacggaggctgagtgaggtttcttatcgcctttatggttcaccatctctgttacctttagggagagcagtacttctaaaactggaatttgcttgagcagagaataggcaaacatttgccctttataagggccaggtagtattttttttttttcttttttgagacagagtcttcctctcttgcataggctggagtgcaacggtgcaatcttggctcactgcaacctccacttcctgggttcaagtgattgtcctgcctcagcctcctgagtagccctgggattataggcatgcaccaccatgcccgactaatttttgcatttttagtagagatggagtttcaccacgttggccagggtggtcttgaactcctaaccttgtgatccacctgccttggccttccaaagtgctgggattaaaggtgtgagacaccgcaccgagcccagatggtaaaatttgtaggctttgcaggtcatgtggtttctgttgtaggtattcaactctactgtagtttcacaaaagcagccctagatagcacagcagcaaatgggcgtggctgggtttatttacaaaaataggtagcaggccagatttggaccagagactgtagtgtcctgacctgttttagagtcctgcagaagtattttggggagcctgcctgatgtgtggggagtttcaagttttactttttatgttttaatttctgtaataataaaaaaggtattagatatgaagtagaaatcattttgctgtgatacatgggatctgaaaatattgtcgtagattaagtctttattttgtgtgtttcttaactggctttgagtatgtggtgtcacttttttttttttttaaattggggtctcactatattgcccaggctggtcttcaccccatgagctgaggagattctcctgcctcagcctcctgagtagctgggactcttgttctcctttaaagttttaaaatgggcctgccatggatgtattactcaattttttttttatggtacaaatttttttaacttttaggttcaggggtacatataaaggtttgttacataggcaacatgtcatgggggttagtggtacagattattacatcacctaggtgtgaagcccagtacccaatagttattaccttttctgcttccctcctcccaccctccactagtgtctgttgtttccttcttcttctttttttttttttttttttttttttgtggtatttggttatatgagtaagttctttttttaaattttttaaattatactttaagttttagggtacatgtgcacaacgtgcagttttgttacatatgtatacatgtgtcatgtcggtgtgctgcacccattaactcatcatttacattaggtatatctcctaaagctatccctcccccctcccccaaccccgcgaaaggccctggtgtgtgatgttccccatcctgtgtccaagtgttctcattgttcaattcccacctatgagtgagaacatgcggtgtttggttttctgtccttgcaatagtttgctgagaatgatggttttcagcttcatccatgtccctacaaaggacatgaactcatcattttttatggctgcatagcattccatggtgtatatgtgccacattttcttaatccagtctattattgatggacatttgggttggttccaagtctttgctattgtgaatagtgccacagtaagcatacatgtgcatgtgtctttatagcagcatgatttataaacctttgggtatatacccagtaatgggatgactgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaatgatcgccattgtaattggtgtgagatggtatctcattgtggttttgatttgcattcctctgatggccagtgatgatgagcattttttcatgtgtcttttggctgcataaatgtcttcttttgagaagtgtctgttcatatccttctcccactttttgatggggttgtttgattttttttcttgtaaatttgtctaagttctttgtagattctggatattagcccttttgtcagatgggtagattgtaaaaattttctcccattctgtaggttgcctgttcactctgatggtagtttcttttgctatgcagaagctttttagtctaattagatcccatttgtcaattttggtttttgttgccattgctcttggtgttttagacatgaagtccttgcccctgcctatgtcctgaatggtattgcctaggttttattctagggtttttatggttttaggtctaacatgtaagtctttaatccatcttgaattaatttttgtataattttgtaaggaagggatccagtttcagctttctacatatggctagccagttttcccagcaccatagcaccatttattaaataggaaatcctttccccatttcttgtttttgtcagatttgtcaaagatcagatggttgtagatgtgtggtattatttctgagggctctgttccgttccattggtctgtatctgtgttttggtacgagcatcatgctgttttggttactgtagccttgtagtatagtttgaagtcaggtagcatgatgcctccagctttgttcttttggcttaggattgtcttggcaatgcaggctcttttttggttccatatgaactttaaagtagttttttccaattccgtgaagaaagtcattgctgtttccttctttgtattcataagttcttatcatttagctgccacttacaagtgagaacatgtggtatttggtattctgttcctgcgttagtttgctaaggatgataggcctccagctccatccatgttcctgcaaaagacattatctcattcttttttatggctgcctagtattccatggtgtatatgtaccatattttcttttttatcccccaaacttatgccaaatctcatttaatctttacaaggtagaaaagtgttcattcattacaaaatacttctactgagtgcagacattgtgttcaatgttgggtatgccattctacatagcatcgtttctctatttttaaatgaggaacctggtttcaacaaaatcaagtgacttggccagggtcacaggcatgagcagaagaccgagttcctctgattcaaatcccatggttcatttccacaaaataaacctataactgagtggggctttagagatcctaaaattcagtgcttttacttcatacgtgagaaaaataagctttctgcccaagtttacaaggtacacatagggaaatgggaatgggaactcaagtcccccaataccagtgtattgttcttacccaaacagataatttaagattcacttattgtatatttttcggtcatctctaaaacccactttcttctctgaagggcatgctctaaagtttcttcttcacctatctcccctcagggcacctaatcttagaatgtaagagaaactctgaccaaatttgtcttcatgttgacctcaggcactttagtcattgttgaaacttcttttttgttgtagttaagagaagtaacaagtaagtctttatttccttgtttagaaaaaaaaaaaaaaagctggctaagttggttgctttttggtgatcaaggagaccaaactccatatccttgtccaattcctccaagttagaccttattgccctccataagcaatgatattttgctgcctgctgccccctgcagttccactggagaattacttcaaaggccagatagaaagttctagccatatattttttttttttttgaagctactttgtggtactattgggaagagacaggagatgagaggccacatgacagtgtgttgggtcactgtggatttatgtttagaactttcctctgcaaaatgagagctaaacactcttgatgcctggctaaattgtttttacatcacaaaaactctaaagtctagctctgacttggtttcaagagatctaaactataaaaagagccaaacaagagtttctttgtttccttaaaaaaaaacttttggttctgtttttttttggtgtgtgtgtgtgttttgttttgttttgttttttggttttttgtcttttgtttttttgacagagtcctgctctgttgctcaggctggacagtggccgtgatctcagcacactgcatcctccacctctcaggctcaagcgattcttctgcctcagcctcccaagtagctgggattacaggtgtccaccaccacgcccggctaattttctgtatttttagtagagacagggtttcaccatgttggccacgctggtcttgaactcctggcctcaggcgatctgcccgcctcagcctcccaaagtgctgggattataggcatgagcccagactttgggttttctaaacacaagtatgatgttctttctcattcatcaggatgttttgaggcccttttactgaatttttcctttgatcccctgggagcccttttgtaaggctcattccgtagccagagcaaacaaacacatggcagagccagcctgcttctctctggtcttacaaacgccggctgaaaacgtattgcctcacactcttacggaccttcttagcaaatgcttactagactccgatagtgaattctgttggttctgttctgagagtctgacacttgccctactgcaaactcacgaagtttggaactttggatgaacacttttaataattaagagcaaaaacaaaaaccatacttgctttctcgttttatgtgattttaacatagaatatcagaattcaaaatgaggctactctgcacaaaatatacaagttttttatttttatgctattttacacagcaacattcagtatttctaatgctaactttaagatgtctgaaatatgtatggacatatatgtgtctatttggaaaatgaaccatcatctaaatatcatttacaaaatgatataggaagttgagaagctctaacttagcttctgccctttcctttccaggttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcggtaagaatgacgtgtgttttatgggacattaattttttcctgacaccccgtatctcagtcagtagagaacatttaagatagatttgctgagtttcagtttgagaagatgagaaaagttctggagatgtacattaagtacagtatgaatatacttaatgccactggactatatacttaaaaatggttaaaatggtaaatatgttctgtgtattttaccacaattcttttttttttttttttttgagatggagttttactcttgtcgcccaggctggagtgcagtggggtgatcttgactcactgcaacttctgcctcccaggttcaagcaatgctcctgcctcagcctcctgagtagctgggactacaggcacccgccaccacacccggctaatttttttttttttttttttttgtatttttagtagagacgggatttcaccgtgttagccaggatggtttcaatctcctgacctcgtgatccgcccaccttggcctcccaaagtgctgggattacaggcgtgagccaccacgcctggcctcttctccatcttgaagcagtccttttgcccactttgcttttgttagttttaatccatggtgtgtctgtaaaataggtaacctagcttcttaacagatgtttcaagtgagtgagagcctaaatgggtctcatgtagaaggaggtctgtgaatgttatggaaggctttagacaggctgtatggagaggcctctgcgtaggtatctggttcctcttgacaaatctagcagttcctccatacctatgggaaggaatttggaagtaatatagttcctccaacttccttgaggttctactagaaaatgtcaagctcacaaaatgctcatgttttgctagataacagtgaaagaagttctagaacctccctgataatctgcctctttaagatctcaaaaaagtcatcttcgtcttgtctgtgactgaagcaatgacgagaaagcttccttggggtggtcgggggaagggcctcaggtaagcctcaggttatgtgtcctcacagaataatatccaagattgtttacctgcatggcttgacttattgcagatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggaattgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaaaattctacctgagagtaattgtcaatgagtacatgtgtataagttgtatcccactctccccacttttatcttttccagtggtcttctgttaatgtagtgtcttttacaagttaatcattaaatttgttagatcttgttatgggct

SEQ ID NO: 36233 - DNA, 452182 bp, Homo sapiens; identical to SEQ ID NO: 36232

SEQ ID NO: 36234 - DNA, 87242 bp, Homo sapiens
ggaaggggacgcgaaccgtcctggtcccatccgagccgccgtagcgcgagtgccgcgggagttcggcagcccaggtcgccaaggcaacgggctccgctgcgggttgcgggctgcgggcgctaggctgccccggggaggcgctgcggaccggcggcccaggcacggagaggcggcgagaccgcaggtgagcaggagccgggcggccggttgcggccccaacgctccgggcctggcgtcgacacgtcgcagggggcgaggggctgagccgccggggatcccggggagggaggctgcggcccgatctttgtccctcagccgcgccggggacggcgcccccgacgccctttgaccccgccccgcgttcagggagagtccgttttcggctgtttattatatttgtagccattggtcgacctcattcgaaagtttcttaaaaaaaaaatcccttcttgtttgggggccagaaaataactcaaaactgtgcagaaaatttatttgtgtgtgtgactcttctggggccagagaggattgacttctttgtgcgtcagttttatcgtctgcaaaatgggaatcatggtagcacctgtctgatgacgttattacaaggtaaatttatatttaaaattcgtggaggtaagccctcaatacatgggagcttttattattactactactacaaggaggaccatcactgagcatttattgtgagccacggcccgggctgatagccagggtaaaaaagtgaacgagagacatcgtgtcctgagggaactccacagttttccggaggagacagactcgtaaacaagaattcacagtgattccggttatgattttggacatacaggggggctgtgaatgcacagagaaaacagttaacctggatttctggaggtgaggttagtgtggatgatcagggagagatgccaaaagaaggtgacttccaaaatgagacatgaaggctgtctttatgttggccagaagatgaggctggtggagtgtaccttgctgtgggtagataaagcaggtagagaaagtaggtagagaaaagccttggggagagagtgcagacttcttgggaatctgcaaggatttcaggctagctggagagcagattatgagagttggagggggtctggctagatggtgtttgagagacaagcaggtgctcctcctgaaagactgtaagtgtggaggagtttgggctttgtgttgggggcagtgggaagccatcaaagggttttaagccggaggtgtgtgtctttgatcagaggtatagtttcagaaagatcagttttttgtgtttctctcttggtcttatcattcctcccatctgtttttcactttgcaggcattcatttgtggtgattcatatatatgtgtgtgtgtgacagtgtgtgcgtgtatgtatttattgttgagatgaggtctcactatgttgcccaggctggtctcagattcctgggctcaagtgatcctcctgtctcagcctcccaagcagctgggactgcaggtgcacaccactgcacctggctaattcaaaaaatatttaatgagcatcttcttctatgtgcaaggcactgtgtaggtagtaaggaagcaggtccctgccctcaaggagatcacagattggtggagaaaatattcatcaaacaagtgattataattgtgatgagaattgtgaaagggggcgcatgttaagatcaatctagcatagtttggagattcaggtagagttttgataaaatgtatggagggtgtagtctgagttagctatcgtggggatgttccaaacattttcaaaagtacattcatggagccaaaagcagtccactacaactggaacttaaagatcaatattgaaagagatccatccagagaggttgacaaaaaaaaaaaggctgagattattcagggctactgcattgcatactcttggaagaatgagccatgcacttagtctacactaaaagaaatggctagagaaacaggaacaggagagaaaccagcaaagtatagtaatgaaggccaaagggagaggttggttggcctttgtagatgttgctgagatgtcgagtaatacaagttaaaaattaaaatgtgtccttttgggtaaataaatatggaggtcggttgggacctcattgagcagatttggtgaaatggttggggcggaatctataatatcagcagctttcaaaggttcaatataatatatcagtgggatgagttaagagtgggatgtgagaaagacaaagtgtaggcagctcagagaagtttggctgcgaagggaggtagagagaaggctgaggagcgattggggaataggtgaagtttttttgagcatgagagagattaaatgctgttggcaaagagccagtggagagagagaaaggctgagaagacacaggatatgaaagggagaattgatagtataactttcctgagaaggtgggagtggaggagctccacagtacagatccttcaataggagtctgatgcctgttactttttggagacgtgggaagccaggttattcctgaaaggagtgcaccagtgtaatgcaacaaaaataaataaaggtataagtgtggaaggaaagtcacaattttcattgtcggcagatagcaggcatttattgaactagtattgtgttaagtacttttcatgcaccattcttttttttttttttgggacagggtatcactctgtcgcccatgctggagtgtagtggtgcaatcttggctcactgcagcctctgcctcctgtgctcaagcgatccacctgcctcagccccccaagtagctgggaatacaggtgcgagccaccacactcagctaatttttgtatttttagtagagatgaggttttgccatgttgaccaggctggtctcgaactccagacctcaagtgatccacccgcatcggcctcccaagatgctaggattacaggcatgagccactgcgcccggcctcatgcaccgttcttaatgaataatgtgatgtttacaacaaccctgtgagataggccctctaataattgcaaatttatggataaagaaactgaggtaacatgctcactcagggtcacacagtatttgaatctaggtttacctgaacccagagcttttactcttaaccactacctggatgatataaatctctacctgtgatatgattgtctgctgagaaaattcaagagaattaaactaaaaatacttagatataataaggctaagtgaacagcagttataagatagacaaaaagcaatagctttatgcaaacaaaaatagaaaatgtaattgtaggagaactgacaatagcaacatgaaaaataaatacttagaaataaacttaaaaatacatgtacccagcttagccacacagagtaagagttggctgggcatggggatgggatgacaggatgagtaaggtaaagtagttttcccatgggaacatcagagtattgatactggagaaggggtaggttaaaaaaaaaacaggtgtctatcataagacatcatgagatattgactatcatgtttttataaaattgaaaaattggcctggcacggtggcttacgcctgtaatcccagcactttgggaggccaaggcgggcagattatctgaggtgaggagtttgagactagcctggtcaacatggtgaaaccccatctctgctaaaaatacaaaaattagctgggtgtagtggtgcacgcctgtagtcccagctacttgggaaactgaggcaggagattctcttcaacctgggaggcagaggttgcagtgagctgagattgtaccattgcactccagcctgggtgacaagagcaaaactccatctcaaaaaaaaggacagttaggtgggagctatatatattagaaagatgtttacattatgtggttaggtgtaaaaagcagattacggtacagtatgttactgttttcttaaatgtatacatgtttataataaaaatgtctggaaatactagttctttttaaaaatgttaaatctttaattgtgataaaatttaccatcttaacgatttttaagtttacagttttgtagtattaagtgtattcatgctgtgcaaccaatctgcatgactttttcatcttgcaaaagtgcaaaagccaaactatacctttaataggtttagctccccatttccgcctccccaccagcccttggcagcacccattctacttttgttttctatgtgtttggttactctggatacatcgtgttagtggaatcttgcattatttgtctttctgtgacgggcttatttcactagcatagtgtcctcaaggttcatccttgttgtgtagcatgtgtcagaatttcattctttttgtaaggctgaataatattccattgcatgtttataccgcactttgtttatccattcatcgatggtcactttgagttgcttccatcttttggctattgtgaataatactgcagtgaaacataagtgtactagaaaggtaagctgtttatgagatcatggggaaacttttattctgttcctcattgccctaattttccttttttatgagcatgaattgccttcataatcagaaaaaaaatgaggaagtatcttctttaggaggctggggaaataagggtaaaaaagggcagtggcagcggaaagggaaaggagagggcagatttgagagacatttcagaaggagaatcaacaggacttgaccaacaagaggtaagggagagaggagtggaagatgaagctttcctggcctctggtgggaaggggcatcagtcctggtggggctttgactaggggaggagggaggaaataaggctggagagccacccaagcctttgtttagcagtttggacttctagaaggtggagagaaaccattgaaaggaagtgaaatgacttgatctgatttgcacatagagagatgacactggctctttccaaccattctttaaactgaaggcagatagtgccaggtatccctttgtgttgcttatacttgaacttctgttaatttccttttatttgagatgaacctttagtactgaagtacacatatctattattctaaaagcacctggaatattttaaacaatgttttagtgtgtgtttttttgttttttgtttttttgtgtgtgttttttgagacggagtctcgctctgttgtgcaggctggagtgcaatggcaccatctcagttcactgcagcctccgcctcccaggttcaagcaattctcctgcctcagcctcccaagtagctgggattacaagcacttgccattatgcccggctaatttttgtattattattattttttttgagatggagtttcactcttatcgcccaggctggagtacaatggtacgatcttggctcaccgcaactgccacctcctgggttcaagcgattctcatgcctcagcctcctgagtagctgggattacaggcacgcgccaccacgcccggctaattttgtatttttagtagagacagcattctccatgttggtcaggctggtcttgaactcccaacctcaggtgatccactcgccttggcctcccaaagtgctgtgattacaggtgtgagccactgctcctggcatttttgtatttttatagaaatggggtttcaccatgttggccaggctggtcttgactcctgacctcaagtgatctgcctgcctcggcctcccaaagtgctgggattacaggcgtgagccaccgtgccctgcctgtgttcagttttatctcaataacacagtctcctgtaaatatacttacttttttttttttttgagacagagtctcactctgtccctcaggctggagtgcagtggtgcgattttggctcactgcacccttcgcctttgaggttcaagtgattctcctgcctcagcgtcccaagtagctgggattacaggcacacaccaccacaccggctattttttttttttttttcatttttagtagagacagggtttcaccatattggccaggctggtctcaaactcctgaactcagatgatccacccatcttggcctcccaaagtgctgggattataggtgtgagccactgcacccagccatcctgtaaatatactttctgactttagtaggagaagtatgaataattgggaaaataaatgaaacaaaaataattcaaggtagagtatgtcacaattctgttaaaattttaaaatttaaaatttttcacattttactgaattctgacagcctccttttgagagaaaaaggacaatataaggtatacagtgtcatattaaggaactcttacaaaatgaaaatttggagggtccagatggattcagcccgtcacttagctccactcccacaaacctgtagtctctgtctacttccagagcattacagacagagggagctaactgttgtgctaacatttgtaaatagctctgcagtttagaagagctggatttccaaaagatgtaaatccatgatatcattttagtcctcctaacaattctgtggggtagggattatcattcccattttcaaatgagaaaattgaagatcagaggatgtgacagatccctctcagatactatatctaataagtcctggagtttgaatccaggttttattttcttcttatattttagcattttattatggaaaagtttaaacatacaaaagtagaaaagataataaaagacacctaatatactgagctttagcaattgccaacatatggtcacttttattttatctatactgcctacttccatcccaccttaaattatcataaagcaaatcctagtcatcatatttcatccatgaatactgtacttcaatatacacatctaagagagaaggattttttcctcctcctttcccccctgtagtcacagtttcattattacacctaaggaaataaacagtagtcagtcctaaatattacataatatccatttggtattcagtttcctcaacaattttataaatgtctttctaaaaaaatgtttttttcaagatggagtctcgctatgttgctcatgctgtacttgaactcctaggttcaagtgatcctcctatctcagcctcatcagtatctggaaatacagatgtgtgtcagtgtacctagctttttttttttctttctttttgacacagagcctcactcttttgcccaggctggaatgcagtggcgtgatctccactcactcactgcaacctctgcctcctgggttcaagcaattatcctgcttcagccacctgagaagctgagattacaggcacgtaccaccataccccactaatttttgtatttttagtagagacagggtttcactattttggccgggctggtctcgaactcctgacctcaggtgatctgcccgcccacctcagcctcccaaagtgttgggattactacaggcgtgagccatcatgcccggcctgcccaactttcataaatgtctttttacagttggtctgtgttcactgggatccaaacaaggtgcctgtattagacctgattgatgatctcttaaatcaagcttgtccaatccgcagcctgtgggccaaatgcagcccaggacagctttgaatgaggcccaacacaaatttgtaaactttctttctttgttttttttttttttgaacgaagttttgctcttgttgcccaggctggagcgcagtggcgtgatctcggctcactgcaaccttgcctcccatgttcaagcgattcttctgcctcagcctcctgagtagctgggattacaggcgcccaccaccacgcccggctgatttttgtatatttagtagtaacagggtttcaccatgttgaccaggctggtcttgaacttctgacctcaggtgatccacctgcctcggcctcccaaagtgctgggattacaggcatgagccaccatgcccagcctcaaatttgtaaactttcttaaaacattatgagattttttgtgtgtgtgattttttttcttcttccaatgtggcccagggaagccaaaagaatggatacccctgtttaaaatcttcttaatctatagccatttctcctcttcttttttccccctttgccatttatttgtttaaaaaagtcatatcatttgccctatacaacttctcatattctgcatttgactgattacatctatttatttatttatttacttttcttagatggagtctcgttctgttgcccaggctgctggagtgcagtggtgtgatcttggctcactgcaacgtccacctccagggttcaagctattctcctgcctcagcctcctgagtagctgggactacaggcgcatgccaccacgcctggctaattttcgtatttttagtagagatggggtttcaccatgttggccaggctggtcttgaactcctgacctccagtgatcaacctgcctcagcctcccaaagtgctgggattacaggcatgagccactgtgcctggcccagtttttccaatatttaaacaaccaacctgtgctatagcaagtttcccagtcaaggattcatttatgttcaagcatgctacttataaaataatacagtatattgatccatttataaaattatgcaatatattgattcattttagaatttcctttaaaggctttcttgggtgactaccaattaaccaaaattaattacgttatcccaatgaccaaattaatcccctggtcaaattgaactggatacatgagttatgtgaaaaaccttccaggggttttcacatgtactgatgtttttgttttgtttttttttgtttttgtttttgtttgagatggagtctcaaacaaaactccagtttcccaggctggaatgcaatggcatgatgtcgactcactgcaacctctacctcctgggttcaaagattctcctgcctcggcctcctgagtagctgggattacagctgcccaccaccatacccggctaatttttaaaaatatttttagtagagacaggatttcaccatgttggccaggctgatcttgaactcttgacctcaggtgatccacctgcctcggcctccccaagtactgggattacaggcatgagccactgcgcctggccgtactgatgtttttgattctctggttatacttgaggtagagtaaatgattctaaccagcactggaaccattaaaggaatgtagggcctcgtcagtattagttggttggagaggggaaggaagttaggaccaggcaggaatgagtgggtggagaaactgactcagccgtttggttggcttctaggcatgggaattcagcggagggagccagacctcctatgcatatgatggtagcaagagtagccctcattttattcctgccctttctaatcaggataggcttaggacatgagcagtgggatgtttagtgacatcggcaatgaaggactaggaaatacagactttgatttattttttaagtgattctccatcagctgtgtgcttttaagactagactatgggtttttttgttttgttttgtttttgagactgggtctcattctgtcacccaggctggagttactgtggtgcaaccatagttcattgccacttcaaactctgggactcaagtgatcctctcacctcagcctcttgagtagctgggactacaggtgtgtgccaccacatccagctaattttaaaattttttgtggatacgggatctctgtatgttggcctggctggtagactgtgtttttatttgaatatttgtaccaaaacttaacattctgctgcttattgattatattttactacctaagaaaataaatatgtattatttttaattggcttatataaaacataatacctgttttcttgtagcttttaagtaaaatttgaagcattagatttttaagtgtaggttctttaggttctttttttttttttttgagacggggttttgctcttgttactcaggctggagtgcaatggatcacggctcactgcagcctcgcctcccaggttcaagcgattctcctgcctcagcctcccgagtagctgggactacagaggtgtgccaccatgcccggctaatttttgcatttttagtagagacagagtttcaccatgttggtcaggctggtcttgaactcttgacctcaaatgatccacccccctcggcttcccaaagtgctgggattataggcataagccaccactcccggccaagtatagcttattttcttatttgtaatttattaaagccaaagacaccaagattgaaagcaactgaaaatgaaaatgatatttccggggaggctaataacttacggagctttcctgtggcctcagggtcattgttctctgttagccaatccttagaaattgctagaactcataggaatgcagagttgtatgatgagaagaacaagaacttgggtttcagggagatcagggtaaccttgggcaaggtctctgagtctaggttcccttatctgtaaaatgtctcatgaagtcatgtgagagttaattgttataaagcttggccactcgaaggggcttaatgaatgtgagttatcttcctttctcccagtcctgattttgcaaacctacctactccgtgtttctgctaatcaccagaatgaaacttaaaaaaaaaaagaaaaagctgatggtttaatcttgattttcagtgtcagttaagcataaaataattctattgttttcttatgtgcataaggcttaactttcattggtttttgatgatctctgcatgttatatatggtacatattaaatatagtggccatatttttttttaatttcttttataatatttttttcgagatggagtctagctctgtctcccaggctggagtgcagtggcgtaatcttggctcactgcagcctcagcctccgcctcctgggttcaagcaattctcctgcctcagcctccccagtatctgggactacaggcatgcgccacaatacccagctaatttttgtatttttagtagagacagggtttcaccacgttggccagactggtctcgaactcctgacctcaagtgataggcccacctcaccctcccaaagtgctgggattacaggcgtgagccactgtgcccagcagctatattttataaaccaaaaaattgggacttgtggtgtgataagtatagtatacttaggaaggttaggagaacagaatattttgaagaagtgcactctcagagaaatggtcgctgtgcttttatgtattcataaggaagcagtacaaagttgtggttaggaatgaggccctagagtcctttggacatgaattcacatcttggcccaggcactttctacttactgcacaatatacttaacctttctaagcttcagagcttcctcacttgtaaagtggatattatgagagttccttgtttcttgtgaggattgcatgaaataaagggctcagcacagtcttggcagatagaacttaacatgtaaatgtcagctgttatgtttattactgtaaagcctttgatacgtgcacacttatacagtaaactttttttttttttgcaaaaacctgttcaaaaagcacttctaaaataactcaatatttgcaaacttactctatagtaagttctttatcaggcctcgtacagaaagggcacagaaatattttgaagaccgcatgccctgtcttgcatgcccactgggaagacctgactgactttggccttctcaaaatatttgcataactctcagcacctactccattgcttctgagatgacctctgcaacgtgtatatgttttggctgatacagccaaacttgtcctggacagacttcaaggttcacttaatctactgtcacaggcttctttccctaagattttcttggttgtgccctccctagagtattggcttcttcctcaggctagcagcaaaatagctgcagtaggcctaggccccagatttatgtatggcacccacctaaggaatagaaagattgtcttggctgggcgcggtggcttacacccgtaaaatacctgtaatcccagcactgtgggaagccgaggcgggtggatcacctgaggtcaggaattcgagaccagcctgaccaacatggtgaaaccccgtctctactaaaaatacaaaaaattagccgtgtgtgatggtagacgcctgtagtcccagctactcgggaggctgaggcaggagaatcgcttgaacctgggaggtggaggttgcagtgagctgaggtcacaccactgcactccgacctgggcaacaagagcaaaactccgcctcaaaaaaaaaaaaaaaaaagattgttccttagagtgagaatttttctcagaagcctccagagaactaccctagaatctcattggcctggactgggtcatatgctcattcctgagccaatttttgttagtagggcaatgtgatgccctgatgggcttaggcctggttcttgaacaagccatttacaagagggatgaaattatctctagaccattcagaaacagaattgtgtttctgttaggaaaatttttttttttctatgagtaggtgaatggacgctgagtagattggtcgaagaggaattgtgttggctgctgataacagtgctttaaagaagacaggttatttttctctcaaaaaatattaagtccaaagtagatagtctgttcctggcatggcagttccacagtgccatcaggcagcctagatctttctctctttctgtttcaccatgcttatcacacagcttgcagtcaccaagtggtcgcacgtgttggctctggctctctagccaaacggtctttgaggcaggaagaagtaggaaaggggagggcagaggacaccctttaaagtaccctaagtcccaaccaccatgttcagtttacatctcattgtccattcttacttgtgaagaaggctggtaaatgcagtttcttagctgtacacattgccattccccaaaacagggattctgcagctgtggaagaatgagaaatagatacaagcctggaagtgggcagtgcccaccacaggaggcggccaacaatgtcagctataccctgtatttggagaaaattgcagtttttacattgactttcctctttcttttcttttcttttctttctttctttccttccttctttcttttttttttttttttttttttttttttgagatggaatcttgctctgtggcctgagctggagtacggtggcacaatcttggttcactacaacctccacctcctgggttcaagcaattcccctgcctcagcttctggagtagctaggattacaggcgtgccccaccatgcccagctaatttttgtatttttagtagagacagggttttgccatgttggccaggccagtctcgaactcctgacctcaggtgatccacccaccttggcctcccaaagtgctggggttacaggtgtgagccactgcgcctgcaatgcccggcctgcattataaatatttgttcataatgtgttgctaacagtgacaatcaataagaatcaactgggtttgttccccagcctgtttagttttattattgtgattacaaaataattaaatattatgttaaccaatgaaatgtaaagggaaaaaggaaaaaagatactgcttttatgaaaaataagttgaatgtgcttacctgataaaggcaaatggctaagaaaaaatatttttgtcaaattaggggtggaagagacctctgaaaagattgaagaaaaaaattataaaaatatggagattctgacagatagggtaactctcacctgtaatcctagcactgggaggctgaggcaggaagattacttgaggccaggagtttgagaccaatctgggcaacagtgagaccccgtctctacaaaaagaaaattagccagatgtggtggtgtgtccctgtagtcctagctacttgggaggctgaagtgggaggatcacttaagcccaggagtttgaagttacagtgaactatcatcacgccactgtacttactccagcctgggacacagagtaagaccctgtctccaaaacatatatatacatatatgtttctgccttcagaacacttcacaagtatcattccagtaaaaactgaaaatcatagatgtacatcatgagtgtagttcatgcagaaactttaattgcttgaacttactctcaagaaaaggccttcactgggcacagtggctcatgtctataatcccagcactttgggaggctgaggcaggtggattacttgagtccaggagttcgagacacaagcctgggaaatacagcaaaaccctgtctctacaaaaaatacaaaaattagcaggttgtggtggtgcatgcctgtactcccaactactcggaggctgaggtgggagaatcacctgagcccagggaggttgaggctgcagtgagccatgatcatgccattgcagtccagcatgggtgacagggagagaccctgtctcagagaagagaaggagaggagagaggagaggagaggctttcatcccttagccagtatttggaaaataaacatgcatttttaatgattcctctctttaactgtattttttaaaaaatgagttataccattattagttctgattccatcaaggagagaacttctactttgtttcttaagttgttatgtatgggttactgtgtatcaattgaaatgaatatcaccaggccttattgttggtcattataaattgtgccctggtgaacttctttccagagacatcttctctagtatattttttgtttttttgagttcttttttttttgagacagagtcttactttgttgcttatgctggagtgcaatggtacaatcttggatcactgtagcctctaccttcccagttcaggcgattctcctgcctcagccccccgggtagctgggactacaggcatgcaccaccactcccggctaatttttgtatttttagtagaaacggggtttcaccatgttgaccaggttggtctcgagctcctgacctcaggtaattccacccgtctcagcgtcccaaagtgctgggattacagatatgagccactgcacccaggcccctcactgattttaaataatgtgaagtttggaatgtctcagggagttcaatgtaatggaatttgtcctgatgttatttctttttccaaatcacatagcacttcaaacttttctttttataacatttctcataaatagtcctcctccataattacctttgtgtttattttgtgtctgctactaaactcttagcttgttgaggacaggagtccttccttggacctctgtacatcctaacatacaatgggtgctcaatttatgttcatggaatgagagaatgaatcaatgtcactgtcttctattattgcatagacatcttcagtaacacttcctttgaattcattgtcagtggagctagtcttgtagccttttcaatagcttacattccgtgttggagcaaaaaatgttaaatgtttataaggtaatttcaaatataagcaaaagtagagagaatggtataaagaaacctccattatctataatcaagcttcaacaattaccagcattttagagcaaattttgatttaggataagggtagagagaatatgatgacatcaggatgctgattttgattttgtggggagagaagcaggccatgtgtggtgagcagggtagagaaagaggaggctggtggcccaaatacaaacctgcctcataggagttgtcttgaggatcacttgagttgacataggaaagtgggaagaacaatgcctcacacatggtgagtacagcctaagtgctcccaccaccattactatcactcctgcgtagtttgtgggagctgaatgtgggagctgtggcacttactaacttggtgactttggacaccgacctttctgagctgcagtttcttcgtcggaaaaaatgggaatagtaataacatcttaaacatagcattggcggggcgcggttgctcattcctgtaatcccagcagtttgggaggccaaggtgggcggatcatttcaattcaggaatttgagaccagcctaaccaacatggtgttggttttaatggagaaccctgttctccattaaaaataggctgggcatggtggctcatgacttgtaattccagcactttgagaggctgaggcaggcggatcactggagatcaggagttcgagatcagcctggccaacatggtgaaacctcgtctctactaaaaatacaaaaaattagccgggtgtggtgttgtgcacctgtaatcccagctactcaggatgctggggcaggagaattacttgaacttgggaggtggaggttgcagtgagccgagatcgcacaactgcactccagcctggatgatagagcaagactgtctagaaaaacaaaaaaacccaaaaaaggtagcatcttatcccacacaggcagtggaataatatatgtaaatatgttctgggttaattaacattaatcacaattttccagagtggttttctagtctggagggagggaccatgtttctggaggttttttcgggagtcaagccaattccttctgtgtattctcattctgagacttcataatattcgtggcagagtcatttgtcagcctagcaaataaacattacaggacaataggctttgtttccgtttgcaaaatgttttttaaataatgaaaacaattttactttatgtagcttgtccatatatgcactgaaaatgaaatacttatcaaccaagttgataaagggataaaaatagttttcctaaggaaaactatttgctggggatttgtgttggacaagttttgtagcagtctgtttccccgtctttgaaatataaacagcatctttatttgtctagattttgcttataacaatttgctcaactcctaattaaagatagctctgtcatccacacatcacttagctactttcctaaagccagaatttctttagaaaatcagttttcttttaagacttcaaaacactttgccttctccttagtactataaagaattctaattatgtaggacattcatccagccactcctcccaccacacacacacacacacacacacacacacacacacacacacacacacacatatatctgtctgagataataattagatactgtgggaagagaaatgaaatatccctgatggttttaataattttctgcagtgtttgtttggacaagaaaatcagctgtcacatcccctgggtatgagagttatataaacccagatcagaaagtcaatgctgcagacttaaattctcaggaagttttaaaacttttaaaactaccacttgccttttggatttgactttttaaaagtttgatttttgctttttcagatactaaacttttggcattcttagtatttgtgatttatagcatcttgtacttttatagacttacttattcaaacaaactaaacccccactctatgcccagataacaaaaaaacacgtacaagatacagttttatctcaaaatgagcaatatcctgaagctatcatttggtcccagtgacatatgaactgttcgtttttttccccatatactgttctgtgtaaatgttctattacacagtctttttttctggattatttttctggagatttcgttatactttgttgatgtttcttttcaaaagctcccgcacaaatcatctccagtagtcatccagccagtgttgtactagaagatgtgttacttctaatttaaacttccatttaaggcttgacgctgtggctcacacctataatcgcagcactttgggaggccaaggcaggaggatcacttgagcccaggagttcaagaccagcctgggcaacaaagtaaaaccccatctctacgaaaaatggaaaaaaatagctgacatggtatcacatgcttgtagtctcagctacttgggaggctgaggtgcgaagatggcttgagcccgggaggtagaagctgcagtgagctgtgtttgccccactgcaccccagcctgggtaacagcatgagatcttttctcaaaagaaaacaaacttccatttgagaaagtgacagaaaagttttggatttttgtaattataggaattctttacttttctttgataatattatatctctttcagtgaaaagggagttaggaagagatctaaatgtactctttgatcttccttgttaatcatttaaaaatggaattcggagctaattttaacttctgaaggacctgggggaattttatctagcacctgaggtataccttagttttttatgtattgaatctttaggaccagttttattctttcatttaaatatgtagtgagcatctagtatgtgcttaccattgtgctgtgtgtttatatatattatctcatttaattctcacacaagcgttgttagatacataaaaggggacttcaaaaaattcatggaaaaaattgaattaaaagataaaaatgaaaaatataaactttatttctcaatataaactccatcaagttcaaggcaatattgtagtgatgataccggccatttagcccgtccctaaagaactgagggttctggaaatttagccatattaatgcagtcttttttacattattaactgaaaaaaaaaatggattccctttaaagatttcttaagattaggaaacaaaaagaagtcagaaagagccaaatcaggactgtaaggtggatgcataatgatttctgtgcacagtgatttcccattgaaatctcgcaaaaattgcccttgtttgataaaaggaatgagcaggaggagtgttgtcatggtggagaaggactctggtgaagctttcccaggcgtttttgtgctaaagctttggccactgtgcccagccacaactttcattttgttaagtcatctaatccttacaactgctccatgaaataggtactattattatccttatgttacagatggagaaactgaggcagagagcgggacagtaacctgcctaaggtcccagagctctagagtcagtggtcttaacctctattatgacctctcacttaatgagggccagatttcccctctagctttttattatgaaaaatttcaaatgtggaaaaaaattaacaagagtacaatgagcacctgtatcaaaaacctagcccaaacaattgttaacattttgctgcatatagtttatctgcatgtgtgtatttcaattttttgctgaactatttgaaaatatattatggacattataattcactccttaaatacaaaacaaagcaacattttcctgttttttttttgagacggagtcttgctctgtcgcccaggctggagtgcagtgatgctcactgcaagcttcgcctcccgggttcacaccactctcctgcctcagcctccccagcagctgggactacaggcacacgccgccacgcctggctaatttttttgtatttttagtagagacggggtttcaccgtgttagccaggatagtcttgatctcctgaccttgtgatctgcccacctcggcctcccaaagtgctgggattacaggcgtgagccaccgcgcccggcccaacattttccttttacttggtaaatgcattcttggaaaatacattgcctctaaaatcatgcaaaagtactttgctacagacaaaaaggagtggagttctaggttcagataactgtaaagagctttacatgagtatcttgatatttaaaaatcaagcagagtaaagggacaatttttgtttctataagacagcccctcaatttgctggatgtttaacatcttggtctctacctactaaatgcccatttgaatgaggagacaattgactgttgtgtcaaccaaaaaatgcctcccatcccctccgtttccagaaagtcctctagccagctgtgcctgttgagtgtcattgacttgactggtcttctgctgaaggagctataggttaaattaaaataaaatgtgctgtcacagaatccttatcatcatgattcagagttgaggtaataaaggtggtagaacttatctgtaattctcctttagttctacaaccacatatgctctagatttgtaaacaaatattcatttattctgttgtattctaccaccaccactttgttccacaaaaggttatacagcagatttttatttatttaaccattaagagtgtctccccgtgtattggaatcggctaggaaatattcgtaattgctacacttttctatataaaaagggacttgaagcagactcagggccaacacaatgtagaatctgtttcttctagctttatttctccctgtgctgctagaggtaccaaagggtttgtctcaactgttactacccctgacatattccattgatctctttacttttctctgttgtctgtcagtctgtttgtcagacttatctcaaatgccacgttgtttgcgcgtatttctcaaagccatccatcaggatacaatctaaatcatcacagcacattctgtcttgtgacactaagcacagactgcctgtgttacatttgattgtgtgtttcccttttcttccacatatgtttcagtagtaatttcctgggcaacttatgtgtggcgggccttgtttgggatcttggaaatagagagatgaagctctcctacatagtctcatttacttccaattttgctttcttgataattggagtagccttttctagcttgtatcccctgcagtacctgatgcattgccttgctcagggtaattcatatatatttctgaattcagtttggaatgaaaggagacaagcaggcacttttgaatcaaatctggtgctgccactatgcaactgtatataaatctaacccaacccctgtgcgccaggttccttatctgtaaaacatggataataacaaccatcttacaggattgttgtaaagtttaaagatgaattgtatgaagcctagcagagttattggcacgtagtaggtgctcatgaagtagttgttattgtaagggaggttcagtcattcctttaggtcacttgagtgggcagtggaagcatttaggatcttaattgtctttagggaaatgcttacttagtctgggggcttctccgagaagcaggctctggggaaggtctggctcattgctgattaactgttccctttttagagtcaatgatctgagtctgtgttttggaaccacttatataatgtataccacctgttatttgtgtatttttagaagtgggagtcgggtaatcctagtcctgtcagtaaaagagcaaactgtttaccagaagcagagcttttttcttaacactgactcacactgactcatctttctcatttttcttcccaccgcctcataacaaccttgcaagagagagaatttttagggaatcagttgacttacttttttgtgattttccaaagttgaaagcttgaaggtatcaggtcattaattccatcccaggaaaggctaaagtttatgctgcctcggagtgccagtatgaccaacgccatgtagtgaatatctcacataaacccttgtctagacaaaccacttctgttggctgagaggttagacaagtgcctgaagtgtacatgttaagagtaaacacattttgctctttgaaaatggttgccttaagttgaacctggaaagtttgctcttctgagataggaaacccaagcagtattagagtcagagctgtggtagcttcacagatggatttcagataacagagaggccagacagcacattagatcagcaaaatggtgaaggaagctttatagatcagaatgactgatatctttgtgccttcatttaacattcattaaatgaacatttactgatcatctgtgatatacttggtgctagggttatgacagtgactaataaaaacatagtgcctgctgtcatggaccttatactctaatgctcgtttatagtaaatgctaagggaacagagagatgccttggcctgcatatgtgaacatgttcctgtgcacacgggtgaggggaggaaggaaggctccttggaggaaaaggcacccaagctgagtctggtggggtgagtaggcattaactaggagaaaagggttagttaggggaatgtggggttggctgaagagtattacatgctgaaatgagctatgagtcttggggtcgagagaagagcttgcccttggagaagctgaaaaaagtgaccaaaggacagtgagagggaagtttggcacaaaataaattcagagaagctaacagtgacagcagagcattgtagaccagtttattaatttaaaaaaaaatttttttttttttgagacagaatcttgctctgtcgcccaggctggagtgctgtgatatgatctcaatctcagttcactgcaacctctgcctcgcaggctcaagcaattctcgtgcctcagccttcccagtacctgggattacaggcacacaccaccatgcctggctaattttttttttgtatttttagtagagacagggtttcaccatgttggtcaggctggtctcgaactccggcctcaagtgattcacccacctcagcctcccaaagtgctaggattataagtgtgagccactgtgcaaggcctaaaaaattttttaatccagataaatttaacatatagtgaaatgctcatgacaaatgcatatacctatgtaaccaacaccccattttgagtaggaacttttaacttggtagtcagagcaaggggaaggatgggtttttgagcagggtccagacttgatgctaattgctagctaagaactgggacaagggtgagggggtgagggggtggcaagtaccagtggggacagagctggaataggcagtagtttgctggtgggcaggagcttccagcttgggggcaaaaaacagattcttggttttcctaacttgtttttagcagaggacaaacctctaagtgctttgtaagatccaaagtgtctatgcagaagacaacagactgtgttttttcaaagattttctgggaagacttccaggctacctgcagtttgaagaaagtcttctgaaaagggcagggggcgtgggggcacctacagagacaggatttcccccaactcgataagatacaggaaaataatcatcttattgatttacttttgttctatagtaatgtgacattttttcttttctgagagtagggtattaaaaattgttacggttttgggttttacagatttgttgaagcttaatatcatttaagtgtcctattttaatatctgttttaatatctgtatttttgacagactgccagaaatcatttaacatgttactgtgctatttttgttgatgttgtcattattatttttgttgatgttattcttaaagaaaaaagaaaagatactatcgatagaattatcgtcagtattagaaattaagaaatgttttaatttcaattgaaaacaaacaagtaaacaaacatgaaaatgtattgagagatgtgtgtattctctacctttgttttattccttttacaaaaactataaggaatagtgcttaacagtgtactgtcaaaacactgacatctatttacaggaagttcatttctgaccagaattgtttgtttgtctctccaaagcttgccaaattctataggttttatgtaagtttataaatattcttgtaaacattggctttaaactaaatccttctaaatatccaaactaccatgtatctttctgtgtctaaattcagagataccatcctgttggctttagataagttacagagtagtttaggcccacatgatttaagctcacccacagttctttgttgatacttgaggatttcatctgaaaagcatcctgttcatactctgaaaatatttctttcatcttagtactcccactcattttgtgtgtgtatatgtgtatagattattttattgttccacatatatgtatatttattttttgtccacttgctagggaacctcattttttttaacaagaaaatacttgtgtgataaggtcataaaacccaagagttgggaggaatattagagacctactttatttattttattttattttatttttttgagacggagtctcgctgtgtcacccaggctggaatagtgcaatggcgtgatctctgctcacggcaacttctgcctcccaggttcaggcgattctcctgcctcagcctcccaagtagctgggactacaggtgcgtgccaccatgcctggctaatttttgtatttttagtagaggcagggtttcaccctgttagccaggatggtctcgatctcctgaactcatgattcacccgccttggcctcccaaagtgctgggattacaggcatgagccaccacacccagcctagagacctaatttaaagtttattgctgctttattactctgaacaactacatcatttattacctaaaataatctttttattttctgttctcatttagctgaatctctgagcttaaaaaaagtgtgtttggcttatatatcacattatcccacatatgttacaaccaaaacttaattattagccataatagtgtcttttggctaatattagtagtaagatttttgtttgtttgtttgttttttgagatggagtctggttctgtcacccaggctggaatgcagtggcgcgatctcggctcactgcaacctctgcctcctgggttcaagtgattctcctgtctcagccttctgagtagctgggattacaagcgtgtgccaccatgcctggctaatttttgtatttttagtagagacggggtttcaccatgttggccacgctggtcttgaactcctgacctcaggtgatctgccccccttgtcctctcaaagtgctgggattacaggcatgagccaccgcgcctggccaatagtagtaagttaatgaagatctgtactaaatttggattccaagtgaaacatttctttttttcttttttatttatggcagagtagagggttgatagatatttgttggctttattagttttctcaaattggtatgtaaaaataatactagatatataggtttaagtctccttcataagattttctttcttctaaacctttggaatatgccatgcttttcaaaaagccccactcattatttttatgatagtggaataaaagtctccaatttgtcaagctcattattcaagccttccaggattgtttgcagttttaaaataaactgctgggggttttatgcatcttgcaatatgagtacttaattaaaattaaaaagggggccatgcatctatctattctattaaggtcgtatataaataaatgattttattgggattttcagtgtatttagagtaatctatacttaatgagagggacttgtacttttcatttctttgtactatttttcagcctttcctgaacagtaaatgttttaaaaaaaactatacccttattccttggtctctaagaactgtggtgggctgggcgcggtggctcacccctgtaatcccagcacttcgggaggcaaaggaaggtgggtcacttgacaaggtcaggagttggagaccagcctggccaacgtggtggaacctcgtctccactaaaaagacaaaaattagctggtgtggtggcgagcgcctgtagtcccagctactcgggaggttgctgcaggggaattgcgtgaacctgggaggcagaggttgctgtgagccgagatcgcaccactgcactccagctgggtgacaggtgacaggtgacaaaaaaaaaaaaaaaaaaggccaggtgcggtggcttacgcctgtaatcccaacactttgggaggctgaggtgggtggatcacaaggtcaggagatagagaccatcctggctaacacaatgaaacactgtctctactaaaaaaaaaaaaaaaaaattagccagccgtggtggcgggcacctgtagtcccagctgctcaggaggctgaggcaggagaatggcgtgaacctggcaggtggagcttgcagtgagtgaagatcacgccactgcactccagcctgggtggcagagcaagactccatctcaaaaaataaaaaataataaaaaaaaaagctgtggtggagtatatggtacaaacatgagacttggtgctcttttggattcctaaggcttttccatgtctgagaactcaggaggcagcctttgcatagcagagggactaggaacctcactatttctccaaagttgactagctttctataagataacccccataaaatcactagtcattagtaataaaactttgtctttaaatgactataatatttttaaaaaggacaatgaatatgtactctatgccatccctttccatactgtaaatgtgtttctgaaaggtatgctatttagatatacttgagtcctattctaatatacggagaggttgctttttaaattgtcctcatcattgtggtagtaatagtaatattagtagtactggtagttaacatttatggaacacttcatatattttacatacatagcttcctttaacccttataataatcctatgagttaggcattttattctctccattttgtgggtgggagaactgagacttgatatgtggactatatgattgatcgattggttgattttggtaaagttcagatatcttttgtcctgtgcttgacactctaaaatagtaagtatttgggtaacaaataattgtaagagagagaaaatcatcttatcttttggactattcccttctattccattcctactgccaacactccagtccaacctcacatttctttttctttctttttttcttttttctttctttctttctttctttctttctttctttctttctcattctttctttttcattctttctttttttctttctccttccttccttcctctctctctttctttctttctctttttctctctcttctctttctttcttcccttctttcccttccttcccttccttcctttcttttcattttctttctttctttcttacagggtcttgctctgttgcccaggctggagtgcagtggcatgatgacagctcactgcagcctccacctccacagctcaagtgatgctcctgcctcagtctcccaagtagctgggactataaatgcgtgccactgtgcccagctaataaagctccttctgctgaagttatgcctaaacccttctttgcacatgtcattccttatcacttatcacctaaagaatgacagggggctttggctttgaatggccctcagtatgtataagcacctaaagatttcagtttatctcagcttcagagcagtccatctcatctgcctgtttttcttcttaaaataaacttttaaaaaataattaaagtttttaaaaggtgcagaatatttaagtaagatttcttctcccctttcccctaaatctccattctcatttcgtagaagtaaaccattcttaacaatttcctggataattcttccagaaattatgcatgtccaaacataaatataaaatctattggttgcttaaaaaatctataaatgagatcatattatacaaactattctactgctattgttcacatagatacattttattcttttaaatgacttcatggttgtatcacttacaaaccttttggctttgagtaacagaagcagggaatgtacagaaggggtgtcagacaaggcttccaaattatcagaaccaaggcaggccagggaatcatcatcctgttttagctgaagcagccaggccagtatgttgccatcactgcccttggacactgtcaggaataaattccaactgttcctttgtcatagtgtcattttttaaggttcagagtcccagtgagactatgcacaatggggaagtacccccaaatagaaagaagtgactggatgttggaaaacttaaaaaatgatacatttccattacattggtattctattgtataaacatgccataatttatgtattaataactagccacttcttggtgaatattcagattgtcatattcaattttttactagcaaaaaccactgctgcaaagaaaattatttatgtctttgtgcatttttgtaagtatatctgtgagattaatttcaagaagactgtgctggatcagagagtatgtatatttaacattttgatgtagcgccgggcatggtggctcatgcctgtaattccaaaactgagaggctgaggtgggcggatcacttgagctcatgagttccagaccagcctgggcaacatttttttcatgggcaaaacccggagaagaaaatatgaaaaaaatacaaaaaaaaaaagaaagaaggaaagaaaaaagaaaattagctgggcatggtgttgcacacctgtagttccagctactcaggaggctgaggtgggaggatggtttgagctggggaggcggaggttgcagtgaccagagattgtgccactgcacaggagcctaggtgatagagccagaccttgtctctaaataaataaataaataaataaataaataaataccattgtgatgtatattgtaattcatgcttagaagctttcactggtttacactcccatctacaaagtgaactggcttttaacttacaagatacaaagttatttatggccatatattcagcaaaagccacaaagtgtcacaccaggtgaaaagggaagtccaagtttctgaggtatagagtttcagtatttatcaggtaagcatagctaccaaagccatttttgttctggaagcatttgctgatcccgagaaagcattttttaggttaagctgtatttttggtgtcttcatatatgaggacagaattcttagcttgttgtccgtcaaggatggggaatcagataaaccacttttttagtttgaatggaacccctaagggcataagagggaacttgaactaagccaaccctcacaatagccttgccaccaagcttctaggtgtagggaatgtagaccaagatctttcatcattatggttctcaagtaataatgccatcaggcagctggcagaagcaaatgcaaattttctctcgaggaagatgttatcatcccggacatcaaaatagtcctctaaataattttttatgtaatcactagcacatgggattaaaaccaggttcacaaagaaataagataccatgaaaagaattagcaaaagccatatacaacaaaagtatcaaagccatgagatactggaatttcagatgcagaatgtaaaacactgtatttactatgcaaaaagaaatagaagccaagataaaaacgtcacaatgggccgggtgtgatggctcacgcctgtaatcccagccctttgggaggcctaggcaggtggatcaccaggtcaggaattcaagaccagcctgaccaacatagtgaaaccccatctctactaaaaatacaaaaaattagctggatgtggtggcgggcgcctgtgatctcagctacttgagaggctgaggcaggagaatcgcttgaacccgggaggcagaagttgcagtgagccgagatcgcaccagtgtattccagcctgggtgacagtgcgagactccgtctcaaaaaaaaaaagtcagtaagtagacactgtcaaaagtgacagcagatttgaaaaaatccaaatagacattctagaaccaaaacatataataatcaaaaacaagaatgcagtggatgtatttaaagtagattacctagcaagagagaactagtgaactagaagatagaagaaaattctccagaataaaccttcaagagatttaaaaaatgtaaaatatagaaaagatgattagagaattaaaacgatccagtgacaagttctaatatgcatttaaaaaaatttttttttcaagttttttcttgctgcagtgtccaggctgaagtgcagtggctattcccaggtgagatcatggcacactgtggcctcaaacttctggcctcaagtgatcctcccacctcaggtaaataggtgggactgcgcccagctttaatatacatttaattagaattacaaaatgagtggagcaagaatggtgcagaagcaatatttgaagagataattgatgatcattttctagaactgcagaaagatgaatttgcagattcaaaagtgtatagccttaaagaaaagctaaaagctaaaaactgagcaagcatccatcttgtaagtcagatcacattttgtaagtcagagaaaacacagcaaaataattctgaagaagataaagagaagctaggcatggtggtgcatgcctgtagtccaagctgcttggaaggctgcaatgggaagattgcttgagttggaggccagcctgggcagcatagtgagaccccacctaccctgtctctaaaagaaagaaaataaagggaaagaaagaatgaaaagagtagaagttatgaagtataaagcaaatgtatagcagggaaaatcaatgaagccaaagtatgattcttagaaaagattaataaaaatgataatactctgattaggttgatcaagaaaaggaagacagaaataaagaaaggagcacaaataaccaaaatcaagaatgaaaaagagggggctgggcccagcctttaatcccagtactttgggggaccgaggcgggcaaatcacttgagctccggagtttgagaccagcctgggcaacatggccaaacgccatctctacaaaaattagccaggtgtggtggtgtgtgcctgtagtcccagccactcaggatgctgaggtgggaggatggcttgagtcttggagggggaggctgcagtgagcctagatcgtgccactgcactccagcctaggggacacagtgagaccctgtctcaaaaaaaaaaaaaaaaaaagagtgcttaaaaaaaaagagtgaaaaagggagatagtatactcattaacaaaataatgatactatgaatactatgaataattttaaaccaaaattttgaaaatttagatgaatggataaatttattagtaatataactattaataaaaatggagtcatctgggcatggtggctcacgcctgtaatcccaccactttgggaggccaaggcaggaggatcacctaaggtcagaagttcgagaccagtctggccaacatggcgaaaccccatctctactaaaaatacaaaaattagctgggcgtggtggcctgtgccagctgcttgggagactgaagcaggagaatcgcttgaacccaggaggcggaggttgcagtgagtggagatcgtgccattgcactccagtctggttgaaagaatgagactccatttaaaaaaaaacagaaaccaaatggaatcagcagttaaactcttcccttaaagaagactactagcccatcactaggagtctaccaagcacttaagagaaagaattaatattacacaaatgcttcctgagaatagaaagagattagcaaaacaaaaaacctgacagtgacattatgagaaaggaaaaatcataagcccttttactcaggaaaatttctacattttactatgaaaaattcccaactatatattagcagagcacaatccaatattttacttattattgtagtataacaaactaccaaagttttgtggcttagaacaactgattttttttttttccagagattctgtgggtcggaagtttggactgggcacaacaaggatggtttgtttctgtttttgtctaggttcccagctgggaagactcataggagggcttggaatcaagcccttggcttgttgatctttgtcgtgtcaatttcttgtttttcttttttctgagacaggatcttgctctcttgcccaggctagagtacagtggcataatcatagctcattgtagcctcagcctcctgggctcaagcgatcctcctaccgcagcctcctgagtggctgtgactacaggcacatgccaccacaccttgctaatttttgtatttttttgtagagatgaggtcttactgtgttgcccagactggtctaaaactcctggactcacgtgatccttccacctcagcctcccaaagtgctgggattacaggcatgagccactgcacctggctgtctgtcttaccagtttctaaaatctctttatgggttaaggaaataagctatttatattgataggaaatataatttcctctagcctgacatttgatttttattttgctgatcatgctttttgccatgcagaatatttttatacatagtcaaatttattaatatttcctttaatgacttctggattttatatcatagtacttggaaataccttctccattgtgaggtcataaaatatgccatgtgtttttccagtgcttttatggtttcatatttttacatttggatttgtggatcctccaggagctatttttggggtgaggtaaaagactacttattaacctcgcttttctcagtcagatggagagattaattttgactgtggagaagggggctctggtaaagtatcttgatcatctcttagggtatgggattgtgaggaattactctcttttcacccaaaggaattggaatgagcatctgaagtcaaaactgcctctcctctacagcaggtgggaaaaattgttttaaactgaatcctttttcactgttccttctcatttcctaagactttctgctaccgtggtatcactggcctcatgacatgttatgattttgatctcgtttttgtactattttagtgttttttttttctgatgtcatgaaaggacacagcttcattttatgtataagctctctctaaattgtgatatagtgttgagttactgtgaattctagccgttgttattattattttttttagagatggggtcttgctgtgttttccacagcgagaatcagagctcctgggctcaagcctcctgcctcagcctcttgagtatctgggactacaggtgttcccggctttagccattatttctaggatcagttttggagggctctcctttcttgttttgttgtttgatcccaagtccatctcaggcagtggtctttctgtaactttctataacactccattcatttattatattataagataggctgtgaatataggagaaaacagaccttcatgatcatgatttcacattcctatcattgttccagacatgtataaacctctcagacctttgaggcttagtctaagataagtcctttgaacaaccagtaaaaatcattaataaaaataaagaaaatcagcaattctttttcttcattaggacgtgttgaccttgatacgaatactactatgctacttgttcttggatgaatgataccaactttgacctgggcgcttatgaaaatattttaaagcatcacttaaaaattacctttctcaccattctaactaaagcaataggttttgtgtgttagtgggtttttttctaatgtctacttatgttcatttattaagcgccttctgtttgtcaggccttctgctagtgctgggactatagagttgaataaaatataaaattttccatctactaagggagatagaatataacaagtagttataatgtacagtgctgtgaactataatagaagtgttattgggggcatgtattggtcaggattcttagtagcaaacaacaaaattcactgtagttggcataagcagaaaggtagttttaacatctgtgcttggatgttacacagatgaaagtgaagcaatcacagacaatatttccatgagaaatggtcaaccccactaagggggactcttctagagaaaacaccactgctgcctttaccagcactggtgacatcagatactggacatcagaaactgtcccataacagtcctagaacatgggcttataattttctttacgttttctagtgcagttagatgcagttagcccattcataatctttatatccttcatgcccttcattggtctatagcaactactactgggtttgaaatagccctgactttaatatggactttacctcaggcaatcataggtgattattttattatttatttagagacagagtattgctctgtcgcccaggctggagtgcagtggcacgatctcggctcactacaacctccgcctcccgggttcaagcaattctccctcctcagcctctcgcgtagctgggattataggcacccgccttcatgctcggctaatttttgtatttttgtagagatggggtttcaccatgttggctaggctggtctcgaactcctgacctcaggtgatctgcccaccttggcctcccaaagcactgggattacaggcgtgagccaccacacccagccaataggtgattattttaaaactcttacaacattgcatgccactaactacccgcatctcattctctaagacagagattgggaaactatggcctgcaggcaaaatccagcctgccacttgtttttgtaaataattagttttattggaatacagctatgttcattttgtttacacattgtgtgtggctgcttttgcactatagtggcagagttgagtagttaccacagagaccacaaagcctgaagtacttactgtctatccacttacagaaaaagcagaaaaagtttactagccgctgttgtaatgcttattaaattctctctgccttttaagtccagcaggtgaggtaaatcagtttctttcaaactttttgactttgaaaataagatgcacaatttatattatgactcatgcatgcatatcatatattatatgtaaatgaaacattttcttcttttcattctattctataccgtttcatgttttgaaaagtatgctagtcccagctgggcatggtggctcatgcctgtaattccagcactttgggaggccgaggcaggcagatcacttaaggccaggggttcgagaccagcctggccaacatggcgaaatcccgtctctactaaaaatacaaaaattagctggatgtggtggtgcacacttgtaatcccagctactcgggaggctttggcaggagaattgcttgaacccagaaggtagaggttacagtgagccaagattgtactactgtacttcagcctgggtgacagaccaagactgtctctaaataaataaataaaaataaaaatatgctagtcccagtctactaaattgatttcatgttccacaaatcagttgtaacccataggtacatgaataggcatgttccattcatgaattatccaagatctgtttcatttccttaggagttttgtctgcattcccttctggtttccattactcaatctgtcaggattctcaggtgctactaacaataagtgtctgctccagctggtttaagcagaaaagcatttcttaaaaaaaagtagggatcttacagaatcttatagagggccagataacagatcctagtgctacctagatggcagttaagcagcaaatgaaatgcaggctggggaaagccatctaactacaccatgagacttccctagagaaaaccctattcctgccattgcgcagcacctgtgaccctagggtctggctaccagatatcctgcaaggtcagccccgtaagaactcagtctctgtgattgtctcaccaaagctccttgaaggagggctctcctggctcaggagctcagaggctgctcagggcatttctaccttttggaatcctgcttcattttcatctcgctgttctaaaactcctaatttttcttctcctattttattttccttttcttcagctatctactttgctcctttccttctccttttcctttatcctcatactcatcttggccattcctatcatcaggtggcgtaactcaaggctgaggtccctgaacagagcttagagctcatttcttcccactttcagtgtaccttcaacggcttttctagctactcctcattgaggttgtccagcttgtgtttcttgtgcaccttccagtgccgggcacaggctgggcagcacaccttctgggccaggcccaggattaagaacaggagcagggccctagagactgagactgttcccggctgacagagtgtggcttatgtctctcttcaccatttttaatggccagacaatgtgtttgatattttgattatttctattatttcactattataaataactctgcctgtaatcccagcactttgggaggctgaggctggcagatcgcctgagcccaggtgtttgagatcagcctgggcaacatggtgaacccccgtctcacaaaaaaaatacaaaatgagctaggcatggtggcgcatgcctgtagtcccagctattcaggaagctgaagtgggaggatcacctgagtctgggaggtcgaggctgcaccatgatcatgccactgcactcgagcctgggtgacagaatgagaccctgtctgaaaataaataaataaataactctgatataaatgtctctctcatttataagtcagtgtatgcacattttgtagcacttggtatgtattttccaaaggaacttaaaaataacttttcgtattttttctttttgtagaagtaatgctatattttagtgtaaaatactattttatagaaaaaatttaaaataccaataagaaaataaaaattacccacagtgtcatcatcctgatatgctactgattaatagtttcttccatttttttctactttccgttttacagacatgagccccttctacatataggggctcaccttaacattaaagtgagacttttttttttttgagacaaagtcttactctgtcgcctgggctggggtacagtggcacaacctctgccgcctggtttcaagtgattctcctgcctcagcctcacgagtagctgagattacaggcacctgccaccgcgcctggctaatttttgtaattttagtagagacggcgtttcaccatcttggccaggctggtcttgaactcctgaccttgtgatccacctgcctcagcctcccaaattgctgggattacagtcgtgagccactgcacctggctcttatgtgactattttttttaatgtcatcagatattcttcgatagtatcatttattgtgactgtgtaatattccattctgtagatttaccaaagtttatttaaccactgcctaatagtggactttaaggattttcagttttacagttttctgaacagtgctgaagtgaacaactttaagtcaagtctttgcacacacatctatagtggtttctcttggatagattcttagatgtaagatgagtgggtcagagagcatttacattttttaattaagaaactttattttttagaccagttgtaggttcccagtgaaactgcacagcaagtacagagaggtcccatgtcccccctacatttttaaggatttcagcacatatcgtcaaattgccctttaggaatgttgtaccgttttccattttcacctacattttctcatatctctgcaacactgagaaatatcatttaaaagaaatctttgataaggcacatgtctagtagaatacctattccagtcaagctaagactaaattttctctctcctgaaatttatatttacattattcagtccattattatttattgtggttagtgatcacacagttccaccaaccttccttctttggccaatttaacaaaaattataaaactaatacatagacacaaaaataaacattcagaacagaaagatatagcgatgaaagtaaaaaaaatccccacttgctttagccaggccttctgaaagcggtttgttttttactttaatgcttttttgtaattgtggtggttacttccaaaactgtaaataaaatatacataaacatgtaatttttattttttttgttattttattttgtcattttatttatttttttttgaggtggagttttactcttgttgcccaggctgcagtgcagtggcgcgatctcggctcactgcaacctcggcctcccgagttcaagagattctcctgcttcagcctcccaagtagctgggattacaggtgtgagccttgccatatcgcacactccccgtgtaatcctgctgtccagagatatacaatttggtgtattgtatatccttttagagatttaaatgtaggctgggctcagtggctcacgcctgtaatcccagcactgtgggaggccaaggcatgaggattacttgagaccagaagtttgagaccagcctggcgacacagtgagaccctgtctccacaggaaatgaaaaaaattagccaggaatggtggtgcatgcctgtagtcctagttattccagaggctgagttgtgggagaatcacttgagactaggagtttgaggttacagcgagctatgatgatatcactgcactcctgcctgagttacagtgcaagaccctgtctcgaatgaatcaataaatatatcagtaacaacaaaacatggactgtgagccaggtactatgcatagtctcattaaatcctcatagtgtctgagatgggggcccttgtttaccaaaacgtaaacttgaaccttatggctaactggtgacttgcctaaacatttccagtatttcctatgataagttgtatgcaataaataagatgtatctaattatgtgttcttgtgtgatcatctccatttaatacatttccacaactaggatggtttggtttaaaaagtgtgcacatttaaactatttaaacttttgtatcatcctgagggaggtagtttagagtgtggactttgtcgtcatacataccagtatttagattctgactgccacttactggccactcactaaaatgaaactgtacatcagtttacctatctctaaaatggaaggataacagaagcctcatatggctgtgaagattaaatgagatgctgctgcaatgtccctggctagtgtgcagcacctaggaagaatggtgtccaagacagaccaggcccctcatctcatagaactgatattttaatgtgggacaggaggaggcagcagtgaaaggcagtaaagaaatgaatgaacaacaaaaaaaagtggtgctgtatggacgcttaacagaaagtgacatgataggtagatgggtggttattttaggttgggtggcttgggaaagtttttctgaagaagtgacatctcagctaaggtctcagtgataaggatagttttataattcaaaaattcctagaaataaaaacatgggatcaaacattacatgcattaggccaggcaccgtggctcacgcctgtaattccagcactttgggaggccgaggcgagtggatcacttgaagccaggagttcgagaccagcctggccaacatggtgaaaccccgtctatactaaaaatacaaaaattaaccggatgtggtggtgcaggcctgtaatcccagctacttgggaggctgaggcaggagaattgcttaaacccaggaggcggaggttgcagtgagctgagatcgtgctctcactacagcctatgcgatagagagactcaaataataataataataataataataatgacaaaatgacctgaaaaaatttttaaataatttgcattctatgtatagacatgcctctttttctttaccattaccagaacttttttcctaatgtaaaaaaaaagtggggttgttcaaagattgtcttagggaccttctaatgagctttactggcagagggaaaagataagaaaatgtgtaagtcccttttaggaatctcttctatttcctctccctgtgttaattgtctaccatcatccattatactataaaccgttgtcttcactttactggcctttttctttacaccacatcctgcctacattgtaggactggaagctgccaacatgcatgttaactaacaagcactttttcgtctttagaattaggcagtgcctgggtcaggggagatgcaagattcagaacagcaatgcttttgctataaaaacaaggcagcttttagggtagactggtttttccaaacaaattcattgttaaggctgtaacacgttctgtgagttaaaactgtgcagaaggctctgcacatatgtttgttacagttgagcctttttcctgtatggcatgcaatgggggcaatgggcattggtgaacactgtacactaccattgcttccacaggtaataagacctcttgtttgtaacgtgtatatgattacatattgtggatctgttctgaaagcctttaatcatcgtagaaacgttctctttgtagggcttgagcaggcctcagcatctttacgacaatatacatgtttttgtttgtttgttttgagacggagtctcgctctgttgcccaggctggggtgcagtggcacaatctcagctcattacaacctctgcctcccgggttcaagcaattctcctgcctcagcctccccagtagccgggattacaggtgcccaccaccacacccggctaatttttttgtgtttttagtagacacagggtttcaccatgttggtcaggctggtctccaactcctgacctcaagtgatccacccacctcagactcccaaagtgctgggattacaggcgtgagccaccacgccaggtcaatatacgtgttaaattatagacatcactcagttactgttttgttcatgtatggggcaaatatatatttttatagaatatacatgtattataatttaatttctgattcaagccttaaagaaaatatgtagttcaaacttggaaataaatggattaaaagtcacttgctcttaaaatgtggtttctttttataatcttttaaaattcagcaacttaaataaaacatcctgagggcaacatgtgttagtgagggggactgggggtggcgtggggagggagtgtgtttgatgaaattgtccaggagcaaagcaccacttacttgaagcccagagatttgtcatccaaatatgtgcagattgctgggctataaatagtttgaactcaagtaaacagcctcttctccctaactgctgcttggccattgttcagatgccagcacagactgaggagcatctcacaccaagctcaaggctcttgtgcccaaattttgggctgcttctcttgtggggagagcttcagctaccctgacttgagatgaccaagggtcacatgttcaccctctttagttatcccacgtttggctcccacccctatgcaacctgatgtacagtttcataaacatgcctctgctctgatgagtagcgctgatctaagaagattcctggcaactattaaaaagccctggggccccatggctgttgactgaagtagatttaggaagcacagaagttcttttttcagggcagaggcacgcatggctcatttctttctttggaactaagtagagtggcactggttgtcagaactgctgcaggctgcctgtgccagcaactcatctgctctgtgccaggcaggcaggctgctgacatttcaagagtccctttgaggactccagcaacatgctgtcattagagcaactgaggacagtccatagtttattagtatatttcctttggaaaaaatgtctccccctctctctctctttaaaattcctgctttagctgcattgctgcattcatgtgcagtgactcttatgtcaaatgcctatgaggagattatgactaatttaacattttgttgttgagaggacataaggaatggtagaaggagtactagattaaggatcaggagcctggattcttgcgcaagttacgtaacttttcctagctttgatttcttcatttgtcaagtaaagatagtcatgtccctcctgtttcttggggttgatgagaaaatttatgtaaaggtactttctggactataccgaacaaatggaatgcaaaggagaagtagggtaatggaaggagcttggtgtttgagtctcacaggcctcgcccacactgtgacctcaagcaagtggctaatgtctctcagcctcaaccttttcatctgtaaaatgggaacatctatacttgccttgcaggagtgttagaaggattagaaataacatatgtaaagcactgacaaatggcaaacaatagttgaatagcaataattgttattattacacttaatgtggatatattcactctgggtgatttaggattctaaacctaaggaagtattcagtttatagatgtagagattagcaaaaggccctgctagtaactgatagtagcaactgataataatagctaactttaaaaaatccaagtaatacatgaatatgactttttaaaaagtctctgagtctagaaaggcatctgtctcctgcttacccctcaccctgaggcagccattttatttttctgcttttacttcttttggtggttacttctatttctctaaataatgttactcccatttccttttttaaatgaattttgtttttgtcagaaaggtacatgcacatagtttgccttagtctttttaaggtcaaatatcataaaagatttgtaataaaaaccatctgttccctgcccccaccctttctttacccttcctcctatcctgctcccaagggcatacacttttgatccttttaggcgtttgatctagcatttatctctctatatctaaataatatgcttatcgagatatggttttttttaactgtattacagaaattttgaaacatgtacaaaactagaaagaatagtataatgaatcctcatgtaccacccattacccggcttcaaaaatcaaaaacccatgaccagttttgtttcatctgtgctggtagccattttcccctgccactagattattttggagtaaattctagacatcattttatcagtaattacttcagcatgttttttttgtttttgtttttgtttttgtttttgtttttgcaatgtcgcctgtcacccaggctggagtgcagtggtacgatcttggctcactgctacctccacctccctggttcaagcagttctcctgtctcagcctcccaggcaggtgggactacaggcacacgccaccatgcccagctaatttttttatttttagtagagacagggtttcaccatattaggctggtctcgaactcctgacctcaggtgatctacctgccttggcctcccaaagtgttgagattacaggcgtgagctaccgtgcccagcctagcatgtacttttaagagaataaggactccttttaaaaatataaccacactatcacacataaaataattaataatcctttattattagcagtggtctccatttaactcataagttatttttttagttctagtcagatccaaacaaggacctcacattaccatactgctttttcttgactcatcagttttttgtttgtttttgagacagtctcgctctattgcccaggctggagtgcagtggcaccatctcagctcactgcaacctccacctcccaaggttcaagtagttctcctgcctcagcctcccaagtagctgggattacaggcatgcgccaccatgcctggctaatttttgtatttttatttttgagacggaggctggccgtcacccacgctggagtgcaatggcatgatctcggctcactgcaacttctgcatcctgggttcaaacgatgctcctgcctctgcctccggagtagctgagattacaggcacctgccaccacgcccagccaatttttgtatttttagtagagatggggttttgccatgttggccaggctggtctcaaactcctgtcatgcagctggttttgatcagacatcctgtcatgctttatttggccattcacaatcaataataaaagacttctttaaggggataggtctcagttcatctgtttgtcccataggcctctgccctgcctgggaagctgctgggtactggaagggtactaaggtactaagtggaagatgctttagggcacatgagcaggagcagcagttagactgagggcccttcacgtgttagcataaggaggccagtctcttactagaagccctcgatcaatcctaggcagttcattcaatttatttaaagaggcctcctgtctttggctgtggttctgcagagcttttgggccctctgtgtgctgcaggtatgggatagaggagctggctggcacaggaccttcagtggatcccttaattttttggcccttctgaatcttctcgacgcctgctgtcttcaggttcagagcctccctggggtcccacaccattccttgtctctcatttccaatggtgctttcttgtccttgtgctccaaacttcagcttctgttgtcatacctctctgaactttttctatcttccggaaattatttgaaatgaaatcccttgttctctaatgatccttccttcagcaaaaaggcccaatttgtagttcagaagacgtggtgctttttacaaaaagtatgttaatgttttaccatagactggactaagtagagtgtgtgtgtgtgtgtgtgtgtgtgtgtgtgtgtgtgtgtgtttagaaaatatttattgagtttcctattttatgccaggcactcttctaggcacttgggatagatgtattcagtgaaccaaggagacatactgttgactttgtggagcttacagtctggtggggaaacacatggaacgtgtacttataaatatgttaagggttataagaagagacataggagtaccatgagaccagtacagcagggggagctaacgtggctcagagaaaagggcgccctagggaagtgatatttaatctgaaatctgatggctgagtaggagttaaccaaaataagagggaagagcccttcaaatttgtatgtcaaagtgcagtagcaagtgagagtctgagaccaatagagagtagcaagtgagagcctcaaaccttctcctgttggagcaccaggctgtactacctcaggatagtcccttgccttctctggatctggcattcctcacccctaaaatgaggagaccacatgctcctttcagctgcaaaaatcaatgagtccaagactgtttaaagttaaggtcactgtttaagtgaaggtccatctctcccaaaacagctgtagttggaaacttatctcaagctggtgggaagtggtttgaaaaaaggcagggaggggacagtgtgatatcctgcgaacctatccagtttctagccacataatcactggggtcaggcttctcttctccttctggctctccttcagacacaccaaatcagcagtccaaaggggaccacaaagtggatcctcaggacatcgaaccctgaagaaaaagcagccacgtgtactccaaaaccaaaaaaatacgttgagcaatgtcttagtcatcttttgtgggtttgattccccatcccccaaaaatgacttaagtttctgatttcaaaacattgtgtgtatgtgtgtgtggttttttttttgagacagattatcattctgtcacccaggctggaatgctgtggcatgatctcatctcactgcaacctctgcctcccaggttcaagcaattctcctgcctcagcctcccgagtagctgggagcctcctgagtagctgggactacaggtgtgcaccaccacgcccagctaatttttttgtgttttttttagtagagacagggtttcaccatgttggccaggctggtctcgaactcctgacctcaagtgacctgctcgcctcagcctcccaaagtgctgggattacaagcgtcagccaccgtgcttgaccaagaacattgttttaagtgtaagtgtggttccttctctggggccttacaccaggattgtggtgagacgatgtattgttctcctttcttttttcctgttcttctgtattttcttatctttttacaataagcaattatgattataattggaagaaaacaaaatctacttttattcgtaaatctcaatcaatatacttctcaattaattgtctagaaaaagcatggaccttctaactgcatggcacagtgaataagtgagttggaaatggtatgacagctgaaacctgcctttgatgggtgatgagcgattgcactgtacagcagctgtgtggactagaaagtgggtagtggtggccagaatttctttattcatatactccttcaacagatatccgtcagttgctagctgatatagtttggatgtctaactatattggtggatagctgttggatgtcatgttgaaatgtgaaccccagtgttggaagtgggccctggtgggaggtgtgtgggttatgcgtacagatctctcatgaatggcgtgatcccctccctgctgtaatgagtgagttcttgttcggttagttcaagtgagaactggttattttttaattaaaaaaaattattttggccgggcatggtggctcatgcctgtaatcccagcactttgggaggccaaggtgggcggatcacgaggtcgggagatcgagaccatcctggttaacacggtgaaaccccatctctactaagcatacaaaaaaattagccgggcatggtggtgggcgcctgtagtcccagttactcgggaggctgaggcaggagaatggcgtgaacctgggaggcggagcttgcagtgagccgagattgcaccactgtactccagcctgagactccatctcaaaaaaaaaaaaaaaaaaaatgcaagggactacatgtgtgcaccaccatgcccagctaatttttgtatttttagtagagacggtgtttcaccatgttggccaggctgtcttgaactcctgacctcaggtgatctgcctgccttggcctcccaaagtgctgggattacaggcgtcagccactgtgcctggccctggttgtttaaaaagaacctggcacttctccctctcacacttgctctccatcttgccatgcaacattccggctctcctttccctctaccatgtctaaaagcttcctaaggcctcaccagaagcagatgctagtgccatgcttcttatacagtctgcagaactgtgagccaaataaacctcttttcatcataaattattcagcctcaggtattcctttatagcagtgcaaacggactaacactgcgtaacaaattaatcaatctgtgcctgtgattttctcatgtgtcaagcagggataataattatacctacctcatagagatccttatggggttaaatgaggtaatttatataaagcagttagaatacaaccaggcacggtggctcacacctgtaatcccaacactttgggaggccaaggcaggcagatcacttgagctcaggagttcaaaaccagcctgggcgtatggtgagacccccgtctctacaacataaataaataaaataaacagaatattacctggcatatggtaaatatacaataatagttttggggtttgtttatggatttccttattttaataagtatctcataatatgtacaaaatgctgctatattagacacagatcttttccttaaaaagttaggattctggcagagaaaaaagacctgcccccaactaaatatgtgtcatcagagaaaagggtatgtttcttaagagagaaacagagcatactaaggaaattcagaggaaggagagaccccttctaaactgggggtaaaaggtggaattaaacagccaaagtttccttcatcctcaaatggagctgatgctgctgtctgtgaaaaacagccaagtttcctgaagggaagccctttaagaggtggtagtgcaagggggttgtggattcaggactggcaccacatggtccctagttagagtgcaggctctgccccttgctcccgtgagcctttgagcaggttggtcggctcaccatgcatctgttgctacagctgtaagatgtgaatattaataatgtctcctgcacccgattattgtgaggatgacatgaagtggtgttcatagagtgctcagtgcacagcttggccccagcccacataagtgtgtccagtattgtcagttataagaagaaatgaatgtgccagtgttgctatggttctgtcttccgggattctgtcacagacgtagaattattccgttcacaagggaagtgatacagagtacatgttgttgaagaaaatgatgttgtttttatgaatgggctccttactattatttttgttcaagtaacaaaacatgattcaaagcacccatcttcaagagcccagcctcatttcctgacacctactcagtcttctggaataaaggctcagccaaacaatagccctgacctccagtccctccaaactgagtgttgctgctgagaacaggccttacagctctgggtgggcttttgttcattactcatcgtgacattctggagaaatacaggacccttttgacttcccgaccaatctctgactttctttcattgtcacatcaccattagggcaaaggatgatgaaatggtcagaattagacaagaagtattcaaatatttttcaatgtatagtatgtgccaggcacataacccacacaagaaccttggagagtaaggctgttattcttctcattttacactgggaaaccaaagcacagcaagaaggtctagggaccagaaggaagcccacatctctctgagctgtgaacggctgctctctgtgggttaccaggctggtgtttttttgttttgttttgttttttgttttttgttttttttttaaagacagagtctcactgtcgcccaagctggagtgcagtggtgcaatctcggctcactgcaacctccatctcctgggttcaagcaattcttctgtctcagcctcccaagtagctgggactacaggaacacgccaccacgcctgactaattttttttgtattttagtagagatggagtttcaccgtgttgcccaagctggtctcaaactcctgagctcaggcaatccacccacctcggcctcccaaagtgctaggattacaggtgtgagccaccgcgcccggccaggctggtgtggtttttattccacagcagtcctacgtcacattgtcacattgttgaaaagccttcagattgacaaactccctcctaatatagcctgttttcttggatgttttctgataagcatctgtgttttctgagaactaataaaaattcttgttaaaccacaaattaccacagcctcttccttacctatagagagccgctttcccagtaaagctccggtcctaccttcccatcaccatcaaagtggcattgaaacagatcagatctgctccttttgagggagttagttgaagcccagtcttgcttcaggccacacaggatttgggtagcaaagcaaggaaagcagcctctctgacctagtggcctgagtgtttcctttcccaggctggctgcggcaaccactttgagaaatggcattggcattggcatgtgtgtggcatgtgtgctgacctagttaggagttgaggcttcatttctaattctgtccctttcgttttgagctgtgtgaccttgggcatgtcacctaacttctctgtatatgtcttcttatccaggaaggagagattaataatgtagcctcatagcacttatctgattctcctaaggatgttatgagaatcaaatgagattatgtacaacgagagcaaacatttattcaatacttagtatgtaccaaatactttcagtttccttacatgtgttttttaattctcacaatcctaaaacagaggcactagtatcccacttgacagttaaaaaaactgaagttcagagaaattaagtcagacaggactcagatccacatctgtggctcccaaatgatgttcctaaccactatgcatgtcactcgctccccattgtacacgaaagtagagagatgttctttgtctttaccatcaagcactctccaaatgcaagaaatgatctctcgtaaccactgctgttccatgttggtccctaaggacacttatagcctgttacttgtttgtcttatcttgtagtttatgctgctgcttttcatgtccctaaggacttgttcagtgaattcttttggttttactcccagagaatctgttcatctccttcataaagggggttaaaggtgcccagctgagcctggcatcttgggcagtggcctctgacttctccagggttcttccttccctcaagcatgtagttgggtagcttgtagtaaaatgctctataatgcatttgtttataagttccccagtcactgatttttactcattgaatctcagaagtggaaagcaccaaagccagcattttgttgatagggaaactgaggtccagagagggatgtgacttgcttgaggtcattcattcagttgaaggcctgaccaagactggaacccagtttcccaggggacacaccagtgctgtttccaagccttccccgggggcacacatcacctcccctacatgaaggacaaactcatgtactgtgcccagcatgtacctaggagacctgggagaaatgaaacaacttggaaaattgggcaggaagaaagagatgggtgtggggtggggtgaagatctccaccctaactagtatattatataccaaagaaaggaattaaacacacaggaaagcagacaacccactaagaagcaaaggaatttacccaggaaccctggctcagtgagtggataggaagccttttgtcactaaagctgcagggttgaaaattgaaggaaggatattaggcaagcgtggtggcctgggatgcagttacagccccctggctcattgtccaaaggaaatggatctctcctgtggacagagaggtggaaactgagtgagtgagttgtgtggttgacatcatcaggctgagcattggattacaacaaatggggacttacttggcccgagacatgggaaacacccactaaaacctcaaagtgcttttcatttaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttgtaagtagaactttactctcctcccctgcccaacacccccagggagaagcagagcttggaggcagagctctctggagagcttgctttccagcctgttggccacaaaatgtctatttttatataatgatatatgtgagcttgctctgaaaattatggccttgtctgaaactgcctaaggctagtcggagcctccagtctcacaaatgggctccattcagatgctgtttcatttttactcaaagaactttgacagagtattcagagctttaaaagcagctccttgctccaaatataggtgaagaaataaatcttccctaagaaattcgtgtttgtaaaaccctttctttttttctgattacaaaggtggtataataatttttaaacattctagaaagaaaagtctccgaaagtagtgaaaattccctattatcttccccctcaggaacatggttgttgtgttaaatttcagttacagatatggtcagactccatgaatttaccacatataaacccagtgctgcagcagctgtgtggaaaactccaagatggaaaggggttggaaatctttaaccttgggtttgcgatctttttattgcttccttttaaaaatttgctgtttatgcctggaatataaacaggacatgtaagcctttaggcattttatttgttggtatctgttttcagggtttgaaactaagcaagctactctgtagagagggaaagagggggcccttgctgtacccaggtcccttacttggtgggtccctgaactgaggaggattcctaggtggcttgagatggcttgcagtgtgctaacaggggaggtgtcccctcttagcaggttaagtatatttgaaaagttacagctaacgggaagatttcagcttcaacaaaaagctaccatatattagaagggtcacccaaggaaactgtcaccttgggcaagtgtttcacactctctgggtcttgtttctttatttgtacctaatgaggggacaaaactagatgatctctgtatttccaaattcagtatgaaatgaactgtccatatttcttttccctttgtattgggcccttatggctttaggagcaaaggaccctaggttttcagtttcccagagtagctaaaaacgggtgcctgtaggacagttaaaagaagacataaaacaggcaacattaagttacttctgagtttttatgggtctttttcagattaggtgttcttgaagaaagagaaagaaaaagtctcagtggtaactgtatgtgcacacgcatacactagcacatacacttggggagagaggaaagaaggaattggcattattgagtatctcttaagcactaggccctatgttatgctcaaccctttacagagcactagatggtcagtattattccctaaccccattgactgaggacaaccatctacttatatgttttcatattatcctgaactaaactgtatttacataattactggcataacttcaattccccatgtctccactagaccatctgcaccttctctgcgtgtctgtctagcccatcactatgccccactgcctagtagaaagcctggcacataggtacaaaggagacacaacttaatttaaacttaaagcccgccatcctagttcctcatttggcaagaaagagggagaagaagggggaaaatccctctatttgcccctctttcatcatttaacatagagccaccctctcctgccacaagggaaggatagccacagccagagtgcaaaaaaaaaaaaaaaaaagcaaaagacgtcagatcttgaattttgagtttccaaggtgccgggtcttgacaaattaaggtttttgctttgttttgttttgtttttgtttgtttgttttgttttctttaagggcatcagagaccctaatcctcaggaagttgtggtatttagaaactatttgtttgaattaaggtcctagttaataagagggttctcaaaggcccttggcacttctttttttttttttttgagacggagtctcactctgtctcccaggctggagtgcaatggtgcagtcttggctcactgcagcttccacctcccgtttttgttcaagggattctcctgcctcagcccctcgaatagctgggattacaggcgcctgccaccacgcccagctaatttttgtatttttagtagagatggggtctcttggcacttctaaagctgcagtcttccccagcatttcatcccatgaaggtggactgttgctgccatggacccacccatgggcatgggcagtgggaaggccagggcatcctctgcttcatcccagccccgctgggatcttgagatttggggtaatcaaaaaaggcatcctttttcctaaggtggtggtgaggaggtgatgttctggaaggaaggtacctagactttgtggtccctgccaggaagtggagagtggaaatgtggaatgcctcacactcctcaactaggtaggccttcatgtaccagatgagggtggctttcagttcttgttttgtgtgtcaaagttgctcctgttatcagtgtgtgtttgctgatctctcccacctcagtcactcccggcagtgagtttagggcatcttgggagtggaggtaggttgtggaaaagatgtgtccagagatctcatttggctttggtatcttcctgaaataaatgtcacacacagggctgggcatcttgcatatgctgacttctcttaatcttcacagcaatgatgtgaggcagagatcatctccattttacacctaagaaaggcacagagaggtgcagtggattgcccagagtctcacagctggcaggggctagagcttgagttcccaatgagaactggttgtccccgaagcccttgaatatttcaccatactgcagtgcctttttcatatcacctccctggatctcagttgctccatctgttaaatgatgacaagtgaactctagtcagaagtcagagtggtgttttgtttttaatttgaatgcctttaggcaggtgtgttctccagttcattaccatttgcgcattcccctgtgccctctagtctcctgcctggcccctggcccctgtgggaatttgcagccctgcatctggttggtgtctaccgtttctttcgatttagacaatctagagggcagtgagaaattggaaaggggtagcaggtaagagctctcgagttcagtgagaaattggaaaggaatagcaggtaagagctctagagttcagtgacaaattggaaagagatagcaggtgagagctcttgagttcagtgagaaattggaaagggacagcaggtgagagctctcgagttcagtgagaaattggaaggggatagcaggtaagagctctgctttcaccgcctcctagctgggagatcctggactgatcacctcactttatagaacctacttctctttctgtcaagtggggggtcacagtcatactgacctcaaaggggtgccatgcggatgaaatgagatagggctcataaagcacttagttagtacaaaaatacatgcttaggattagctgctctcaatttccagaaagagaatgtcagccaatgtacacaggcatctgccccctcagacataggatggcatttgcatgaggaaccagaagttatctttgaactcatcattttgaaacccctgtgatgaaccctggagctgccatgttggctcttcaaaccaagcctcagcattatttcctgtcacccagtcaagtgatgctgaacctcaaatcagccagccagtgctgaggccaaaagcagaagtgggtgctattctcttgggaccagaggaccctagcccagccacttaaggaagaagctggtaacaggtgctggctgtgacagacaagaagctgaactggcccaattaactctgccaaatgctttcacgaggggccagaagcaattcctaagtggagactgaggtggaaaatctaaagttctgggaaacaggttattaatcatgaccctaggctgagctcactacctcctggaaatccttcagaaatgtcttaggaaaacttggagtactgctccttcaaagagtggtttctttggaagttgccgtgggctcctatgctgactgattatgaattgcagattagaacacataatgtatccgctcttactggaggaagctgcatttccaaaaagaagtctctttaatgtttcaagaaattacaggctttagcttgactcttcagaactgaataatggcccttcatggcaccgaagaaagtatttggtgtattcttactatgtcccaggaacctaggtcagttactgttttagtactttatcagtgtagtctttaacattccataaatgtacattgaggacctgttagtactaagcactgaactagaggaccagggtaaagacactgcctctggtcttgtggaattctctgtgcaacaagggaagatagacagaggagtgaataattttaatggcacgtgaaaagtactgcaaaagaaatatgcacaagtgctacaaaacaccagacactggatcagcatattgtggaggtcctgatcttgcgctgggttgattccttctgctctctccctacaattcctggctctgggagctttgccagcatttgcattagggagcaactgagagctgcccctgctgaagcactcatttctggcaccttcctatcccccgtggcttcagaggggtggaaagaacacttccttacaaaatgtatgggccccacctgagagggccctgaatctgaagtccaaagttgtagtaaggaaacagagggacgggtgacttttgtagtctaaaatcaccactgattttccgttggtttgtttttataacatttattgtggattttttttttctgattgcaaaattagaatatgttcaagggaagaaaagctagatagtacagaaaaacacacttaaaataaatcatcactcagtgatttcacttctctgtttttgaataagggcctgtctcccaatccccccacccacataccgctgtatttcaagtttagctctaattttaatttctccctgggcaaagtctcatgtttgtttgcatatctcaaaggtgcttgtgttgtgggctccaatcactactatctgcaattggttagagcctgcggccatcatttatactttcctggacgtgtgtgtagattcatctactgctaagaaccctttatgtgttaggcattatgcaaggtgcggtggggaatgtcgaggtaaataagactttgaggttgctcatggccggataggaaaaaaagactcagataacatgaacacattgtgaaaatgtgccccaagatggggacagagtcctgtagaaagcctaagagattggaggagcagtagcatttgagctgagccttcaataaatttttcatgtatttagccaatatttgttgagaacctaatatccgccaggcactgggcaaggtgataggtggatgatgttaaatataacaggcatggcctttacctgcatgaagtttacaagcacaaatggtggcgttaagaagtcaataagcagggggagtgaaagaggagagtgtggctggggtcttccttgaaaaggtggtattcaaactgagaagagggctgggcgcggtggctcatgcctgtaatcccaacactttgggaggccaaggcgagtggatcacctgaggtcagtatttcaagatcagcctggccaacatggtgaaaccccgtctgtactaaaaaaatacaaaaattagccgggcgcggtggcacgcacctgcagtcccagctacttgggaggctgaggcggaagaattgcttaaacttgggaggcagaggttgcagtgagctgagattgtgccattgcactccagcctgggtgacagagtgagactttcaaaaaaaaaaaaagaaatggagtcacttataccaagagtaaaggagggagagggagtaaagaagggtgctggattattccttcctttgctcattattgattctaaaaatctcacttattttctgtattcagtttcctttctattggagaatattcttggggtctgtgaatggtaaacttgcccagtctttgtttgaaaatatcttttgccctcacacttgatatgttagctagatatagaattttttgcatagcatgtgtaatgaatgtgaaagttatacatgcctctttaaaagttttcaatcaaaacagaaatagataatgtacaaagtgaaagtctttcatttcttttctcacaatttctcaaaagagaataatttttttcaaaagagagaagtttcccagggggaaccattggttacagtttgcccttttctatatatactgaaaattgtttaaagtgtaaagtatgtatactttttaaaaatgtgcacgtacacaaatgctgtactttttttttttctaaacataaataatcatgttcacatttgagcaggacacagtagttcacacctgtaatctcaactagtcaggtggctgagagtggatgattgcttgaggccaggagtttgaggctacattgagctatgattgcaccagtacactccagcctggggacagagtgagacctggtctcttaaaattaaaaagaaaatgtaaagttctttttttaattaaaaaatgataatatatgcaattttacaatatgctttttaacaatcaagcatgtacttttttccacatcagtacaatgaaatctccttcattctttgaagttgctgtatagtttctcatgatattgatacaccataatttaactatttttctattaatagacatttaagttgttttcgccccttggttttgctactatacagtatttcactgagtatctttttacttaggtaaatatatctgtagtataaattcctggacatttcaggaatgtgacgtgtctaggaatttgaccccaaaggatatgtatgcacatttaacaagttaatagatattgtcaacttgtcttcccaaaagattgtttcaatttataatcccagagtatgtctggctctaatttttgtttttcttctggttccttagaattcccgtactgattagtcaacagtggaaaatctgaagagatgcaagcaggaaaaagaaattaaaccaggtaggtagtggcactgttcatactctactgccagagcagcacacgtttttgcctgaatatctttatttctggttgaaggaagaaaatacgtaagttccaaactaaattagtgggagattttgaccttatgaagaaaaggcaggatggctcttttcagaagttatatacataacagcatgctacaatttcacagtcaagattctgttttcaggcgttttttttttaatagcatcagaaagaaaatttacctttggtggcttaagaggggatgggtttcccggccatgtacttaagcttaagcaggtggaatcatacacaggagttattagcaacattgggcctggtgccagctttcctctccaccaagtgtttgctgtaaagctgttttcacaaagaccagggcacattatgggaattttcattttaatgctgtaatagaggagcaaaagccagcaaaacccaacccaaagaaatgggttcggcccagtagtctggtgagaagggatgaagatgcagtccctccagctgagaacaaattgccattcaaagagcacaagtggcccacctggcagtatggccaccttgggtccagtgtccatagtttatgatatctaaatgtttctggcataagttaataattttaaactcagggtaacataataatcgactttttacctaaagcagcagtatttatcaacaaatctggtgaatttctttgaattgtcaagttggaagtactgggtccacagagatcttttcacccaccaggcatccatcagcatccatggatgtggttgttaaggtatcagaattgaaggctattctagattggcctacacccacctggaccttctccatagctggaattttcacaaagaggctaaagagcctggggatgagcgcatcgctctgaagagcttgccgaatccactgtgcatctgtccataagctaaggatggtgtgaggactgaaagctgcatgggagagagaaggtcttgtgattttctctctcttcagcactgtagggggcacattgcagctgtgtctggtgcagctcagtttagactcctgcctcagccaggaaaagtttttttcatttttacattaatttagcaggtatttatggagcatcttctataaattggacaccagataacaaagcaaaagtggcacagtccttgccctcaggaagcttgtgggtctggctgacagtagactagtagcagtagtctgcggtaggtccagagggctagtgggcagagggtgctgcggcttgaaaggtatgcaggagatgacttggagaagagtgggcggggacaggctgggggcttgcggagcagcacagcgaaggcctggaggcttggggggtgcagcactccatggaaattccatgggccaaacacagtgcagagggggttccctggctggagttgagtctggaggtgtccatgaatgaatctgaactttatcctgatggctctgaatggaaagtcgctggagggctttaagcaggggagagttgtgagtcaggcttaggaaggagactgtctagcttcagtttgggtaagggactgagagagttctaagggactgagagagttccgcactctgcctggcccactctcatcacctctcttcttagcgcctgtgctcctccttcccttggaacttcaagaaggcaaaggacagagcccgaagtctgagataagatagactccttggggagaaaagaggaagtggtgctgggtgggtgggtgggggcacccagtgtaaagcagagtgtacaggttgccttggacaagtcacttcacacctatgagcttcagcttccttatctattaaatgaagataataagtattactcttcttttctctcatctcatgagatatcatcatgatatcttaaaatatcatggatattttacatgcccagctagggcttccagagaaatctctctgtttcgtttgccatgtaaggatttgttgaaatcctcaagcgcacattaagtgcatcctgtcgctgcagcttatcgcctgggatgagagcagtgaagaagccctagcctcaggatcagtctcacagctccctctccctgcagccaagaaggaccggtctacagaggggagggagcaaacactgaccgaaggccaggtgtgtgcttggcaccacccacagacaaaagagtgcttgggcagagctgctagaactattatttaagccatgtgccagatgtgataagcacttacatccttctcagcctcatttagtttgatcttatgaagtacatatatattatctccatttgatagatgaggaaaccgagactcaaagaggtggaactgcttgctggtagtgacacaattgggaagaaggagaagggccggagtctggagttcgtgctctctgacttctgtgggtagcatctgccattctgctggtgctccttcagacctttcagacagtgcagaggacacagaggaatcaagggacagctgttctcttacaaaccttgaaaatcctgtacagagccctcagataaccaaaacgtggtccagaactgaatcctggggccaacatgcccatttagcacttctctcaatcagtccttttccccaggtgcattaaacagggcagctgccttcccaccctatgggcaaactgcttggcagctaggagtgtgcctgctcatctcccaggctgctttcctttgcacctcagcaaggagggcaggccgtgcatccagggaagcacatagttactccttctgccagaaggccaccccctaatctggtttaccgtggacactgaagtcactccctgtctcctggccatgaggaaaactcctttgagaggagcctctgaagccagtggagagagtaaaaagtgagaatcctgcctagttgaacaggcagttcagcctgttctggaaagagttaaggctgtgtccataccaagccatttaaagaatctgcccagtagaatcaatattgtcaaaatgtccatactacccaaagcgatctacagaattaattccattcctatcaaaattccagtggcattgcttacagaaatagaacaaataatcctaaaattcctatgaaaccatgaaagaccccaaattactaaggcaatcttgagcaagaagatctaagttggaggcatcacacaacctgatttcaaatattataggctggacatggtgactcacacctgtaattccagcactttgggaggctgaggcgggagttcgagaccaacctgggcaacatagcgaaaccctgtttctataaaagaaaaaaaaaaaatccaaaaagtagctgggcatggtggcgtgcacctgtagtcccagctactcaggaggccaaggtgggaggatcacttgagcccaggcatcgcatcaaggctgcagtgagccgtagtcatgccactgtactccagcctggctgaaagagtgagattatgtctcaaaaaaaaaaattataatgctataataatcaacacacacacacacacacacacacacacacacacacacacacacacacgactattactcagccttaaaaaagaaaatcctgacatttgcaaaaacatggttgaacctggaggacattgtgctaagtgaaatagggcagacacagaaagacaaatactacaggatctcagttatatgtggaatctaaaagagttgaactaagagagagtagaagggtggtttccagagagagtagaagggttgttggggaaatggagagatgttgagcaaaggttacaaacttgcagttataagatgaataaattttggcgacctaatgtacagcatggtaattacagttaataatatggtattgtatacttgaaatttgctaagagagtagatcttaagtattctcgtcacaaaaagtaactgtgtgaggtggtggatatgttaattagcttgattgtgataatcatgtcacagtgtgaatatataacatttttatttgtcattcataccttaataaaactgaaaaaaatttaaagaatctgcccaggtcacaggaagccatcagtcataccctgagctgttgtgtaagctcaaagagtatggtttatagcatatggatgagtgctcttgtgccaacgctgggctaaacctttacatccagtgtctaattaggtagtttctgttattatccatgttttaccaaggaggaaactgaggcttttggagattacatcatttggccaatgtaccagagctggaaagttgcataactaagatttcacttgagctttttttagctccacatcttctattttttcagctacaccaaaacgacttctttaatttagctttgcttttctgataatagtaaccaccaccctttattgagcatcttgtcatgtgagccaggcattatacatccattatttccaatcccagtagaaccttacaagtaaagtatcattgtccccgtttcacagatgaagaacctgaggttcagagaggtcaggaattttgcctcacagatttcatctgagactagagtgagctctcaactatcatcctgtacttccttcattccttaccttttcaggttcctaggaggaaaggactcaaaaaaattatgcatgaatttcctttaatttcacaacaaccctaagggttgggggttgatatctctgttttacaaaagaagaaactgaggctcagagatgttaagtgatttgctcagcgtcatgcagctagcaattggtggagccccgattcatacaggctctgacccatagcttaagcttacttgcctcccccattcccacccctcacccctcttcggctctgtctccttgcaatgggggcagaaaatccagcctttatttctccaggtcctagtagtcctgggagtctgggggatttccagctcctttgaattcccttttttggcctctactctgcctccagcacctctcttaagagtccttttcactgttgtcatagcaagggtctcatctggagggaagctgccttgaggttggaactatttggctgcttatcagcaaggcttcagggccttgccatagcaactttccaagccacccatcttgtgacctgttctgactcagggcccctgggaatcccctgggtgcagatgtttgcagtgactaggatgcagcagtcggctcccaggactctttttctggccaaggccattttaggaaggcttctgttccagctgtgctgggagagttgaggtccagagcctccaaaccttaagaatgcagggttatgtgatgtctagagctggagtttttagccaggggcttatgggttaagagccccctgtgatcataggtatggttacacacacacgcagagaatatatacttttctgggcaaagtatctgtagcttccctcaaactctcaaatgtgtctgtgacccttaaagtttaagaacactggtctagagagaacccaaagtgttgtgggccactgtgctcccttggccaccagcctctcagatgccagaatcttgagagagcacaccaggcctctagtgtttctgcttaggcatgaactgggatacagtatcaaatattgctgaagttcacaattataactataaatgtacagctgtcctttgggatgccccaagtacttttatttatttatttatttttttgagatggagtttcgctgtgttgcccaggcaggggtgcagtggcatgatcttggctcactgcaacctccgcctcctgggttcaagcaattcttctgtctcagcctcctgagtagctgggatcacaggcgtgcaccaccatgcccggctaatttttgtatttttagtagagatggggttttaccatgttggtaaagctggtctcgaactcctgacctcgtgatccgccagccttggcctcccaaagtgctgggattacaggtgtgaaccactgcgcctggtgcccctggtgctgtaaaagtacaactgtcctgtggatgccccaagtacaaccacgaaaatgcatgcccagcaccccaaacatgtcaacatgtttgaacatagtatattcaccccataagtggtagccaattttttattttattaaatattaaataaattaattttaaacacatttttgttttgttttactcttatcattgttattatttatttggtcaggagccaggaatcagatggttatttagtcactgagtgattaaaatctatatgtcaggagctgtgctatatttcaaagatacagtgacaaacaagaaaggcagggtacctaccctcttggaatcagttggaatggcagataatgaacaaatgtatcagcatcatgcctggctcacgggacatttctgtgtgtatttgtcgaatgactgttgaatgaatttcgactgagtcattattaggaagaagtcaaggtgctgcaggtggcaggcaaggaaacttcatctcttctggtgggtcagggaagaggaagagggactcaggctaaagggcctacgccccaggctgccaggaattacacaggactgtttacagggggctggcattcccatgaagactggaggtgtggggggagggctggaatactgaacaaccaagggcttaggaaccttgagtaaatgatgttaatgtgggccagaggtacggatgacatctacactctgctcaagtagtgatggtccctggcttgcaaacatgttgctcttccaggttccaagggaggctgttgttcaaccggtatttacctatgtagcaagttctgggttcggaaccctacttctctcaggaggcaggaaggatggaaggacatccctcctgcagctgaagacggcagagccccagccactgctggcagtggccgtggacacacagtgcagtgtctgagcagtgtgtgaagagactcccttactgtctgaagggcttcactcaccctacactagtgagaagcctctgaatattgtcttggaagggaagcattcacatattaagggtaaaatcaaagtcagagcaaaatttaaagtctgctctttgcccctcaagaccctgaaagtccccagtgactgtcattccactcacctcctctcccattcactgctccccagccccatggcctcttattagtctttctgggcagcaggctccccttgcctcttgcatgctgtgccctctgcctcgcatacttagatgtatatgcagaagtggtttctaaactcctctctctcatcatgtgtgtgggctgtgatacccaaccatcagtaacagcagctgatgaggacagtgatcattagctagagagcacaccctcagtcgctccacccagcattattagaataataataattccccaccaggtccccccacccggcattattagaataataataatcccccaccagatccccccacctggctttattagaattactatgagaaactatcctctagtgattctgttaattgtgatttttgcccccctactaccactggttaagaattacgggcttatgaactgagctccctaactagaccatggacttccctcaggggcacaatggtatcttactgtttttgtatctgtggtatctagtcccaagcctagtatacactgagggatcagtgaaatttttctgaaggaatggatgaatactatagagataatatcttgcttcttttcattctccacggtgtattttggagatgcattttatagaattagaggaactagaattgacacaaactgtcttcaacccatgaaagtctgtgcttccatgaaggtctctggaaagcagcagaacagtccatctggatcactgcttggtggctgggcatgctgggtcctccccgggcctcctgctgcggatgtatgatctaaatttgccgaggctcagctacacagcaaggttctcagagagtggcagtctccatcctactgtgaaaggaggggcagttttccaaggacttccttgctttcctgcccttccttcagagctagaagactcttacctcccttaccccagagctagaagtaacattagagattgcttcagttatccacttctgcataatccatcacccctgttactcagtggtttaaaacaacagcaatagtttcttatatctcatggtttctgtgggtcaggaatttgggaacagcttggctgggcagttctggcttggatcttttatgcagttgcagttagatggtggctggaactggagcagcttggggccagcaccgctgaaggctggccggctgctgctctttcctggccgtctcaggacctctcccctgtggttacttcatagggcctgtttgggcttcctcacagcacggccacctcagatttcccatatgcagctcaatgctctagaggcaggtttccccagagagagctaggtgaaagctgtataaccctttatagcctcatcttggaggtgacacaaaatcatttttgttgcattctatttgttagaggtcattaaggccagctcgttcggggaaattgaaattaaactctacctcccgagaggaggaatgtcagataatttgcagacatgtttcagaaccaccacagagatacccagtttcccccttcattccacacttgagactcccgaggtttgaggggaagagccttgtccagaggtgcccagcctggcatgggcagacctggagtgtgacccagcccctaggcctttggcaggcctgccaggaagtgatctcactttcccttccttcctgtcccctcacagtaagatagagactgccactctctgggaaccttgctgtgtagctgagcctcagcaagtttgataatacagacacagcaggaggcctggggaggacccagcatgcccggccaccaagcagtgatgcagctggactgttccgcagctttccagagacctccatggaagcacagacttccatgggttgaagagagtttgtgtcacaattccagtccctagccctggccctgtgtgaagtagtaacaccgccctgccagtaggatatagctgctgaggaggtaagagttttaaaaaattcataccccaaaataattatttttactcttgctgtgaagttagataccaaagagtagaatgtggtggtagaatcaagagagtcaacccaacatcactgaaaagattctgaaggtttgtatccagctgaatatccaaaacaggatgttgcttaagcatgggtaaaatgcatctggtgtatgttttagacagccttgtactatgttttccagggacttgcttactttcttgcccttccttaagaaatgccttattatgaagctgggggcaggggaaaaagaaggtcagaaaagggaatgggtacttttcagtaaatccatactacatgccaggcataatactaattcactcccctgctttatagcctaatagcacaggctccatctggctccaagctccctaaccttgctgagtttcagctgcctcttttgtactatgggataatgatactttctgtcatagagttgctataaaattaaatgcttgtaagatgcttagcacagtctggcatgcagtaagaaagaactgtgtaacaggccaggcaccgtggctcaagcctgcagtcccagcactttaggaggctgaggcgggcggatcacaaggtcaagagatcgagaccatcctggccaacatggtgaaaccctgtctctactaaaagtacaaaaattagctgggcatggtggcgcacacctatagtcccagctacttgggaggctgaggcaggagaatcgcttgaacctgggaggcagaggttgcagtgagccaagatcgcgccgctgcactccagcctagtcacagagcgagattctgtctcaaaaaaacaaaaaacaaaaaacaaaaaaactgtataactgttggctccaattaatccccacagccactttttaagacaagtgtgagccctcccattttatagaaggggtgtctgcagttaggtgaggtgcccagcatcatgtgccactgtagggacagcagctgagactctgaagtccttgtggcatccaccacaccacattaccctccgggcagctctgccagggctttcctgacatgcaatagttgggggcagaggaactcaggaggctttgtgccctacaggagccccatgtcaggtcctagagcaagaacatttgaaaaaccaaggccaggaatccatttatccacttaggaggctctatagggagcagggttacagagaatgttgtacacagaggaaatagtctagtaaaggctttgaggtcaggaattaaatgaggtttgaggatttaaagagaggcccagtgtgaccagagcaaaatggaccaagaagagagtagaaatgagacaaaggctcatctgcagaggcaggcagggccaggtcaatgcagggcttcagggactggcatcaggagagtggatttcactagatgtgaaatagaaaagcatcagaagttgaacgaagcagggaaattccagtgatccaatttccattttgagaacgttaccctgcctgccatataaaaaatagaccctgggctaggggtgagagagacacaggactctggtcagggtctctgctcagagtcctggtgagacattccggagcctgggtggtgcatgtggaggagagaggtcagcagattcaagctctgttttgcaggtagaaacaaaaggaccaggctgggcactgttgctcatgcctgtaatcccagctctttgggaggccaaggtgggaggattgcttgaggccaggaatttaagactaggctgggcagcatcgtaagaccctgtctctacaaaaacattaaaaaaaaaaagaagaagaaatgacaggactgggtaaagaattgtccatgggtggtgaagaagaagcgaggtcagggatggtcctgggtttccagctgggcagatggtggtgcccttgctcagttgggaaggccgtggcgagcaggctggtgacttgacgtctgaagcttgcagtgctgtgggatagccaaatgacacgctcaataggctgagtcagaaatctagaactcttaagagagggttgcagctctttgaaggtcaccaacatagattatttcgggaaaggataagagcccctcgggagcaaacagaagagactggcgtcctaacacaaaggtcccggcagtagcaggtgcctgtgcagactggttggagggaggcccaaagggtgtggtgtctggaagtcccatgaagagaatggtccgggaagaaatgagttggaagaggaggacagaaaggtgtccctggggataggcaccgtagaagtcactcaggaccttgtctgacttgagcaccctgaccttcccttcctatcactgcctgcatccaggcctgcttgggtctaggcctggcaggtgcagaggccaaggcccggcctctctgcctccaaacaaagcctcacccagggccactctttgaatggcaacaggcactgcccaggcaggcgacaggctcctctctggtgaccttgtgctggatgtgccccaaggcgctgggtagggctttgcagccagccccaggcaggccacacatggatagaaccggcagccctcccttttcccaggttcttggaatattctcattttggggctctgagttttctgttggcctcagtgcctctcttttctggctttctatcacagagagaagccgctacccttgaaatttgatgaatgcctgttcagtaggccctggcatttctgtttccacggccctttcgtccctcagagaagccttagagagcattttgcccacccctgataaaacttctcccataagaccaggtcccacttctgtgcttcatgtcttctgcaaaagtctgtttgctttttgtatggtttctgcaaatactgaatttttgaaaaagaaaaaaaaacaggaaatgacctttctagtatatttggaaaacaatttggagcttgtaatggaatctgcctgagcaatgaggactaatagctgcagacttggaacagaccatgtagctcttggcagagcctggggcctcttcagtttacaaagctggggggagtattagaaacccacgggagaagtggcttcctgtggggaaatgcccagagcaggcacctgcaggcactgtaacctctgaccccagggccccaaaaggcctggggacagagtataagggcttcaccctttgtcctgggcattcaaggtcaatcacatgtctggcaatcatccagatcccacaagataccaaaacctcctgaggatgaggaaaagaaagagcttcattctttagcaccctgtagggctcaggctgagctagaagattctagattgtttttagactcaaattgcctgttggctctctgggtccctctctatccaacttttctgtagatttcagcaaaaaccacctcctcagagaggcctttcctgatcatacagccattaactgcatgatccacatgcagagaaccctctcctcttctcccatagcacataccataatctgtgataagattcatttacttgtgcagtgcctttttctctttacacattgtaaatatcttttttagtttccagtatataccctatgcccggcacagtgcctggcatgtagaagttgctcagtacattgaatgaataaatgaaatatcaagactggaagacttggaggccaggtgcggtggctcatgcctgtaatcccagcactttgggaggccgaggcaggtggatcacttgaggtcaggagttcaagattaacctggccaacatggtgaaaccccatctctattaaaaatacaaaaaaaaaaaaattagccgggtatgttggttcatgcctgtaatcccagctacttgggaggctgaggcaggaaaagcacttgaaccggggaggtggaggttgcagtgagcagagatcatgccactgcactccaacctgggcgacagagtaagactccatctcaaaaaaaaaaaaaaaagactggaagacttggagatcatatttcaaacttcattatttagatggtgggaaaggaagctgagagagaaggggactcatcaagggtcaccctattgcgcgggtattgaaccagatcttcagccactgttatgatgcagggccgcacattctttgctcttctttccctgtaatctagaacatcttctattattcacttgttcatcagctattcattgagcttcaagtatgtgcagggccttctggacgtaacagtaaacacaccagccagggtcaccacttctggggaatttatattcttaccacacaacaccataaagcaccaaagaaggaagttttaatcttctgtagcaccgttaaacagagtaaaaacaaaggagctgaatgaaatgtccaaaggcaggttttactaactcagcccccaaatgaaccatcctaatcatttattaattgcattccacttacattccccatcacttactacactttttgcatcaccatcttattgaatcttcataacagccccctgaactgcagggtgtgactgttagccccgctttgctgaggtgaggggagttgtgcacggcccacagctggtaaacaacaaagctgggctggacgagcaccctagatgccttctaccctgccacccattcccctcagagatttgtaatgtcatcagggactcccaagggggcagtgtgatgtggggaaaagagctctggaccgggagttaggaccgctagatcaagaaccctgggcaagtgccttgccctttctgagcctccgtttccgcagctgttgatgagaggcttgtctagatgagctctgggatgtctttcggttagattctacaacaacttttcattaattgaacaggtatttgccctgtgatggtcctgaatgaatcaaagctgtctccctgctggagataggtcatgggctgttggaagtaaaggtttagaactcaggagagaaaagactgtagacccatgtgttagggcatattagtaatcatatattgagaacatccttccgtgtcaatatacataaatggattggcctgattctttttaatcattgaaggtttctgaactgagcatgaggatgagccaactgatgttggggaatgtccctcttgaagtagaggacagagggcttgaggatgaattgggggtgggggtggtgaggaataagtgagaagactgggggcagaaaagccagttggggaaggttgtagtagactggatagagatgatgaagcgtaactgaggccatgattactgcatggagaaaatgggaagatggacctgaagagagaaaataattgaacctgggtaattgagctttaaggtgcaggatgccttcttaaagagaggaagaagtcaggcatgagttacgggtaataggtttttgacttgcataattgattgtggaggtggctcctgactaagggaatgaatgagagagagtcctggaggagggagagcataattttgttgatatcctccgggaggattcatctagatgtctgcagctcagcaatgaggggatcgacattgaaatgaatggaagatgatgtcatgagagagaacgagacgtgtagaacaattagagaaacattagaagagagtaaaggatggaattaaggagatatacaagtagtcaaggtgttggactaggagaatgtaaaagagcattctgagaagttgaaggcagttgctttactgcctgagccttagtttcctcatttctaaaatgaggattagaatcgtgcctactcgttgtgtttagggttacatgagagaatgtgtggaaggcacttaccttgcatatcagaagtagaactcatgcaataattcatcattcattccgtaagtaagagtcaagcaccagcatatgccaggcagctgggccagccctttggagtacacagaggagcaaaagggaagtctgagtgcctgaccttgtgggagaggaattgtgaaagaaagaagactcaatatcataaaaatgtgatttctatctacattcaggtaccagatattactatatatatttaatgcagtcctgataaatacaagataaattgggggacaagttaaatgactattaagtttataagaaaacatagatcagcaaaaacagccagaaaaaaaaaatctaaagtcaaaaaagatttgagctatgagaaggaaaccatcctacaacatgatactagtatatgagtagacagatcagctggagagattaaaagattcagaaacaggccaggtgcggtggctcacgcctgtaatcccagcactttgggaggccgagacgggcggatcacgaggccaggagatcgagaccatcctggctgacacggtgaaaccccgtctctactgaacaaaatacaaaaaattagccgggtgtggtagcaggcgcctgagtcccagctactcaggaggctgaggcaggagaatggcgtgaacccaggaggcggagcttgcagtgagtccagattgcaccactgcactccagcctgggcgacagagtgagactccgtctcaaaaaaaaaaaaaaaaaaaaaaagattcagaaacagaccccaatacacagttttgtatgtaacaatgatagctttttacatcaatgaggaaatgatggattactccacaaatgatttgagataggtagaaaaaattaaggtggctcgctaattcataccttattacagataaattctagatcaaagatttaaatgtgaaaagggaagccataaaagtactagagaggccaggcgtggtggctcacacctgtaatcccagcagtttgggaggctcaggcaggagtatcacttgagcccaggagttcaaaaccagcctgggcaacatagtgagaccccatctcttaaaaaaaaaagaattagctgggcacattagcatgcacctgtagtcccagcttctcaggaagctaagctaggaggatctcttgagcccaggagttcaaggttgctgtgagctaggctggcaccgctacactccagcctgggtgactccagaccctgtctcaaaaaacaaagtaccagaaataaacaaagggatttctttactaatcttagagtggggaagacatttctaattatgttacaaagcccagaaaccataaaataaaataaagatcaattttactaatgaatataaaaatatgtatgtggggagaagtgccgaaaaataaagtcaaagtacaaatgacaagtaaaaaatactagtaactcctaattagacaaaagactaattgccttaatatattaagaactcctacaaatcaataagaaaaagacctaaaatccattagaagtgggcaaaagaatttgaagaaacagtaaacagaaaaggagatgcaagtgggaagatgctcaggttcactcctaggagcagtaggaactaaaacaatcaggcactggttttaaaaccaccttttagattaggaacaaaacagcattaagaagactgtggtgaaggaaagtgctcatctgatatacctactggggattgctatggtttgaatgtgttccctccaaaataccaatgtgataatattaagaggtagggcctttaagaggtgattaggtcatgagggctccttccttgtgaatgggattaggcaccttttataaaagggcttgaggccaggcatggtggctcacgcttgtaatctcagcactttgggaggctgaggtggctggatcacccgaggtcaggagttcaagaccagcctggccaacatggtgaaacctcatctctcccaaaaatataaaaattagctgggcgtggtggtgcacacctgtaagcccagctacttgggaggctgaggcaggaaaatcacttgaatctgggaggaggaggttgcagtgagccgagaccatgccactgcattccagcatgggcgacagaacaagactccatcaaataaataaataaatgggcttgagggagtgagtttgcccctttttgcctttctgccatttgctctgtgagaacacagtgttcaaggtgccctcttggaagcagagagcaggcctcaccacaggctggcgccttgatcttggacttcccagcctccagaactgtgtgaaataaatttctgttctttagaaattactgagactcagatattttgttgtagcagcacaaaacggactgagagacaggaactaacttctgtggggagaagttggcaatacctgttataataaaaaagtcacagatcctttgaggtggcaattccacttttatagaaacaatcctcaggtccatcaacagggaagtaattaaatcaatctacaacagtgagacaacagagtatcatgcagacaataaaaggaacaatttagttattactttgggtttgttttcagtgtgttgatgtaatcagtgctgcagtggcttcagagtgatctacagttgtttccaaggtgtgtgtgtgtgtgtgtttgtgtgtgtatatgtgtgtgtgtgtgtatatatatatatatatatttttttttttttttttttgaaatagagtctcactgtcacccaggctggagtgcagtggcgcaatcccggctcactgcagcctctgcctctcgggttcgagcaattctcctgcctcagcctcctgagtagctgggactacaggcgtgcaccaccacacccagctaatttttgtatttttagtagagatggggtttcaccatgttggccaggctagtcttgaactcctgacctcaggtgatccacccgcctcagcctcccaaagccaagacacatttttaaatgaaaaaaaggcaagatggaaaataaatttttttttttttttttgagacggagtctcactctgtcacccaggctggagtgcagtggcacgatctcggctcactgcaagctccacctcctgggttcacgccattctcctgcctcagcctcccgagtagctgggactacaggcgcccactaccacgcccagctaattttttgcatttttagtagagacggggtttcgccatgttggccaggatggtctcgatctcttgacctcgtgatccacacccaccccccgccgcctcggcctcccaaagttctgggattacaggcatgagccaccatgcccggccaaaattttgttttaaataaaggaaaaaggaagggaaggagaaaaagggggaacatatatattgcataaattttgtctggaaggacaccaaaacgtgcttgccttggggagggtgtctggatcggatgggaagggagactaagctcttatctctgtccttttggaccttttgagttttagaccacatgcacacataatctaaaattaagtaattttaagatgaagtgaatgtgttcactataaaaaggaaatataacagattttaaaattacttataaaaatattaatgtatgtaattatatcactggtattctttttcatttaactatatgtgaacattttgccatttctttaaaaaatattcacaaacatcattttaatgcctgaatggtatttcatttagatacaaattagttaagtatgtatatattaataattctccattgtccgtttaggacatgtgacacatccatttaggaactcattttggtgtctttagtttcctgctattataaataatactgtgggccaggcgcagtggcttaggcctgtaatcccaacactttggaagtccgaggcaggaggatcacttgagcccaggagtttgagaccacgagtttgagaccaccttggttaacataatgagattcccatccctgaaaaaaaatgagccagacatggaatagtcccagctactcaggaggctgaggcaacaggattgcttgagcccaggaagttgaggctacagtgagccatgattgtaccactgcactccagcctgtgtgacacagcgagaccctgtctcaaaaaaaaaaaaaaaaatactatgaggaacatctttgtacattttatcttcatgtagatcttggattattttcttagaatagattattataaactgatttagtagctaaaagatatggaaaaagttgaggtttctggatacacactgtcaagtcactgcccaaggaggtcttggaagtttacagtctcattaacagggtttgagaatgaccattttctgacaggatttccaactctgaggattctttatttccccatttgctgttgactctaaagatgagagggtgagtgacgaatataaatatgggagaaaaataaaacgatgtgtttctgctttcgattggagagctccccagagccgtctttggaattgctgttccctgaggggatatggtagccagagcatgttggcccagctgatgttttctaggattggtctttgagtgtggcatttgctgtctctgtgtcccgagggccagtggcctgcactgggcagcctgtaacatcagatggcattgtgagatcaaagccccaggagacattccagcatgaagctggcctttcagatagagcctgtaattccatcccatggtgtcaggtcctaggacaagaacacctgcacagcactccacggtgcacggaggcccttctcaacagccccaagaaggaactgcggctcctccccacagaggacaggcgggcagcaggggagaagagggatagacacaaactccctctccttcagaggcccgagagtgaaatccagcgagtgtgcatggagcgcctgctctttaccaggtgctggatgagaatcagggaatgcagcggccagaacctgttggctcagctgccaggattaggtttcagctggacatgggaaaaatccagaccaaattcctgttcccgtggagctgacagtctaactgaggaagagccgaggactcggaggctccgggagccagtgtggcctgctcggggtttgtcattttccagagcagcgggtttcaggtggggctgaggcccttctgagccgtggctgtaaaccggcctcactcacctcagagggcagctgtggccactgagtgcgtgatgtgtatgaaaacacaggcacctgggccatggtacctttccttatcgtaggaattgtcagcatcatttttatcctctgttattactgttattatcataagccattttcctgtcctgaagcattgagcggtttccccagaggcagagcgcaggagtgaacctccgtgacctgtagaaggagccacctctggaacttccgggaattcttttagccaaggaggagccagagcgtgactagggcagcgcgcaaggctgctaggaagataggcagggtgcgccatctgctgtagccggggggaattgccgtggacagtgtcctggccctcctctattttacacaggggaaatgaaggccccaagaaaggcagggtcttgcccagggttaggtggcagagcttgggtttaaggtcacgtgtctcattctttgctctttctaccataggacacctccctgtctcacctgtctgatctttgagggcccctaattcattctttaggtgtttcttctgagctaggtgttgtggggggatgtgggccttgccctccatactgatcctcttctctgtctctctctttctctctctctctctctctctcttctctctctctctctcacacacacacacacacacacacacacacctgcagcacttactggctcaaccccaccctgggtgccttctgggcacttctgccaatgtcagctaccttctaaaagcattgcacaataatttgggtttataaaacttcaaccattgaaaaaatatagacttagaaaacgaaagttccccttaatcacaaagaaccacagttgacagggttgatagatgttttttcagatttttttttcatatgtctgctatctttccccacaggaactgggttttattttaggtgttgttttgcaacctctgtttttcagttgccagtttatctcagacattgtcctatgtcagtacaggcccatctggcacatttctttattattttttttttactgacatgtcattgtatatatttgtggggtgcaacttgatgttttgatacatatatgttgtataataatcagatcagggcagttagcatatccatcatctcatgcatttatttctttgtgatgagaatattcaaaagcttctgtagttattttgtaatatagaatgccttttttttttttttttttgagacggagtctcgctctgtcttgcccagggtggagtgcagtggcgtgatctcagctcacggcagtctccgcctcatgggttcaagagattctcctgtctcagcctccagagtaactgagactacaggcgtgtgctaccacacccgactaattttgtatttttagtagaggcgacgtttcacgatgttggccagcccagtctcgaacttctgacctcaggtgaactacccgcctcggcctcccaaagtgctgggattataggcatgagccaccgcacccggcctagaatgccttattgttaaccatcaccatactgtacaatagaacaggaacttactgctcctatctaattgtaactatgtacccgttgaccagctttccatcctttcctctcctctcccctccccagtctctggtaaccactgttgtattctctccttctatatcaacttttttttttttttttgacagagttttgctctgtcacctaggctagagtgcagtgtcatgatcttggctcactgcaagctccgcctcctgggttcacgccattctcctgcctcagcctcctgagtagctgggactacaggcgcctgccaccacgcctggctaatttttgtttgtttttttagtagagagggggtttcaccatgttggccaggatggtctcgatctcctgacctagtgatccacccgcctcggcctcccaaagtactgggattacaggtgtgagccactgtgcctagccgataacaaatttttttttttttaagattccatgtatgcgtaaaatcatgcagtatttgtgtttctgtgtctggcttatttcacttaacattatgtcctccaggtttatccgttttgtcccaaataacaagatttcattcttttttatggctgaatagtattcctttgtgtatatatacattttctgtatccattcaatcatgttggacatttgggttgattccatatcttggctattataaatagtgctgcagtaaacataggaggtcagatgtcttcttgacataccaatgtcagttctttggatatatacctagtagtgggattgttgggtcatatggtactgtttttaattttctcaggaaccctccatactgttttccatagtggctgtatggcacatttcttttttatgactacttcataattcacgcgatgcctaacctcctggtggacatttgggtggtttcctataggctgctattactgaccaggtgcagtaaacatcctcacactagagaaaacattgggcatttgcctgagtgggtctagaactaggatttgctgggtgggcccatgggcccaccccactggactatgaactcctaaagtcaggccagtgcttagaccacccctcccacttactaattcaggtctgcgaggtagccagagtccatgcaatgactgctatctaattgccttcagaaaaccataggtgctcaatgagagatactagtatccccttcgcaaattaaccttttgttaatatagtagcagtacttcttgttgccaagagtacataaatggacaatcttgtgtgctactggtgggaatataaataaaaacagcactgactttataagtctttctgccaattttttgtcatcatgaataccactgtgctatttgggaaggcaactgggaaatgtgtcaaaaatctaaaaattatttcacccttccctttagcccagcagttctacttctagggatatactctcaggaaacaattagggatgggcacagagactttcataaagtcccagtgctgtgtgtggcggtagaaaacagggaagtacctctgtgttcatttctggaggcctcatcctagagtaaatcatggcccatccaagcatgctggcacaaaattcatgtggagggagacttagtgacatgttctaaagcgtcccaaagagtaggctacaaaacacaacataaggtatggtcccaaatcatttctaaatgtatgtggctcttctttatatatgtggcactcttctctcctttctctagactgtgttaccaagcaccagggctgttaactgctgtctctgtagtaagaactactaatttattttttctttttttcgagatggagtctcgctttgtcgcccaggctggagtgcagtggcacaatctcggctcactgcaagttctgcctcccgggttcatgccattctcctgcctcagcctcctgagtagctggaactacaggcgcccgccaccacgcccggctaatttttttgtatttttagtagagatgggatttcactgtgttagccaggatggtcttgatctagaactactaatttcatatctttcctccccactccacctctcttctgagctccagcctcctagttccatgtacctagcctacctctccccttggagggctcacaggcatctcaaagttaccgaataggccaaacaggactttatgccctcaaatattcctcctttgttcttccatatgtcagcaaaccacacttctgtccacctacttattcacaccagaaacctaaattacctgtcaatccaacactacttcttgttggttcgatttccaagttatatctagaatccttcccactgcccccctcctccacccaccatcttggcacctgaacttcacaggagcctcctaacttgccccttcccagcactgctgtgcccggccgccacagtcacctttgaaaatgcacggctgctacttcatggccttgcctaaagcccctcaggaaccaagttccagatgtggtctggctcctgcctacctcagcagtgtccttggtgtcattgtccctcttctgccatgctcccgcctgctggctctttctgtccttccaagccctcatgcctccctccctcagagccttcacacatgctgttcccctctctgtagtgctcttcccctcactcttcatctgcatgacgcctcgtcctccttggttctcagctaaaatgtcactttgtgacccccagccttgatcaggtcccagtgatcactccagcaccctgcattctcccttgaagccttgagcaccaaggccatgacttaggtacgaggtgactttatgccacctgtagtagatggtaagctctgtgaggccagggaccatggccagtttgttcatggtggtatctgtgccagtgcctggcgcatggtattaataaatgtgtgtacatgtttgtcaataattttatttaaagaaaagtctgagcccatgttctttaaaatgttgatggtggttgtctgggtgtggaattatgagtgacttgttttgttctttgtacttttctgtgctttttgctttgttttcaataagaggcaataactgtcattttgacagaagccactgtgctggggaactggagctgtcctctctgcagaatgcatctggacttacctctgcccccttgccttctgtccccacaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcaggttagagccagcaggtccttggcactactgcatgccagaggccctctgccgggccccgggctagcctccaagtcctagactgcccatactttcttagagaagaaaccacatttaagtcaggcctgccccatggtcagtggcagagtccagcaatctctaggttggaagatgtttgagtctcaggccccaaggactcctctggacaggcatccgggactcttcctgtccccctgccccctagcccaggtccctccacttctcgctatccccacagctatacctggctctggccactcacagctctcacctggctgactttagcggccggcttccctgggctccctacacccatctccgcccttcctgttcagctctatgcagcagccagcagaccccatttaaaccattctgtccatcatgcttctgccaaaaaaaaaaaatcccccagtggcttcactgagtgaagctaagcttgtcacattgccctggggcagtcctgctgtaggccgggccctgcccaagtctcacccggtgccactcctctccctgacaccctccagctacatctacctttggtctgtttctcagtcaagcctctccaaggggccttctctgagtgctagatcagccttccccaatcacatgaccctcatcactctctgacaaggtctcaggggtctaaatgtgagcgccgggagggcagaggccttgcattctgtttggcacacagcaggtgcttggtaaccacagaccgaatgacaaaaggaaacagcatccacccacccaagtcctggctggaacacccccaccccctccattcccccagagaaccccttggctcaagtccacagtcagcctgggaatttccttgggaagcttccctgacccctgcacggctgaggcctttccctcctgctctcacagcgccacagaggccgtgtgtgcttctcacagcacagccatcaggctgcaactgtctccccgtgggctgtccggagggccacagccctgcccctccctgggtagccctagtcttcttgcccctcactggccagaagtgaatcaaaagtacagaacagagaagactttgccggggcttggacccagccctctcatgttacagatggacaaactgaggcccagagaagttggaggacttgctctgggccacccagggagttaacatagaatctggccggcttgagagagagcccccagcaccctgtcgacggaaccccaccccaaaagccttccctgtcccataatctattcattctcctctgtcacgtggcccaggcagaacctccacaggctcaccctgctcgcctctccagcatcaactctcatcctctcgccagccatagtcaagtactttgatcgctcagaagcccctgtgggccttcacacgctgcacctctgtttgcttctcccctccctccccttgcctggctgggttctcttcattcttagagacccaggcatctgctcagctgagaagccttccctgaccgcagtacccctcccagaccggggaggcacctcttctccctgctgcctccatgagcccactgagcataatggccctgctctagactgagcttctccagcacaggctctgtgtcttgtgccctcggtgcctggtggtgtttggcacatgatggaggtaccgagtcaatggctgttcattgaccgactgaatgaccagcatgtccagctgccacactgggcacgctgccctgggctctctctcaaggcttctgtgtcctcaccctcagctctggtgagctctgttctgtctctctctccctcagcagttgtagctgctggcccatgtgcccaggctctcctaacacctgttttccctgactcagattccctaaagtatgggtcctctggctacatgacattcacctgccagggtgactgacatttaaaaagggggcctgaggaaagaacagtgctcactgaaggaaaggaaacactcacggtggcgtccaggcaagagtgactggccaaggagccttccaggaagcccgcagggagcagttccgtttcacaggcggggctgcgggccacgcccactccagcgactccccaaggcagggggagtacagagttccaggcgccaccccgctgggaataaaagcaggctttccaggcagcgggctcggaatagggtcccgagctaccacccacttcctagcttgccgcaggggcacagtgaggcagtgctgatgtcaggcctctataaaccttcaggaatgctgcttattggaggaggttaaatttggtagaaggggtactagccttggtggcaggcagggctctccacccttgatccaggcaaatcagctcacctcgctgggcctcggttttctcatgcatatcatgaccctagttacacctccatgttactgtgtgcattgcacgagaaagtgcccatccatctgcagaccctggagcttgctatagggtggtgattctcctggttctgtgaagggcttagcctgaaggataaaaaggtgtggtctggttgggctggatttgaactcaggccctcagtgagcttgtagggcacctagtaacattgcacagtgtcactggggtttaagaatgtaccacctattgagctctgcccacatgccaggccccacgtggtgcaccttatgaaaagacacctgtttatcatgcagcctgaggaggaaagcatggagactggggcctgggtgtgagtttggcactcccctcaacctgcactgctggtccagtgggtggcaggagctgcctgtcccaccttgcacaggggggctcaagggaagctgaaagtgaggagacttggcttgtatcctgactcccctcagtgaggtgctccatctctgtgagcctgctgctgcccctcaccccaccaagatgtctgacaggatggatttgagaaggaggtacaacacacaccccatgatgcacggttggcccccacagactctgatgcaggccacaccctggcgctccctgagctggcctggttcagtgctctttactctcttagaagaacattggccgggcacggtggctcacacctataatcccagcactttgggaggctgaggcaggcagatcacctgaggtcaggagtttgagaccagtctggccaacatggtgaaaccccgtctctactaaaaatacaaaaattaaaaaaaaaacaaacaaacagaacagctgccatttgctgagcacctgtgacacactggggacttaacatctggcctctccctctggggaacctgcacaaacaaagcaaccttcaagagcccttcacttgatgctttaagcacccatccataatggcccttaattgactcttaattatactaacaaacactatgtgtatttccatgtaaaaagatgttacagaccaggctaaagtccataggccaccaccacctcagtccagctccagctcgtcttgctccccagggcatatccactgctatcagtttggctgggccctttcacacctccttctgtgcattactttgtgtatatgtgcccaagaaaaacctctttctctcctctccagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtgtg

SEQ ID NO: 36235 - DNA, 11822 bp, Homo sapiens
ggcggcgggcggcgggcggcggggaccgggtgcggtggtggctgcggcggcggcggcgggagcagcatggattggggcactgagctgtgggtaagtccaatcggcccgcctctaagttcccctttgctggggtccaggcaccccccttttgtccccaatgtatcttagagggggctccgcgcctttcccttccaccgacccctgggtccccgccctccaccctccgctctctctcgaagtttatctgggagtctcagcacgctcaggggcgaagggcgactttgccggaccggagtggggaaactgaggcacagggttgcgaatgaggcgggcagaaggaatcctggggccaggccggggcggctgagagaggtcacctattttgggcgccctggccgggcaggcggcttatcttacggcccctgggtccctgcccgtcgtccgcctgtccggctaggaggggggaggggaccctctggtcaccctcatccccacccacgtgggacctagaagtcctgaccgccctttccctcgcctttaatcaacacctaggggctggggacgctcatggaggggaagggggatgctaagctcggcctgatccccctccctggcttccccctgctcaccccaggcccagggcgggaccgccccctggtcgcctataacctcagccctggaagccccagaaatttccccctatcctagccggacctctgacccctccccttgctgggggcggtggaatccctgagttcttagtgcagcgggggtaaccagactgccaccccctcctccaattctgcgatttcttttggatgtgtagtggggtcagtggggtaaattgagtcacccatcgggggatccctggaagcagggagattcagggaacctggtgcctgccccctggccactcaggggcccccagtctgccaggaaccctgcccctctggccttgactcacgccgggccggccggattttccggaatccggggggattaggggagcccgagctgggggagtggccctgtccccttccacgcccctcttggcggtcctatgtcggagacctccatctcccggccggggtggctggggcctgggcgctgttctccggcccttcccgggaaggggagggggttcccgccagtttcctgcctccccccgcgccacgccggggcggcgccgggaagccactccttctaggagcgcagagccttggccctccctgggagtctggtcggcgggctgtggggtcccaaaatcgtgaccccggcccctctcccctcctcccccaccatgtcccatgtcaggatcagttcgaggtgctcgagcgccacacgcagtgggggctggacctgttggacagatatgtaaagttcgtgaaagaacgcaccgaagtggaacaggcttacgccaaacaactgcggtgagaccctggggtggacgctacggaggacgcgcctggggcgacggggagcggtgggagggctgcgggctcagccctcctacctctgtctccccttaggagcctggtgaaaaaatatctgcccaagagacctgccaaggatgatcctgagtccaagtaaggttggagaggggctgcagggctagatttgtggggaaaggcggtgcttgggtctcacttcccctccctcagctgggacaccccaccgctcctctcacttccccttctagaggtgagagcatggatgcaagatgcgggattatctggcttggaatcctgagtccactactatgtagagaaattgacttgggcttgtgactcaggttttctgccactattttccttaactgttaaatacagaggccccagcagttacaaaaccagtaactttgggcagatgacttaaagttttgcgcctctgttttcctcatctgtgaaatggaatgatgacgattcctccagctttgtagggctttcatgaacacgagctgagtgaatgtgtttaaacagtgtgcagtccatatcaaacgccgtaaggagcatttgacttggaattgagtccccaattccaaaatccaaaaaagccctggaaatcaagttgttttggtcacttgtttggcagcaatctctgacctgaactttttgttaattgtagttgttttgttttgtttttgacagagtttcactctgtcccccaggctggagtgcagtggcgccatctcagctcactgcaacttccgcctcccaggttcaagcgattctcctgcctcagcctccctagtagctgggattacagtcacctgccaccatgcccagctaatttttatatttttagtagagacagggtttcaccatgttagccaggctggtaattgtagttttgacttttatcccacttagtgtgaatgttaacacctctcattgtaaaattaaaaaaaaaaatagggttgggcacagtggctcacacctgtaatcccacacattgggagggtgcgcaggtggatcacttgaggtcaggagttcgagagcagcctggtcaacatggtgaaaccttgtctcttctaaaaatacaaaaattagccaggcgttgtggtgcgcgcctgtaatcccagctactcaggaggctgaggcatgagaatcgcttgaacccgggaggcggaggttgcagtgagccaagatcgcaccactgcactccagcctgggcgacagagtgagactctgtctccaaaacaaatagatacggtgtttgattacaaaatgatgtccccaaccccactaagatgatgcagaaaagatggtataagctttgtacaccatctttaaaaactggaaaattctgtgttccaatatacattcgaggtccagtgcggtggctcacacctgtactcccagcactttgggagggtgaggcgggaagatgcggagttcggggggattggagtttgagacctcatctggaaaaaaaaaattagccaggtgtggtggcgtgtgcctgtggtcccagctatttgggagcctgaggtgggaggatcacttgagcccaggagtttgaggctgcagtgagacgcaatcatgccgctgcactgcagcctgggtgacagcaagaccctgtctcaaaaaaaaaaaaaaaaaaaatctactcaagggttggggttaaggaatatggaccagaatttgtcatcgcttcagggattacattcttggggcttaacccttttccacctggaggtgcgtcctggggcatcagcctgctcgggaggaggggcctgactccctgttccccgattctcatccaaccccagattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatggtgaggagccccccgattcaggttttacaaagggcttctgctggaaccctggcgagccttatcactcttctttctgtagcacttccaagaagggcggcgggcccagcagcagctggaaaatggctttaaacagctggagaatgtgagtttgcagaggtagcagtgactgtggcccggaggcatgggggcagggttgcggatccggagtcagggagctgccctctttgtcagacctggaccttccctcccccataggcttccagtactcccttgacccctacttactggatgacatcccaataatccctgaaaccttggtttcccaccctgctgtctttgggatggtggctccctcactccggttctgtcccctacacagagtaagcgtaaatttgagcgggactgccgggaggcagagaaggcagcccagactgctgaacggctagaccaggatatcaacgccaccaaggctgatgtggagaaggtgtgtgtggcgggggcggggggggggtgcggggtctgggacaagcttggggagtccgagtgggacgtgatcggaacctggcagtaccttccacctctgcattcttcaggccaagcagcaagcccaccttcggagtcacatggccgaagaaagcaaaaacgaatatgcggctcaactgcagcgcttcaaccgagaccaagcccacttctatttttcacagatgccccagatattcgatgtgagtgctcccagttctcagacctaccttcccgaaagcctccaaatgttagccaactcctacgcattcatcaaaaccccagctgcaatgtcccagtccctagattgaaagggaatcagaaacctatagtaacagtgagctgtgcttttagtcagctgttcttcctgctgggcatgccttttacttgtttgtttatttacttctatagagagatggggcctggctctgtcacccgggcaggagtgcagtggcataatcacagctcactgcagcctggaacccctgtgctcaagtgacctttctttctttttgaaattcctacttattcttctaagctccacctctaacaacccctctgaaaggtctcgaatttcccctctcctgtttcaatctagcgctccactctctgtcccatccgtggccctgggagtatcagggctggttctgctttttcttcaaatccctgttcccttgtctcctcctttgagaagcctttgctgaccccctaggcacgcgtccccctctgagatccccctggccctgtgtctcttccccaaccacagtgggctggagtctctcttcccgactctgtcttcccctccagactggcttggggctggggccagcgtggagcgcgatcatatttgcagagtgaatcactgtgcttctagtccctctgttagcacccctgagccacccttgtccctgtccttacagaagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgtgggtgcctggtctgggtccactgggctacgggaagggcagagggaggtacccataggctaggcactcgactgctcatccactgtccccctcccccaggactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaaggtgggggccgggacccttgggatggtgggggagaaggacagtgaagtggggacagtggggcccctattgagtcagccccagccgcctgaacgccgagtctcgggcaggaattttcctcttggctgccagcccggactggagggaaggaaggcggccgattggcctgggagtcccccgaggcgaaggcgggggcagggtggggaggtggggaggtccgtggcgtttgtctgctgcttctcgggatgctgggagaaaacctgctggtggaattcagggctggcctgagggctggtgacaccatccctggggactccccgagtttctctctccatcctgctgatgggactctgggagccgccctgcatgtcttgctttcttgggtttttggattttaatataccttagcacccttggtttatacctttgatttatactttgggtccctcttcacttacactctcatacctctccttgacttaacacctgtgatccccgagcttaaacttctgatgcccctaacccctctcattttcctgccttccactccctctcggcttgtggttttatttttgtttatttatttttgtcctctgtggcctcttacctgtctgagaccttgattcctgcatgcgtcttctagactgtcagcccagaaagctaagtggacagagagacatgggcctccctgcctcctggacccatgcttgctcccggacataacattccagagacctaggagataccgggggagtgagagttctggctttcgggcttacagttcaacatcctccccgccaccttccagatttttttgtgtcgctcctgcatgcgttttctctgtgtggttgtgcatcttgagttgtggttttcttaccgttttttttctttctccattttgtttttcctttttcctttttttgcgtccatccgtccatccgtgcgtccatccctccgtccattcgtcctcactctctacatcctcctatgcccccccaccccttcaacctatccccctccccggcccccgccggtagcctcgccccccacccctctcccccctggggggccccgtaccctcggcattgcctaacggacccccgtccccccgctccggccgtgaccccttggccatactgagcgagatcagtaagtcggtcaaaccgaggctagcatccttccgcagccttcgaggcagccgtggggtaagtgaggcctcggggcaggaggaggtggtggccctagcctgcccagcggcgggtggcgggaccctgggctcgcttcctgccgctggctgggcccctcttccctggttgcccaacccagacctgctttgctctgtgcatggcttcgctgtcaagaaccatggctggggaagggagtgaaatatctcagacgggtgcagagtctggcaggctagactccttgatcccaaattcagccctctacccaccttgcagacagtggtgaccgaggattttagccacttgcccccagagcagcagcgaaaacggcttcaacagcagttggaagaacgcagtcgtgaacttcagaaggaggttgaccagaggtaaggtggtggggtagggaaggacaggcaaggaacatgataaaatagtaaatgaacttcacttatttgtttattattttattttatttattttattatattttattttgtgacagggtcttagtctgtcgtccaggctggagtgcagtgctgtgatcttagctcactgcaatcgccacatcccaggttcaagcaattcttgtgcctcagcctgccgattagctaggaccacaggcatgcaccagctaatttttatatttttagtagaggcggggtttccccatattagccaggctgtcttgaactcctggcctcagttgatctgcctgcctcagcctcccatagtgctgggattataggcatgagccactgcccgggtctgtaaatgaatgacatttaaatggtactcaaagatctccccaataatcccaaggccccgacggttttacaggtgattcctaccacacttagttacttcttggccaggtgcagtggcctgtgcctgcaatcccagcattttgggaggttgaggcaggaggatcatctgagcctaggagtttgagacctgcctgggcaacagagtgagaccccatttctagcaaaaataaaaaaattagctgggtgtggtggtttgtgtctgtagtcccagccacttgggaggctgaggtgggaggatggcttaagcctgggaaatggagactacagtgagctgtgactgcaccacttgcacttcagcctgggtgtcagagtgagaccctgtctcaaaaagaaaaaaagaaacagttacttcttgtcttatacaagtcattccagcaaacagaaaaagtgtgaaagctgtcaacctctttaggctgaagaatcctgattcccaaatctgtggccaagaattcaataagataaaattaagggctcattttaccttatttatgatcatagaggcaaaatcctagccaagcaaatccagtgtttaaaaaataatacatcactttgggaggccaaggagggcagatcacgtgaggtcaggagttcgagaccagcctgaccaacatggtgaaaccccgtctctactaaaaatacaaaaactagctgggcattgtggcacgcgcctgtaattccagctactcgggaggctgaggtgggagaatcgcttgaacctgggaggcggaggttgcagtgagtcaagactgcaccactgcactccagcctgggtaacacagcgagtctctacctcaaataataataataataataataatacattagccgagcacagtggctcatgcctataagcccagcactttgggaggctgggtagaaggatcactcacttgagcctaggagttcaaggccagcctgggcaacgtagtaaaaccccatctcttagaagaagaagaagaaaaacccaagtaaatttttttaaaaactaaaaaaaaaaaaatccaccattggttgggttttatcccaataatgcaaagatagttcaatatcaaaaaatgtatccatctagttcaccacattaattggctaaaagaaaagcagcatatggttatctatttaatagctcaaacacttaaaatattgacaataaaaaaatctggcagattaaaaaaaaaatctttactcactctttccaggcaacaaaatcctcttcccagttctgttacataataggaatgatgtttgccacttgcaaacaggcagccaaattatattttgccatttgcatgtaacctcttggacagaatggcttttattggtgtaaagttccattcagaactctctagttcctgagtttctacggtggaggggttaagggtgcatgttctagagtcacgacaaactggacttgatttccagcttcatctcaggacttgggcagcctgttttaccttttaattcctcagtttcttcatctgtaaagtggatcaggtattagaactggaatgaagttggcagggtgcagtggtttatgcctgtaatccaagcactttgggaggccgaggcaggcagatggcttgagaccgagtttgagaccagcttggccaacatatggaaatcctgtctctactaaaaatataaaaattagccaggcgtggtggcgtgtgcctgtagtcccagctactccagaggctgaggcacgagaatcacttgatcccgggaggcacaggttgctgtgagccgagattgcgccactgcattccagcctgggcgacagagtgagactgtgtctcaaaaaaagataaaaaataactggaaggaagttgagctcagatctggtcttttccaaaggtccattatagtcgtgactacctgtatatatagacataggggagacagggatgagaaactgatgataatgataacagtatttattagtcacttactgcattctaggcactattcgaaacagtgtacatggatttattcgaattttcaaggtttcctgagagattgtatgcagacttaagatctgtcttgtttagtgttatatttatctttatttattttttcccctgcccccccttctttttttattttttaaaaattattttgattttttactagagacaaagtctcacaccattgcccaggctggtcttgaactcctggcctcaagtgatccttccacctcagcctcccaaaataatgctgggattacagatgtgagccaccacggccagcccagtgttatatttctgatgcttggaataggacctgtatgcagtaggtactcaatatgtatatgagtaatagtgaggacttactaggtatcaggcattgtattaatcctcacagtgacccacatgagatattaggatcattatctccatttccaaaataagcaaacagcagtgggggttcaatgatttaagccaagctcacacagctaggaaatattcaaactgagattcgaacccaggcagtcgggcactagtatttgcatccttaaccattgtcctgccttgctatttgctccttgatgcaaaacccctgttttttgcttgttaaatcacatggagcccggtgctgtggctcatgcctgtaatcccagcactttgggaggctgagccaggaggatcccttgaactcagcctgggcaacatagccagaccccatctctactaaaaatttttgaaaaatcaggcgagtgtggtgatgcgggtctatagtcccagttactcaggaggctgaggcaggagtatcacttgagcccgggaggttaaggttgcagtgagccatgattgcaccactgcacaccagcctggggaaagagtcagaatgagaccctgactcaaacaaaacaaaacaacagcaacaaaaaaactcacacggaagtatgttttcctgtctatcctgtctcccttgtcatagggaagccctaaagaaaatgaaggatgtctatgagaagacacctcagatgggggaccccgccagcttggagccccagatcgctgaaaccctgagcaacattgaacggctgaaattggaagtgcagaagtatgaggtcaggaaagaccctggggaggggcgggagccagcgggcctggctgagtcactgctgggtggggtggggggtcggggacaggggaggtgttcggagcggggggtctccagctgttttccatcacagccttggctgtgcgtgggtgatctcagggaacctctgggtccaaagtgggctgaccccggagctctgccctggaacgattttcctgtcccctcctcccaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagaggtgaggggtgacgtcagagtgggtctgttcccagggtcccaggagggcctgtctttatctgccgaattatccccaaacagctctgaagagcctccctcagaagagagccaggacacccccatttacacggagtttgatgaggatttcgaggaggaacccacatcccccataggtcactgtgtggccatctaccactttgaaggtgagaacggccagagtgggcttggcggggtatgggaggcagtgtctctggctaggttcagtttaaattcgcctaaagcagggctgggcgggtggctcaggcttgtaatcccagcactttgggaagctgaggcaggcagatcacttgaggtcaagaattccataccagcctggcgaacacggtgaaaccccatctctactgaaagtacaaaaattagccaggtgtggtggcgcacgcctgtgatcccagctactcgggaggctgaggcaggagaatcccttgaacctggaggcagaggttgcagggagccaagatccgtgccactgcactccagcctgggcgagagcgaggctctgtctcaaaaataaaaaataaaaataataaattttgcctaaagcagatctgggcccacccccacccccatcacagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatgggaaaaaaaaaaaagaaattatataaagttcctag

SEQ ID NO: 36236 - DNA, 16241 bp, Homo sapiens
ggtgctgactggcttgcgtctctgccactttctttcagcttagtggcgcgcggcgcggcgacgaccgccgggagcgtgtgcagcggcggcggcggaagtggccggcgagcccggtccccgccggcaccatggtgagggcagggcaactgcggggtctcaccgggaggcgggaacagcagtcgttgggatccctgcgggcgggcgctgtgggcttggttggcgcggggcgaacgtaaggtccgagcctcgagtcccgccccccggcacgaggctgggaaactgaggccggagactgcaggtggctctatcacgttcgtgtctgggatttagggttgcacggacttgtatccacagtacagtggcctcgccttagttagttttcccagtttgcaggtggggaaactgaagtaaaaaaaaaaaaggtggggatccgccaaatgcagcagagagtttttgggcagggaaggggtcccttacgcttcgggcccagtctgacctccctgattgaaaactagagtgctgggaagtagggggccagtctgagttgtgaaacttagttttaggaatttcagagcttgcaagatgctagcagcacagcctcctaggcctcttggtttctggctgaaaagcaggcctggtgctggggtgtggtgtttctccttgggtcacatagcatgtcattccagcggaagggggcgttttgagctaggggtggacaaagtacatcctcccaatacaaagaaggaaaaattgcggcccaggtctctgcagggcccattgtttatgattctggaagttctggatctgggctagaaagtgcccgtgtcccccactgtgcagatcggaaaaggaattcagagctgggagtttcctggcccatcagcttctggtccttcttttttcaatgagagaaaccaaggcccttgttggggatgtgacttccagactctgtgagacagtgggagattcagtaaccaggagggtcccccaggggtggctgcatcagaactgtggattagtgagaactctccctaaatccggctggtcagtgtgtaaccacccaatgggttcaccttgcctgtcttcctagacagatttatcaagacaggggaattgcagtggagaaagagtatttcacacagagccagctatgcaggagaccagagttttattattgctcaaatcagtctccgctgagcattaggggatccgagttttgaaagataatttggcgggtaggggctcaggaagtggggagtgctgattggttggagcttcctgaggtcgatggagtcatcgacgggagtgttgaagtgaggttttcttgctgtcttctgttcctgggtgggatcgcaggactggttgagccagattactggtctgggtagtgtcagctgatccgtcaagtacggggtctgcaaaatatctcaagcactgatcttagattttataatagtgatgttatcccaaggagcaatttggggagtttcagactcttgcagccagaggctgaagttacctaaatggtaatttctaatcttgtagcttatttgttagtcctacaaaggcagactggtccccaggcaagaagagggtcttttcgggaaagggctattaccaattttgttccagagtcaaactataaactaaatcccttcccaaggttagtttggcctatacctaggaataagcaaagatggcgtaaaggttagaagcacaatggagtcggttaggtctgatctcttttcactgtcataatttcccgctacaatttttgcaaaggcgatttcaagtgcaaggattcagagagcctgtccctctctgcggtgtacttagagggcagagttggcatgtaagactgggcagagctggaaggatccatccctgtgttaagttttgtgggagcaggatcttcgtttttcttccgactagattcccagtatgtagaacggtgcgtgggcaaagtgtgaactcattcattcagccccttcccaccttctgaacatccagagtcctggctgtccagctgtttcctggaggagtagccgagaatggacaagccatcacaggatacacacttccagttccctgtcgtcagggcagggccagaaggagtggcctaggttagcagcggggatgggcagtcctggacagcttcctgaattaggaggcactgggtttaggtcctcgtggatctagacctgagaaccagattccagatgctccaagaaagcccagagaaaggaattctcttttctgaattttcttgtgaccttccataaaccagggtggggcctctcctatcacacttggcactttttttctttttctatttcattttatttatttttttgagacagagtcttgttctgtcgcccaggctgaagtgcagtggtgtaatctcagctcactgcaacctccacctctccgagagtgattctcctacctcagcctcccaagtagctgtgattacaggcacgcaccaccacacctggataatttttgtattttcagtagagatcaggtttcactatgttggccaggctagtcttgaacccctgagctcaggtgatccacccacctcggcctctcaaagtgctgggattacaggcgtgagccactgcactctagactttttttgtttttcagagctgagatctcactctcatccaggctggagtgcagtggcacaatcactacagcctcaacctcactggcccgtgatcctcccacctgacctcagcctcccaagtagctgggaccacaggcatgcatcactaaacctggctaatttctagattttttgtagagacagaatcttttgtgttgcccaagctggtctcatactcctgggctcaagcgatcctcccacctcagtctcccaaagtgctgtgattgcaggcacaagccactgtgcccagcctcacctggcactttgatgtatcttcttttaagattttgaggatccaccccttcctctgacctctctccaacagagtttggagatgaggatgtaggagaaatcaagatatatggtcacaggcccaggccattgcagcctgggagggcctgggagtcaggcagctccctgtcccgcagccactccttcccttacctgtggggtggggcgagtgttctgccttccctgcatgcctccctgggtagtgtgtgcatttttcttgtgtatttattcagcaaatatttaccgagtccctctcatgtgcctggccttgtgcttggccctggacaaagtccacacccactttgagtgttccagtctagcgagggacacaggtaataaacaaggtaattaaagactggctgcatcctatgatggaaacaaacacccatgaggcagagggtggccattaaaagggcctggccaaaggaggtgacgtttcagcagcctggggaaggtcaccccaggcagaggcaatagcagaagcaaaggtcaggtggcaggaatgggtgtggcggccagtgtggcagagcctgtctgccttgactctatagcgggcctgaggagtgttgtgagagtgggtctgcaccaaccctatttgggttttttgttgttgttgttgttgtttttgagatgaagtgtcactgtcacccaggctggagtgcagtggcacaatctcagctcactgcagcctctgcctcctgggttcaagcgattcttctgcctcagcctcccaagtagctgggactacaggtgtgcgccaccatgcttggctaatttttgtatttttagtagagatggggtttcaccatattggccaggctggtctcgaactcctgacctcgtgatccgcccaccttggcctcccaaagtgctgggattacaggcatgagccacggcgcctagccagtctttcttttgttttgtttttttgttttttgtttttttttgaaacagtctcgctctgttgcccaggctggagtgcagtggcgcaatcttggctcactgcaacctctgcctcctggtttcaagcgattctcctgcctcagcctcctgagtagctgggattacagttgcctaccaccacgcccagctaatttttgtattttagtagaggtggggttttgccatgttggccaggctggtctggaactcctgacctcaggtgatctgcccgcctcagcctcccaaagtgccgagattacaggcgagagcctccgtggccatcccaccagctctctttgtttctcagatgttctttctgctgctttttggatgggactgcaagtgacaggcaaggaggccgtgggtcctcccaggctgtgctattggtcgctgagaccaggtggtggcccaagagggtctgtcactggcatggaaggtgtgtctacaagctacctgcctctgggcagctttgccagggccttgctggatgtccctgggcaggtcacttctgctgtgggcgctggcgcctcctctgcagaatgagaggtgggcctttaagggctagcctgacctctgcgccttccctggtgatccaggaggaggtccaaggtcccgttcctgttacggactagagaaagaaaacaggcttgctgaggaaaacccacggcttcttcacagtaaagggcgacctgggcatgagacccgtgtgccagtctgtggctcctgtgttttctctgtggctggtggcacccagtcagatgcacacccagccgcccgcagccctcctcccctgcctctcctagcagctgccccggggccacatggccctttcttcccccttatctggctcttccaggaagccggtgcaggaagtgggcttgggcctggcttcctgctggcaccaacctcccctgggcagctcttctcaggaaggggctgtgggatgtaggattccctccccaaccccttcctttcattggggagccacccggccagggttgagggccatttccggcctccacagggagaggccttcaagttcacaccacctggaaaagcagccacactgtggattagggtggtggccagggcaggactcccagcaaaggcatctggggtcagggccacctggaattccagtcaccaggacagggctaggtgaagcctgtgtcccatgaggcactgtcttgtcagggccccttggtgctggggccttcctcatggcagtactagaacgggcatgttataggaccccgcacccaggcacagctctgcgttacccgaggcagctcccagcgtacgggttgagttttctgtttccaaaatgaaagtgttgatttcccccccagtaatagaaatactacatatttgacataataaagaaattcagtaatgatggaaaaaaacatcttgaaaccaggcgtggtggtgcatacctataattccagctacttgggagcttgagatgggaggattccctgaggccaagagttcaaaaccagcttgggcaatatagtaaaagcctgtcaccatcaaaaaaaaaaatcttgaaagttcaccttacctggtgacttcctgtctttgaaaacccagttcagggccgggtgcggtggctcacgcctgtaatcccagcactttgagaggccaaggcaggcggatcacggggtcaggagatcgagaccatcctggctaacacggtgaaaccctgtctctactaaaaatacaaaaataaaaataaaaaaaaattagccgggcatggtggtgggcgcctgtagtcccagctactcgggaggctgaggcaggagaatggcatgaacccgggaggcggagcttgtagtaagccgagattgcaccactacactccagcctgggcgacagagcgagactccgtctcaaaaaaaaaaaaaaagaaaacccagttcaggcggggggtgatggctcaatgctgttaccccagccctttgggaggaccaggcaagcagatcatttgaggtcaggagttcaagaccagcctggccaacatggagaaaccccatctctactaaaagtacaaaaattagctgggcatggtggtgcacccctaataatcccagctatttgggaggctgaggcgggaggatcacttgaacccgggaggtggaagttgcagtgagccaagatcacaccactgcactccagcctgggtgacaggcttgcttcccaggctcaagcaatcctcctgcctcagcacccaagtagctgggactacagatgcgcaccaccgtgcccagcaaagttttgtatttttagagcaaggcttcatctaaaaaaataaaaataaaaccagctcagatgtggccttctctgatgggattgacccctgcattggggcctggcagtgtcagtcttgggccagttggggctgccctgcaaggcatggtcttgtgcttgcttcagacagacaggaccaggccagctctgtctcctcctagcgccatagtactgggcaagttcctcgggtttccaagctgtagtgtcctcaactccatactcagagtaacctcatcaacatggatgcatctcagagataccagtttgagcttaaaatacaagcattagggcaggcacggtggctcatgcctgtaatcccagcactttgggaagccgaggcgggtggatcacctgaggtctggagtttgcgactagcctggccaacatggtgaaaccccgcctttattaaaaatacaaaaatttgctgggtgtggtgacgcatgcctgttgtccccagctgcttgggaggctgaggcaagctgcttgtgaggcttgaacacgggaggtggaggttgcagtgagccatgatcatgccactgcactccagcctgggtgacagagcgagactccgtctcaaaaaaaaaaaaaaaaaaaaaattgaccagagtgttcagcaccaagagcaggtggtggccacctacgggagtagggagggtgtgtgaggcttttcttcctaatctgagaggcaggtgtgtgttccagggctgggcagagtgaggaaatggcatttccagtggggggtgattgacacgcactcctgtgccccctcaaccgcaccgcaccatctatgagtcatgggtgggactcaagaccagagctcccaggcgctggtcaaacagacaaatcatgtggctttatttgcctttcagcttcccttgtcactgctgaagacggctcagaatcaccccatggtgagtactcagtggtctgggaaagcctgtttgagagggggccagcctcagcacaggggcggtggctgagcagacggcttcctggcctgcctgtccaccagcatggcagtttgctctcttctccctccccaggagtgtccacactcctgtcatttctgctgcttgtaagagtaatacatacatacttactaaaaatttaatgggccagttgcagtggctcgcgcctgtaatcccagcactttgggaggccaagacaggaggatcgcttgagctcaggagttcgagatcagcctgggcaagaagaaaaacttaaaattagccagatgaggtggtgtgtgcctatagtcacagctactcaggagactgaggcaagaggatcgactgatcccaggagtttgaggctgcagtgagctatgatcataccactgcgctccagtctgagcgacagagtgaaaccttgtctctagaaaaagaaaattaatgaggtggaaggatcacttgagcccaggagttcaaatccaacctgggcaatatagcaagaccctgtcacttaaaaaaataaaaagaacttcaggttgggcatggtggctcaggcctataattccagcactttgggaggctgaggctagaggatggcttcagcccaggagttcagagaccagtctaggcaacatggagaaaccacgtctctccataaaatataaaaattagctgggtgtagtggcgtgcacctgtagttccagttagttgggagcctaaggcaggaggatcacctgagcctgaggcgtttgaggttgcaggtcgctgggtgacagtgaaaccctgtctccaaaaaatgataatattggccgggcgtggtggctctatgcctgtaatcccagcactttgggaggccgaggcgggcagatcaggagatcgagaccatcctggctaacacggtgaaaccccgtctctactaaaaatacaaaaaaattagccgggcgtgatggcgggcacctgcagtcccagctacttggaaggcagaggcaggagaatggcgtgaacccgggaggcggagcttgcagtgagctgagatcgcgccactgcactccagcctgggtgacagagcgagactccatctcaaaaaaaaaaggataatattacatactaacacttcagttaaagtgcacaatttagtggcatttggtgcagtcacaggttgtgtaaccaccacctttatctaggccggaacatttccgtctccacaaaaggaaagcccatttccatcagcagtcacttcccagccccagtccctgatgagcatgaggcagctgccgtctctgtggggttgcctattccggatatttcccatgcatgcgaacggagaccatgaggcctttcgagcctggtggttgtcactcagcaacgtgtttttgaggttcatccaccctgtggcctgtgtcagtgcctcattccttatagccagacgatactccgtggagcggatacttaccacttttttttttttgagagggagtctagctctgtcgcccagcctggagtgatctgggctcactgcaagctccgcctcctggtttcacgccattttcctgcctcagcctcctgaggagctgggactacaggtacacgccaccacgcctggctaattttttttgtattttttttttagtagagacggggtttcactgtgttagccaggatggtctcgatctcatgacctcgtgatccgcccgcctcggcctcccaaagtgctgggattacaggctcacgcccggcctacattttgtttatgtgtttgtctgctgataggcatctgggctctttcccctttttggctattgcgaacagtgtcactgtgaacattcacgcacacatttttgtatggttgcctgtgttcatttctcttgggcagatgcctaagttgagtcatttaaaaatctcagccctggtgggaggccaaggcgggtggatcacctgaggtcaggagttcaagaccagcctggccaacatggtgaaatccccgtctctactaaaaaattagctgggcgtgatggcaggcgcctgtaatcccagctacttgggaggttgaggcaggagaatcacttgaacccgggaggcagaagttgcagtgagctgagatcacaccattgcactccagtctgagcaacaacagagaaacttccatctcaaaagaaaatctcaggcttggactgagtgtggtggctaatgcctataatcccagcaccccgggaggccaagacaggaggatcacttgagcccaggagtttgggaccagtctgggcaacagtgagaccccacttctacaaaaggaaaagaaattaaccacatgtggtagtgtgcgcttatagtctcagctactagggaaactgaggtgggaggatggcttgagcccaggaggttgaggctgtagtgagccatgatcacgatactgcactccagcctgggcaacagagcaagaccctgtctcataaaagacaccaaaaaatatcagtcttttcctaacagcagcatatcctcagaatgatctgctacttatctttgttctcaaaacataccaaaatagatgagtaattattgcagtaaaaaacagcatttgtggaacactgaagcccaaatatctggtgttgtgggggtgcctgccaggaccagcccagctgtgcccacctggcccccagccaccctggatcagtggccaccatcaccattgtctcacttattcctttaaacatttctgtgtttcttagttttttgtttttttaagaccaagtggcactctgttgctcaggctggagtgcagtggtgcgatctcagctcactgcaacctccccctatctcaactcactgcaacctccgcctcctgggttcaaacagttctcctgcctcaggctcccgagtagctgggactacaggcatgcaccaccatgcccagctaatttttatgattttagtagagatggggtttcaccatgttggtcaggatggtctcaatcttttgacctcgtgatctgcctgcctcggcctcccaaagtgctgggattacaggcgtgagccaccgcgcccggcccagtatcattttttaattgcacaaaggttggcgtcatgatagactgtctaactgccagcgaagtgtctagcggaggcagagcctgtcgcctgtaaggaaggccatttaggggtctgggaactgtgggctgaggcccggaggtggtggtccatctcagggcagagctacacctcctgaggggcccatggcgcagggctccagggctacagccaacctctagcctgtctctcttctagttggtggagctgaaaaatggggagacgtacaatggacacctggtgagctgcgacaactggatgaacattaacctgcgagaagtcatctgcacgtccagggtgggtgctgcacccaccaacgggggtgggatgcagggggtgcacactcagcctcctccctccctccctgggcctcatgggaggagtcagtgggggaggccgcctaggactgctcgtccttccaggggtcagtcaggagggacagggcagggtgagctaggccaccaagtctcccagtgtgccctggactttgaccctgtgggagactttcctgctgtgtgtctgttggtgccacccctgacctggaaggacctaggactggggactccctgtggctcaggctggggcagccccctccaggggaggcccaagactcccggactctgctgcctttagtccagcctggatgttgcctgcactctgcgggccatggtagtgtggccctgggatgtccgggatgcccaggtcacggtgggcaggagcagcgccagggcccggtgggtcaggagccaccagccagagcccaagaccggaagtgcctggctaggagtgctgctgggtcggccggggctggaagatggttcccctggtgtcacgggccttccctgcccctgggatgacccacagagcactgaggaggaggccagggatggtgctgaaggcagcggctcccttggactcctcccaccaaccttccctgaccccatctgtcttgtctccctgtgggtgacagccccccatggtatagggaggaaactgctggggagcttggagtgcctgcctggggtcaccttgacaggacaacagggctcgaggggggaggcgcttcttcctgaagtggccgtatcttgccctgaccgccacccccacccgggactgggcctctcatcagcacagggctgggcggggtggggacaggtggtgaggctgctgtgcagcagcgctagaagctctagaaactgcttgctgggtttcgtgccatagcctgtcggagggcgtctgggtgggtccagtctggctgtgtcggatggtgccttggtgcagaaccgcgtgcctcccatctgcggccagcggggctctgtccacttccggtattggaatcaccaggcgtgttgcgtgcgtgagcatgtgcggtcttgtggacacctccaggtcctagacatgagaagcctgttgattcagaggctgcgtggtctccaggggttggtttggcctctgcctccagcttcgagtggacggatggctttccctgagcagcctgcctctgtggccaggcggtgatgctgccgtcacatgtggctgggaggagaggcgatgggaactcacatcgtccccatctaagtggggccctccctccctcagaggcaggccgcaggatgcagagaccccgggctgagagacctctggagcgctgtgggcaggaggcaggggcctccctgcagtgagctcaggccctgcccaggttcctgcacgaggaagcctctgggccctgcctgggagagctgggcgccaagtcacctgcccaggccctgagtccccacagaaccatggtgtgtccgccccacgagccctcgaggggttcctgggagagtgagcacccaaaggggctgttcctccccgcccagcgctaggccaggccacacctacccaggtgtggaggagagtgtctgacaggaggacttggggattcgggcaggtaaggccttttggggtcaaagttagccagatgagaagtgggaaaaccacgtgcaaagttctgggggcaagcccatggcgtgtgttccggaaacagaaagttccatctggagggagtgtcgtcgggctgggagaggaccgccagggcggggcaggatctcgggccctagagagccctgctgaggttcttagaccttgcccccaggctggagggggccctgggtgggttccaagctggaacatactgtgatctgactttaaagggcatcgggggcaaaggccatccaggcgtcgtgcgtgggtctgtccaggaacctgggcggtggggcggggctgggaaactgatatggtaggaatggccctggcccctgctaatccctcgatctgtcccagtgggggcctcggaggcattgcagcatgagtctgtgtctttgcaaggcccccatttctccagtcttggttagctctcctaaaactggcatcgctgggagccgcccttgagccaccctggcaggacccaagtccccccatttcccgcccctcttcacccaccacactaggcctgtagcttgctcgcatgtccctgcacccagcgcaggccctgtcaggagatacttagatgaatgaatgagtcagggcatgtagagaggcttccagaagtgaggtggggctggggcaggaggaggagtagctgggcttcggctgtgtctggtgcacagggaggcccccacccgctctgggctttgggctgcaggtgaagaaccccaaccagagagagccccatcccaggctggagggagccccagtcagccactcctgagccaggcccacgggcagaggataggagccagtcttccttgtgagtgcacaatgggggctgcgcctaccacacccacccttgctcctgggtgaaggattgcctggggtcaggacagatcctgcctgcagggtggaccctttgccacgtatgtcccgggactgatactgtgcagcttgcaggggtggtacggggtgcaggctgggcaggatctgcagggcctcccgcgctcccagggctgggccagacggcccggtggtaagttaataacctgctccccttctccgcaggacggggacaagttctggcggatgcccgagtgctacatccgcggcagcaccatcaagtacctgcgcatccccgacgagatcatcgacatggtcaaggaggaggtggtggccaagggccgcggccgcggaggcctgcagcagcagaagcagcagaaaggccgcggcatgggcggcgctggccgaggtgggtctcccctctccagtggacgtacctggggcgggaagacagccacacgtggcatccctccttcttggggttgcccttgcagcgctgcctcggagcctcccaaccctcccgggcccccctcctggtccttggccatgagccgaggcccaggcagaggagccccgagacctgggactcagccctcctctcactgcgcctcctggcggtcctcagggcacatcaagtcacctccccaagcctcagtttcccctctgagagggtatggtggtgcccatctgtccaggccgctggcaactccacttggaacctggcgtggctctatccagagccaaggtcgcccgcccccaccggagatgatgaattggcataaaattccatttgttaggcccaggggccatctgtagcccctgcccttcctcacctctctgtccccagctctgtgttctcggggggacctgggctttgcttctgccatccatgggcactgcctgtgtgctgggctcaggtgccagcctgggggcttgcagcacggcatggctgcccccggaaggccccaggcgccaattctgtgcaggctcacgaggtggtcaggagtgagcccgagggaggggcagggatagtactccaggcagggagctttggggatctcagggtgggtggggcctctggggtccccggcctggctccttcccagtagttggggtcaaggttgttgagagagtgggtcgggtcctacctagggaagtggggggttttctctggctgctctgcaggaagccactgggccatggagtgcagatagcagcctcgcagtaacccccaccaggctgtgcaccctagcacagctggtcctgcctggtgagaggggaggttggtggcccaggccagcgttggcctctggcctctgtccccacagggcctggtggcccctggctggtgagagccctgacctcttagatcctctgaatctggacccctgaccccaccttcacggggttgaggtctgcagagtagaccgtgattccagttcctgttggggtcagtcctcctgtccccagacctccctggcccacgactgagcctcccagcgggctctgtggagggcctgagctatgctgcctgcagcgctggcctctggcccctggcacccagcacatgggccacagggccagctcctcttgctggccttggctctcctgctgtttgaagctccagctttgatttcctcaagcgttcgtccagctagaaagttctctgaaacggctccctaaacggggcttacagagctggggtccccaagggagacagagagggagggatcaatgttgggtcccggcctgaccaacctgctgcgtccaggcctggcctgtggtgagggtggcgtgaaggggcgccaggcacacagagggtgtggggacaggcgtgccctgcgtgcagcctgctcaggattactggaggtgccgctgtagcgtccactcagtccctggggccctcatctcccgggaaccccctgtcacctccccagtggccacatgctcccacctcaggggcttcatggaaaatgtcatttgtcctcatggtctatctctggcctcaggcctgctggggagtcccctccccttccccatccctggggctggatacacagaaatccctctttctgttttcctcctggcaggtagatgaggggctgtgggtggttgtggcgcataggaggccccccccccgccagggagcccccagcctggcctactgccctggtctctgctccacgcctctcctacctcctcctcctcctccaggaaacccttctggctttgtcctttaggaagcctgccccaacccccaatgtgacttagtgtcctctgtcgcctagtcccccccccccgcatccctgggggctgggtctagtcccataatgaggatgccctggagttcctgccttcctcagatgctctgccccacggaggagatccaagcaccctcagtcaccacctcacacatgaggaagctgaggctggagacttaggtgacctggcctagagtttcagggcgccgggatcctgtcgaaggtcccacccacctggctctgctgcagcgccctctctctgtcctctaggtgtgtttggtggccggggccgaggtgggatcccgggcacaggcagaggccagccagagaagaagcctggcagacaggcgggcaaacagtgagcgcccacccagaccggctgctgcgccccctcctgccagggtggcgattccgctccacagtctcggacggatctgctcagaaaggaagaggcaggcgccagggggaacccccttcgtgttttgtgaccctcccttttaggtgaagcccctttttcttgctaaaaccggcaattctccggttagaaatgttacttggtgttttttggttttgtgaaacggccgtcccaaaactggctggattcctagaagagtctgtgttgaaggcatctttcaagccctcgctctggttctcagggcagcattttccaggcgggtttgttttgcatttcttggagcctctccgagcagcaaccagacgggagatttttattttaagctgttcatgctgggactgacagcctgcagggtttccttgggcgcggccccaaaattgccttcaaaacaaacccgggacggttgaaagccttcgaaccgtgcaggggatgcctcgggccctggcccttcgcttcctctcttgtgttatggaaataaaaacaaataaaactacacactgcac

SEQ ID NO: 36237 - DNA, 16241 bp, Homo sapiens; identical to SEQ ID NO: 36236

SEQ ID NO: 36238 - DNA, 239022 bp, Homo sapiens
ggccaaggcggcgaccggagcgcgatggcgggggcggcgggactcacggcagaagtgagctggaaggtcttggagcgaagagctcggaccaagcgctcaggtttggctggctggggcgccgccccccacccgagtaccttgggtggtgcttcgcctcaagcgccttggcgggaggcaggtgggggccctgggaatgaacctgtgccccgagttcctccttagaaagcaggtggcggccctggccttgtttctaatatcttcctccacctctaaaaattaggtggcagagccagctccactctgcgtgtgcccccgactctattccgcttgtgagccccactcggaaagtaggcagcggtccggacttcccttagagtcttctaacttaaaaatcgggcggcggcacattcctgggaaagggaatgtgtcttccctgtgaatgtgtctttcctgtgaatgttctctgcaaaagtcagatagcttaatcagaccaagtcagatgtaactacgatctggctgcagaaagccggcgtctgggctccttgctttatgtcttatatcccttttacattccccacaggttctaagcagtagacctgtcatctatctagcagaaactgaaggagactgggcctcagatattgaagagtatagttagggcccagaaagaaaagggcttcttaagtggccccaggttgtgtggtttccaaacccgaaagcatagaggtcagaaggtgccttgcaggcagttttaacagttccaagtgtcccgaactgacttgttcaaattgcaacgtcatgacttgtggcgttattaaaacttcctgtattcctggttggctggatataatcttgaacaaaaggcatgcacttaaacaggaaaggtgaaaggcggaatgcaggttttcagctaaggagcttcccttttaaagaattgatgaagtgtcattattgggggtgggtgtgaaaggtgttagctaggaaaattaactttgcacttgcattgatattaagaaattattttcggacgggcgcggtggctcacgcctgtaatcccagcactttgggaggccgaggcgggcggatcacctgaggtcaggagttcgagaccagcctggccaacctggtaaaaccccatctctactaaaaatacaaaaattacctgggcgtggtggcgggcgcctgtaaccccagctactcgggagtctgaggcagaagaattgcttgaacctgggaggcggaggctgcagtgagtggaggtcgcaccactgcactccagcgtgggcgacagagtgagactccgtctcaaaaaaaaaaaaaattattttctcacctaatatgttctccttacgttttgggcttttcctatttatgaagttcttagttgtctgttgtgcacactgacttttttttttttttttttggagaaagtaaatctaatttctgaaaatctaatttcagaaatcatacaccgaacactctgtttttttataccttacaaaaagttcagctttatatacttagggttatagtaaaattaccatctatgaagtatgagataattttttcaaaaagtagtccttagtactactaagaatcaataaagtgacttggaatagtcacatgtatttgtttcacactttttcttaaattgtttttgtgtgatatagaaatactgagttggctactaacgatgtggctatctggatataaaaagtgttattggattggttatgtctgaacaaagagaataactggagttttcttacagggacctgagtactgcccccaacatatatttttgcaacatttctctttaactttcataagctcatagagttgattttcttcgtcagtctttgtttcctctgaaatgcatgtcataacagtaagctttgaaaaccttaattctcttttcttagctgagaaaaaaaattctagtgttaactgttgttgagtgcagttatttaaatccacttttatgtgcaaagtgcatagtatcaatgttgaatgttcctgtatgtttacatcatagtagtaaagagataccacttgaagttattcctccaaattaatagttaaatttgaggtttcagattcttgtaagtatatgaagtacagaggataaagttaataactcgagttaataacttcctgtatcattaaaagcaatcaacttgattctgtttgttacttttagaagaatatataaatggagctttgttaaacacttgactaacctgactccagtatagagtcctccccacagagttctgagcattgttacatagtagcataattacttcactgcacaacagaggatactacttttatgtaatgtctaataagtggatattatatagtttctatctcatccatatgagcaagtgtaatttatcaaagcaaagaaaatcacattttcaagtcataaaagagaaaataaaattataatgatcctcagttactgcctttgttgcatactgcatcatgttaataactgctcacactgctttcaattaatttaacactgattgcttctaacctttactaaacagttttaaaattgctatagcttagcctgcgacgcttatgattagagccaacaatttgaaatggcctgctcacctgatgcagtcgtctctccgtcttccgctttcttaaggtctggtaagtgttgtagaccccaaaagggtcacttggtaattttaaatacctttgtttctgaaggttgatttcactataagatatcattatgtctttatttcttctttggtgggcccaggcctgagtacccggctggtgttttgtttaactttgcattgtgttttgaatgtggcctattgtgttcttctcatgtgggatgtgaaaagaacagagagtggagtgcctgccccgatatttgcaagcagaggcagttccttagtgtctgggagctcccattgtcaaatgtgcacatagcatatttcttaaatgatttttgtcttcttgccacaatggaagtaacttctacaaattaggaaattttggtcaacatcccacttatctgttcttcatcagcttactgtgaagcaggttattaatatacacgttttcacagacaggaagcgacttgccccagggaatattttgaggccatgtgctttggcctttatcctgtggcatcctggtgtaagggctggaacagatgttggcacaatggctcttagaccgttgtgttgatgcacccctttgagagctggatgaaagctatggaattgctcttcagacgtgtgcacaggattttggaaacaatttctgggtgattcatggacccagacatgattacctatgcattcccattagcaaccaggcctttggatgtattcagtgtcactttacagaacaagccacacatttagttaggtggccacatagctgaaatgaaaactgaagcatttacagcccttttctgtagttgtggcctaacttgggccatttaaaacctattatgtactagaaaactcggagaagcctgctggtaagagattaccttttctataatgcctcttaagcagaatatttcaagcctcaggactcatgaacaggcaaatgtgagatgagcacccccaaacacagtgaaaactccttggcttcaccatagcctttcagaagtgtttctccctcttcattcattttcgtttatatttcaagtcctgttctggcaagatagaggaggaaaatcttaaagaaaataaataagaaataacttaaggaagaatcaaacaggagaaaacaaaaactctttaaggaactaaaatgatttctatttctaggtgtcatctgctaaatgacaaaatattacatgtaacaatgccaattgatttctgattttatctttgaactaaaagaacaggaggacatatatctctagactctgttttctttccttataagcaccaagctctgttttccatcttggcttttctactaagaaggaaagtggttttaagcactagcacagtcattcagtagtaatggggaaatagaatgtttaaagatagcttttatgcatcaacagtcctgaaaatttctaaacccaagaactgtgctttaacattacatagagtgtttgaaggtatatacaagacgcttttcctgtactgtatcatcaaattgaaatagaatgcaccaagaaacagactagaaaaatatcaaactttagtgttataatccgttttgaagaatgattctttatacattactttcaatgttgacacttttttgggagttcatctaaccaaaacttagtaaaactataaagacacacttaaaatttgtatctgttaaaataataagtaccatacctgctggtgttaggcttaactttgcattgtgttttgaatgtggcctgtcgtgtttgcatttaagtactctgagtggtttgcatttataatttcttacttatttagaaatactccatttatattggaaatgatttgctttcccctattgtagttctttggacattatctttataggcatatgttttattgtgcgatttcatttgacaattattttaaagcacatccttgcttcacagctgagcttttcattggtactttggccagaaactatccagtattgccaaaagtgaaagccagtagtatcttgattttgaaaaatttattttcaatgtacctgcattgttttatgtattttaacccttcatattccttctggatatgtttctgctttttgttttttctttgtttctcctctttatggaatttagtgtgaatcctgtatttctgtgtgtgcatacttgagttgtgctgttactactaatgtactagtatttgctgtggttgaaagaaatttgttttgactgcttaaactaaaagagggatctagatattcaggtttttctttaaagacccttggagtcaaatgtacaaaaccaagaatttataaagaaattcaacagccaaaataaataattattagagaaggaatgtagcattcaataccttagattgcttccgtttctcatgtggccactacagttatattaagttagcatagttggtcagctgtagcaatcaccttggcaatacagttcagttacttggaataatggttatagcatattgtgatgaggtaggaaacggcttggcatttttgcttttattcttaaatgacaaagataatttaagaggttattcctttttataatggctcatgagcttatctaccttggctccctaagtttatcagccagctggtaagtgagcttcaacataggacttgagtcttttcatttacttgtttctctttatgttctttgattaactttcttttgttaatttaatttgatgggcaaatcagtacctgttaaaattttattgtatattctgggcaaaacaaaactttcaattgtatatgcctgatattgttttttttaaggaatttatatagcagtcttgttttcagttaactaatctaaccgtcaactaatcaaaaagattcttgtgattggaagagaacacaggcccgagtctcctgaactcttgtgggttgtggcctcctttaagagcctaatgaaagggtgtacatttggtgttcacgtacacctgggtctgattcaggctctgttgtttactacctatttgatcctgaggaagctatatctttttgagattcagcttcttgctttgtaaaaatgatgttaataaaacctaccaggagagattattgtgaagatcaaacaagatgttatatgcaaaacacctgatatttagtaactgcgcaataaattttagttatctttcctaaaaatatgtgtcttttacaatattgctgatgtgtattaaagactaatgacttatatacaacaaatatgatttcttatctctctcattttggtatctaccctcaaaatagccattttaagtaaatctgtcatgcttaaatacaactagcttgaatcagattactcagaatttaatattaatagagctgtactatttaatatggtccactccattttgtaaatttagcttttattttactctacgtccatcttatttttgtcagtaatcactgtaactctaaagaaattgtttctgatagtttccatggaaactcctattagattgcaggtagagcagttgttattttacgtatacttaaaagatatttttgtctcagatatgcactgtgctcgcttcatgtagcatggaattctcagaagcactccttaattgtatcctacttggacctctgacctcttactaggacctgccctgtaatcttataagatttaggaaatagaggccatatcatatgacttaacccccttggcatgaagcttattgaccctcaggctgtgtcattatgctcagcaaaaatgatgcttcacatttcataagtgaagtggtttcatgaagagcacaacagcttgtctcactgctttagattatcaccagtactcacattgtgcattctaaaagcgattttccttgtgctgttttatcttcagtcttttgtgaaatgagagagtaagaggaactccctagaatttctgattctgatccaggtatctatgcacatttccaaatgggtatatggtgggcatttcaaatgtaaccggaacaaaacagaactcttattttctactcttattcttatcccaatcatgttcttccttaaatatacttcatttcattaaactaaaccattattcttccagctactcaagctaaaaaggttattcctctctttccttcaacctttttattcagttaatctgtaaatctttctactccacctctaaaacacataccaaatttgtttttcttcagctgtactcctacctccctagtccaagccacttttatctctggtccacactacagaaatagcctgaattcctgtttcctcattcttatctcactacagtctgttctctgtcaagcagtgagatgggtctttaagaaatgcaagtcagctcatgtcactttcctgcttaaggccctcctattgtatctgtcattacttagcataaaatctacaatcccaggctcacgcctataatcccagcactgtgggaggccaaggtgggtgggttacctgaggtcagaagttcgagatcagcctggccaacatggtgaaaccctgtctctactaataatacaaaaaattagccaggtatggtggcatgcgcctgtaatctcagctactcgggaagctgagacagaagaatcgcttgaacccaggaggtggaggttgcagtgagctgagatcgtgccattgcactccagcctgggcaacaagatcgaaactgtgtctcacaaaataaaataaataaataaataaaaataaattctacattcccttcctttgaatgacaaagtcccaggtgacatggcttttgcctgcccctctgacctcctcacagaattctcctcttcttctccactgctatctttgggtccataagatgcaatctaatttgcactttaggctctgtagtatagctttttaggctctctctaatagctattttatctgcctggaaagctctctatactgctgtttgggtagcttgttccttctggttgagttttaggttcttatcttaaatgtagcctctttagaaaggctttttctgcccacccaatctaagtagcccccagacacatcactcttaattttaattctctgtagtgtccttattattaggtaatttttcccccttcttagttttcctgttcatcttcatccactagaatataagctatataaaagcagagacttacttgttttgtgcatagctgtatccctaaagtccagaagagtgcctggaacataaaaaatgttcagtaaatcatataatatctatcacactggagactgtcctgcttcttttgagagacagtgtcataatatggttattatatagatgttagactcgtacaactaggttcaaatactagtattgaatcttacaaactgtgaactcaatagcaaagacatggaatcaacctaggtgcccaaaaacagtgggttggataaagaaaatgtggtacatatacaccagggaataattcacagctgtggaaagaatgaaatcatgtcctttgcagcaacatgaatacagctggaggccattatcctaagtgaattaacacaagaacagaaaaccaaatactactgcatgttctcctaagtgggagctaaacattgggtactcatggacataaacatggcaacagtagaaactggggattgctagaggggagagtgagggagaggggcagggcaggggttgaaaaactaactgttgggttctttattcactgcctgaatgatgggatcattcacaccccaaacctcagcatcacgtaatatacccaggtaacaaacttgcacgtgtacccctaaacctaaaacaaaatttgaaattattagaaataaataaacaaaatgtttttccccctaaaaccaaacaaattgtgtctaatgttttgcacttaattttccatactatggagtggagataatagtatatccctcataagttcttttgtgaagatgaagtaatgtctggaagtacctagtggtggtagtagtagtactaatgataataatgatttttcatgctatgatgacagcagtgacaactttttaagcagctaatctttattgagtacttaatgtgttacaagtagtgctttacatttaaatctcacagaaatcctcttgcctagaccagtttggttggggagaccctaacccagcggcgctagaggaattaaagacacacacacagaaatacagaggtgtgaagtgggaaatcaggggtctcacagccttcagagctgagagcctctaacagagatttacccacgtatttattcacagcaagccagtcattagcattgtttctgtagatattaaattaactataagtatcctttatgggaaacaagggatgggccgaattaaaggaatgggttgggcaagttaactgcagcaggagcatgtctttaaggcacagatccctcatgctattgttgtatggcttaagaatgcctttaagcggttttaggccctgggcgggccaggtgttccttgccctcattccttaaacccacaactttccagagtgggcgttatggccatcatgaacgtatcgcagtgctgcagagattttgtttatggccagttttggggctggtttatggccagattttgggggcctgttcccaacatcctcttttgtaggtgttattactattcccttttgaaaaactcacagcacagggaagtaaagtaacttacttaaagtcacccaaactctggcagaccctattacccagccactgctgccttccttctcttcatctatagtgcctagtactccataaataaacaacagtggttactactgatgtcttcttgatgtttattgttcttctttcattcatttctaattaactgatgtttattggacctctctgatgtaggaagtttgtaataaataatagtggttgagagagctaatagcctgatggaatttatgcagaactcaaggcgaccagtgcttttgtatacattcactctgtctctctcctggattcctccagttgtttcctactgaactttgctactagagccataacctctccttgtacaatcaccctagtcaatgcacactattgttgcctgggtgatttttctaaaatgaactaacccttaagtggttacttaacaccactcatcagctctctgtctcctgcagggttgaagtagggacttcaaggaaagcctctctggaagtgatatttaactcctagaaataggaatcagtggagaagttggggtaaggaggactctaggctgaggatcctggggctagatagagctgggtatttaaagcgtactgaaaaggccattatgggtaaagcattgtgaatgacaggaatgggtgagaggaaggcctgggatgggcagggtcttgggagccttgaagatgtttgaattttattataaatggaagggaaggtgaaaatttgaagcagtggagttgtaaggctggattagtattttatgatgattctctgtctgttatgtaaaaatagactggaaggtgacaaaaaggcggggagcaacctcatggccgaagctgtgtgtcatatagctctatgtttaacacctggcaccatgctgggtgcatagggccactcaatctatgtttgatagtgaatggctgtgaaggcacagatattgagtatatcatcattctggattcagaagatgtggccaccttgattatgcattagaatctacatatctctgactcagtaaactcacttttggaagaatattcctgtggcccatttcctgttaaacggagaataaactaactttagaaagtgagtttattgaatcagaggtataaatggtaggtaggttctaatgcataattaattaaggtgcatatatacaaatataaaatgtatatgtgtcacgaggtcaggagatcgagaccaccctggctaacgtggtgaaaccccctctctactaaaaatacaaagaaattagccgggtatggtggcgggcgcctgtagtcccagctactcgcaaggctgaggcaggagaatggcgtgaacccgggaggcgggtcttgcattgagctgagattgcaccactgcactccagcctgggtgacagagagagactccgtctcaaaaaataaaaagtatatgtgcgaaatacatgtgtgtgtatatatagtaaaatcttagatacagttagttttatatcatgatgctattctgttttcacattttaaaatggcatattgacccttctattctgaggaatagtctgcaaagctacacaaggtccttgattctttgcttgattcaggcagaaggatgcatttagacatttaatttacctctgaacagataatggacttttagaaaatatatgcaattaagacatatcttttatggttttgggacacatctattttcaaatccctgattagaaaacaactgcccattgcggtggctcatgcctgtaatcctagcacttcaaaaggccaaggcaggcgggctgcttgagcccaatttgagactagcctgtgcaacatgacgaaaccatctctacaaaaaatacaaaaattaggctgggtgcggtggctcacgcctgtaatcgcagcactttgggaggccgagacgggcggatcacgagatcaggagatcgagaccattctggctaacacagtgaaacctcgtctctactaaaaatacaaaaaagttagcgaggcgtggtggtgggcacctgtaatcccaactactcgggaggccgggcaggagaatggcgtgaacccaggaggcggagcttgcagtgagccgagatcgtgccactgcactccagcctgggcgacagggcgagactccatctcaaaaaaaaaacaaaaattagccaggtgttgtggtgcctgggatggctggttggaggttgtggcaggagggacagcttgagcccgaaaggttgaggctacagtgaggtcgcaccactgcactccagcctgggtgacagagtgagaccctgtctcaaaaataaataaaaagaaaacaagtaatagaaaattgtaactgcatatattacatatttagtcttgaagatgctttctgatggttcattgtagcttctaggatctgtgtttttttttttgtttgtttgtttgtttgtttttgtttttgagacagggtcttgctctctcacccaggctggagtggagtacagtggcactgtcacagttcactgcagcctcggtctcctgtgctcaagcattcccttctgctgggcctataggtgtgcactaccatgcctggctaattttttttttttttttttttttttttttttttttattgtagagacaagtcctcactattttgcccaggctggtctggaactcccagtctcaagcactcctcccaactctgcctcccaaagtgctgagattataggcgtgagccactgcacctggcctctgtgatgtattttgaatacattcatacttgttctcattttctttttcacattaggccttcgttgccttgattagaaatggtttttaaaagatgaaacaattgttgctgttttttattttattatttgttacctttttcttatagactttattagtttattttaccaacaatcacatgattattagtccattaaaaaagaattattctttatgtttaacttactggttttatagctttcttctctttcagttcatatttcacaaattttcttgaggatgttggtttgtgtagatgaacagttgtggtacctaaacattaagtgatttccaacagccttaatgagaatttttttaaagttatttttaattgacaaatagtaattgtatatatttacagggtacaatataatgttttggtatatgcttacagtgttggataattaaatcaggctaattaacaaatctggcccctcacatacttactattttttcgtaatgaaaacatttaaagtctactcttctagcaattttgaaatatataacgttttatgattatagccaccattctgtacagtaggtcactgaagcttttgcctcctatctaactgaaactttgtaccctttggtcaacattcgagaatcttgtgtaataattgaaatttgtcatttttataggttctgatatatgtcatatatgctcttttttcaaaatatatatcattgatttttcatttgtcatataaaatcttttaaagttctgatatatgtcatatatgctcttttttcaaaatatatatcattgatttttcatttgtcatataaaatcttttaaagtttattgttttactccctttgttattaatagcctcacagtgtttacatggccctcctttttggcaatttaagattcaagtcttgtagctcaggactgaaataggcaccagccatagagatgaacacttatgctgttatttggattatagatcaagtcttattgctaaagctgtggatggagactaggaaggacagacacagagtctgggattgggctgttgagctgtggatagttcctcttcgtacatattttagctacctggtatgttttgaaaatatactcatcaggtgcttaacttgtattctttattatatttctgtcttcctccaatagttgaaccagtaaataattttctgtatactaaaaaaaaatgtggtacatttactttgtatattaactttggttgcattaactttgtcggctcacttgtaaatatctgatgattgataagttataaatcaacaatatgtcaaaaagaattagcttgttgtgacttcagtcagtggactattttcttgtttttttttttttgagatggagttttgctcttgttgctcaggctagagtgcaatgatgcaatctcagctcactgcaacctccatctcccaggttcaagcgattctcctgcctcagcctcccaagtagctgggattacaggcatgcgccaccatgcccagccaattttgtatttttaatacaggcagggtttcaccattttggccaggctggtctcgaactcctgatttcaggtgatcctcccgcctcagcctcccagagtgctggtattacaggtgtgtgccactgcgcctggactatttctttcatggggttttctgcttacaggacagcttattgttaactttttataattcgcatctaaacttttaatggcttctgatttaggatgatttcagtctcatctttttttcactgcctgctaaataagttttgtcatgaatttccatctttgtagctaaatgggagtcatgcaagtctaacttcaaaaattaaggacaagagactaaacctttaaatttactgtgatctttgattttaaatgttttgatataagtgtttgctgatatattttgaagatggaagttgggacatctcaagttctagcatgctttttctttctttttctatctcgggaacttgaccacagatctcgatgtcctaatagaggcagccttattatttcctctgtccttaagcaaaaacaatacatttaataagttttgagtaacggaacattctatggctaaatgactccaaagtgggcatcactcttaggctttggccaacttgatgctatagatttgattaggggacttcatctggaaatttgtagtgagaaacccagatggaactctagagaaaatacactgtgcatcataaggctttgctaaatgtaggaaatagaaccatgccccatttggtgacatttctcttagcaaattcccatgcttccaaataacatttaaaaatatgtcgtatttttaaaataattatttaaaaaataatcttaattaagcagctttatttggtattacggtaagcattgatagagagtgttaatcatttctattgatgttcttcctgctttgacagttttcctgttcaaattgagccccttttaactgtggcttatataaacatgtttattttatttttagagtcaggatcttccttgatctcccaggctggaatgcagtcgtgcagtcatagctcattgcagccttgaacttctgggctcaagtgatcttcttgcctcagcctcatgagtaactgggactacaggcatgtgccaccatgcccagctaattttttttttcttgttttagggacaggatcttgctatgttgcccaagctggtctcaagctcctgtcctcaagcaatcctttcttctcagcctctcaaagtgctgggattatatgagtgagccttgatttttaaagtgtaaggccttaactttcatttgtgttaagcagattttatgtagtccactggtagttttcatgataaatatctttaatatagaggtttttaaaataaaagcgtgttttcttaacttacgtatttctaacagaaattattttagttttgtggaatctttttatataaatttctttctgtgcccattcagagatcctcttgtttggttatctttttttcatggaaatacacagtaaggctcaattagtttgttatacccactttatcccaattcttaataggcttgtagctttgataataatcatttgctcaatgacctcaaggataaaaagatctatcaggatgtaaggttttagttattataatttgaagaaataaactatttgagagttagaatttatcagtgcactctttcttctgctgtatctcattttcattatattgatacttatacctaagacctataccaaatttaagtccttcttagttttttaaattctactatttaaatatttcttgaatatttcctcccttatgcattactggtgtcactgtcttaattcaaggccctagaatgattgttttgacccaaactagacttttatgcctagggcttactccctgtctagcagtcatttgctctgccaacagatatatcttctagagtttggatcatatgatgccccagtggctcttcagtttctaaagaataaaatgcaaacctggaatctgctgttcagcatcctccctgttagacttctggatacctatccagcctcctgtcttcctcacattctctgctgcaatgttattaatgtacctggcagttcccaggagggtcactctctttctggcttctgcacctttatcatgaagttccctctgtattaaatagcctttctctgtaagcttggtgcactccataatcttttattctgctctagtgatctcttgtttttacatattttctgacaactcccttctctgcatttcaggtttcaattaattgctctactggttcccatgacattttatacaggcttcttttggctctgatgtcactgcattgctattagataattatatatcttttttctttactaggctatgaaatccttcaggtcatggacaagatttgttgcagctttgtatagcccctgatacaaggcttggtgctggggactcaatgttgaataataatacaagttgaatgaattaattaatcatgttcgaagattagtacagttttggttcagaatgaactttccagcactatgtgttgtctaataatttaaactttttacttggtgaataaaattcagtttatttattttcctgcaggttttgaataagaacatattttcatagtaaaaaaaagtcttctactggtcaagtccgaaaagtttcaaaattcagactcataaaataaatgtaataaatataacaaaatactgacctaggtttataatagctttatgacgtggtgagggcacttttgatttttctattaaactgtggacagcatctccaaggccaaactacatggctctgactgcttttaccccttgtatacaaactttgagctatctctgtgtactgattttttctttccctgaagagaaaatggaagaaatcacatagattattcatctacattgtaatccaaatgtaagtcaccagtagcatgtttattccttcatgcatagggtgagtcagtgctatttaataggccttgtgtgtcatagtgtgaactttacctaagataccgaggaatttgaacttaaccatttaaatttcaggaatatggtaaagaaagagaaaattatatacttttaaataaaatagagaaaagcttcctaaatcttgccatctagagtaagtttcagaataagaagtgatataacatctatttctggaaaagtcttgaacatagtgctaaataatgcactagagaaaaaaatctatgtttttaccttagacctctttaaagcagagtctagcaattatcatgtatttaatttacaagatgagagttatttttattcttgtgaactgcagttgtcttcaactaatatggtattgaaatggaaatagaaagaagtgaaatctaggtaaaggacagatgcgtcaagtaacatgacagctgaaatggttcatttacatggctgacatggacagagtgcagcgaccaataccagaattgcttagaaaccccttcatattttggggaaaattgtcattaaagcagtatttctgatttaaatgttaccttggaagcaggttatatattgctgtgaaatttttttttttttttttttttgctttacctgaaaaaaagaaacaaagcatatttcagtgtttaaatcctaggtcttccacttgctaccagtgtgaccttggttaagttactaaaccccatttaaaaaaaaatctttagaatgataatgatagtaccattattattaggagagttattgtgaggattaaatgaaatcatatgtaaatagctctcaacagtactttgcgtgtggtaaatgctctgatattgttagttcttattaggatgctgataatcatactataatgatattattcttaacctttttgagctctttggttaaaattaaatttatgtgtttatattcattctggcatgttgcatattgacagcacccactaagcatggtgttctgggcacactggtgaattacagtagcataaagaaatgaccttgtccagaataaacagaccaaaataatgaatgtattttaaaaatatcagatccctgaatagagtctggagatcttgtttttggtgttggttttatgcttaacaagctctgcatccttgagcaagttgtgaattccttccacgaaataagggacttagaccagatacttgttaatatttttttctgcttcaaaatattatggcactcaatcattgactgtcgggggagttaggggaaagtacttatacggttttagggccgaggctggatgatttcaaggtagatcttacaaggtggagaactgattgtgattgtgagagttgagctgatgagataatagctttggatttgtcagtacggtgatgcaaagatcttaaagcaagctttgatgaacaagatgttagttttgatatttaagctgttttagttggttcatgatcttactttctagggattgtagagctagattttcctaagacaacaaagctgctgtctaattttgatctctggcatcttcaacatctcacaccctctcttcttccctcccctcttctctctcatttttttttttttcgcaagatagtagtactatcactgtagagccttggatctaattaaattcagatccagttaagcgggtttgggatagggcctgagaaactgctattctaacaagctcccaggtgaggcccttgctgcctgtggatggcctgcactttgaagagcagaagtctatctacagcatcatatttgttgagcagcagtcctttgtgccatcttcatctcttctttgtcttctaattcagattgcagatcttgggctctgaattaagcatcctcatattccaaacttgaacttagtctttgaataaatatgtcattatctgcatccctgattcccactgggcataaccccacagttcctgggtgtgatccatggctgtttttgcagcttcctttcactggtatggcactctgcttctgtcagtttgctggtgtactccaggttctgacttctggcctggatttacctggcccagatccttttactcatctgaacccacttcagggttccatgttgaggccattgctgtacattgctataaacgttaaaatttccaactgttgctcttggaaatgagtatatatatatacatctcctgtctcatctgtttatcgttcatgactacagtaattagtgatcccttctgtgtcctgaggatcatgtagttctcctttcagtagggagctctgcttcaggatgtaatgactgcctccattttcagagagttgcctaaccaattgaatggaaatcagaggtataactggttagcactagaagttaagctgatttccgcccgagtccagtttatttttccacatgtgtatctttgagaaactgatgtgctaattgcttaaaggtctttgtggaggctctttctgatgctggtgggattgggttccttccagcctctttcatatttcatgcagcttataatttaaaagagaacaatagtattaaacactggctttagaagttctttttttcctaagtatccttgtaagattcaacaatattatggaatgaccgtaaaaatagtggtaggtgcttcaagaaatataattttctttgaaaagtagaggaaacagcaaacagtcttcaaactaactacaaaaaactgacaagttcaaggctgatttccattgtagtttcatgttacagaagtagtttagtttcatttgctgtagtataagctgagtaccttcaatatccattgtcataactccagttttcatttcaattttttgctgcaataaaattcttataactaaattataatgcaaattaaagtactgcaaaattttaatagacgtaatgttcacccatagtcacattctttcagtttcgtattacataaaaaactaatagtccataaaaatatggtaaagttaagctacacttagaatagacatgaaaaaaattttaagccaaactagatggtctgaatagcatattgaatgatgaattagaacttaaagaatgcctattatagctttccagttctgtaattttaaatgtatttattagaaagtagattaatttacattttgatgtcttcattataatgtggatgtgacaacttcgtactcattttatacttctctatgagatatttggttcctctcccaagggtcgtgagtttgctttgtctcccacagagacagcatggttttctgggatgtttgacaactagctttagttaggcatgacggttgttagtgacttttcgtgaaattaaggttagctctgaatagtcatgcttcagaaatgatcattcattttggttatgaaatttttcttgaagacttattagcatcactcctgtgtagcacagggtcatattttattggcgcttttatccctcatctgacataattaatgctcttccctctggcatggttagaaaaagtggtaatcttggttttctgcagctcctgctcataatcactaaactacccattgcagcccaaggctgctttaacttcacattatttcacttagttgtctttttctgtttttaaaaattactgattatttaatttgctgatttaaaaatcattatgtgggtcatccattcttggattgatcaagaggattctgacattaacctgacaaagccaattaatccagaaaccattggtttcccacattgtgccccagtcctgtcctaagtgctgaagtagatgacaaaatttaaggcaaagaagagaagacaattcgtatttaatatgcactgtgtgttgctttatttaaaatatttcacttaagcctcacaacatccctgtgaggttatataattttctccacttttcagatgagaagacctagctcagagagagcccaggtcttgaaagttacaaagtgatacagctgtgattgcagcccagttcttcctgttttcaaaacgcttgttgtttccatgaccttttagctatgaagaccttccatgaccttttagctatgaagaccttctgtgaccttttagctatgaagacgttctcccctccagcagtttgttgatactctgagggctggggtaggggaaggcagtttctctcttttacttgatttaacattgggtttaaccttattcactaaagaatgaaagctggcttgtgaaaaatgtggcttggattccgtatgagaaagtttggtcagttaacgattatactataggtaggtctttgcaaggcacttccttagacggattctcaggacagcattggagcaaatcactgaagtctaggggttgtacgtaagtatagtgtgggaaaggctaatgccatctcttccttgtttcacttagccaataaacaaaacttcagtgtgtttctattggaagaaaattaactagcattcattacctacaaactctgtactgtccttcagaagtatatctagttttattctggtttttatttacagtcagcttactttgctaatttatagtttattgtgttttttcctgctaacattcaagacttcccatattcattttaattatacagattataatttctatacaatttctaattgtagtagtaacattcacattaaatgtactgctgaattttgccaagacaagaatatagaacaggcttcatcaaagtgtaaatgagaagtggaaatggtttgggtctatttttcaaaatgctgaatgacttgaaagtattacttctgtacgacttgcgtagaataatgtatgacacaataaaatgcctaatataacatctttatcagtataataacaagacataatacaattaattttttttttgagataggttctgactttatcacccaggctagagtgcagtggcagtgatctccgctcactgcaacctctgcctcctgggctcaagcgattctcccacctcagcctcccatgtaactgggattgcaggcacacaccaccatgcctgactaaattttgtatttttaggagagatggggttttgccatgttgtccaggctggtctggagttcctgggtttaaatgacccacccaccttggcctcccaaagtactgagattataggtgtgaaccaccatgcctggcctattaaataatttctttttttttttttttttttttggagacagagtctcattctgtcaccctggctggagtgcagtggcgtgatctcagctcactgcaacctccacctcctgggttcaagcgattctcatgcctcagcctcccgagtagctgggattacaggcgcccaccaccacacccagctaagctttgtattttttgtatttttagtagagacgcggtttcactatgttggccatgctggtctcaaactcctgacctcaggtgatccacctgcctcggcctcccaaagtactggtattatgggtgtgagccaccacacctggctctttctgtaaagatttaaagtagtatatagtgaagttcttttcccctccatataattcagttaatatggtgaactaagactctgtcatttaagccttagaagtttggaattttaaatttttacttgtagtataagtatgaaataatgaccctgagtttctcttgagaaatcttattatgtgttcagattagtattattctctataaagtgatccacttgtaaggctacatacgtttattctagtggtgctgccattggtcaaatcgttttttaatcatctttttatatcattcccatctccgtttataagcaatagaataacagaacataagagaatagaatagaacacactcaatagaagagaacaatgaattaccttatagttatagttaaggttattgatgagtgagtcttcacttcatctgcactgattcgtcaccttattcattgtggctgagtcacagtaacttttggtaaggtttagacatcagagtatagtaatttcattttgttagtaaatacttattaagcactcactatgtgccaggcactgttggcactggggttactttggtgaataaaacaattgccatttataacattaaataaccacttctaaatgcatttgtttcctaaaaaggagttccaaaactttatagaaagattagaattgtcagaatacagctctgacctcacagaaatcatacaaaatcatagtatattatgggaaggtagtataaataagaaaggaaaatgaaatagctagttgagtgattgctattcataaggtcaacacatgaaacatcaaccaggtttaatatcctgaaatagattttataggccatgttctttctctaaaggtcactggaagaacttaatacctttttattaaaaataaaatgggaatggtggaatgggcttttcacatattatttggataagttgaataggcaaattttgcttcctttttatgaagttatattatttcatatttgccatttcttattttacatgtgaaatatgtttcttacccaccttgctatccatcatggagaaacgtagactctaaatcttgagggttcaaatgaagtataataataaataggagttgttaaataaaagtatgtatatatgtatgtatgcatatacaaataattttggagcaatctcctgtttaaagcagaaagtgaaagcaaggattaaaggctcaatgcttctcagtgaagcattttttttggtgaggtttcatagtataaggaaaagtgcacatgtacagtttgtcttcacagagccctgttttcaaattcagactgccatttaataacttctctgtgcctccatgtggtatgacaaagccattgtcatttatttatctagagataccagtctcacagctttgtcaggatgatgggatggaataatgtatataaactatcttgtgcaatgcataagtagttaggcattcaaatttcctttttccatttaaaaaattgcacaagtagtaaatgcatataatattttcatatagcatttttacaatcagaactataaagaataaaaatcacactcctttccctagtggtaatcatttttaacaatgtggtgtgtatccttctaggcattttaaagtacttagttatctatatatgcatgtacatttcaaatgttatacatatatagttattgttgcttagcttttcaacacctaggatcatgctaaacatcttttcttctgtaacattacttttccacactgtatttagtctttcataatcatatagaactaccttattccttaaactgtcttaacatacttcattgaatgaaggtgtcataatttatttatttattcctccattgagagcacatttattccataatattttaaatttcggtgtatggtggaactgtgcagaaaataaatcatggtttaagttttgtttcttttgttctcaaagagatatcagtcatcttgaagatgctcacagtgctgaatctatgtatagtatattcaaatctttttaactatagaggttaagatgcatccattctaaagtgaggaagacaaattttccaacttgtctaatcatggaaatcttgctcaggaggtggaactacattattaaatcagagaatgtggatgggacagtagcaggagatagggtagtctgtgagaataaatttgtaaactggtcatcaaaagtttcctgaacactgcttcttggtcaggacttcatacatagcagagcaacttcactgctttctttggttcgttcgtatttatttatctagagataaggtctcactctgtcgccaggctggagtccaggtgcgtgatctttgctcactgcaacctctgcctcctgggctcaagcgatcctcccacctcagcctcctaagtagctaggactacaggcgtgtaccagcacacctggctgatttttaaatttttttgtacagatggggtttcgccatgttgccaaggccgatctgggactcctgggctcaaatgatcctcctgccttggcctcccaaagtgctgggattataggcgtgagccactgtgcctggtccctcaccgctttctgttgaaagtcagtggttgacaaaagattaaaaaaaaaaaagtagtaaaaagaaaaaaaaagtttcctgaaacatattttgtcagcttctgtcctttttcttccttcctactaaacatttattgtcacctaccatgtattagatattgttcctgtaattgatcgtcttccaatgtagtatggaaaataacacattaatcaaatggtgaaaataaaatgtattgtgatcacttttgataaacaagcagtgattaaggttgcagaagatcgaacaattaactgctgtgggaattaaagaaggcctccccgataatgtggatcactcagttcagttcataaatatttaccgagaacctcctatgtgccagcattagagatccaaagttgagaatgtattggatgacttgtcctttcgctagtttgtatcagtgaaggagtaaatcggaattttaagaagaagaaattattgcctgaagatgatgtaatttaaatttcaaaactgcttgaaaatatattgtatcttgtatagatgagtcataggacaaacatatagactgttgttctatgggaatgcttgctgtctcagcagctcaaatattaatgccttaataatttacttaataagccaaagatgtagtttgctgatagactgtatgttcatatacaagcctctttcctctgctctcccatgcctaccccgtctgcaacctttgtgccctcgtcaccctcctgtgtgcatgtatgagtacccggaatatacaaacctcatggaactatgggactctttgacctctatgataaaagatcttcggattatgcttacttcttgattatctttttggggaacatcttggcctagggatttggattattcactgcttctttgtacatacttcttagtttgttaacttctgcaacacagtcttcaaaaattgtacacctcaggctttcagagatttattcctgattctgaaaaattactgttctttacatgtcccataactggaagattatctaatcacaattagctaaggcaggagaagaatctgaagttggaaattagaactggtgaacctcaagttgctcagttcccaaaattagagaatcattaatgaaacacaggtggtaaacactgactgattccttccctggggtaagattctattttcacagatttggtgtatttttctgctagaacccaaaacccaaagaaatctgaaagtatgttgtttgtataatatttttaacttccagtatcagtatccagtagggagtgctatgtaaaatgttttttaaatcaatatattgcttcaggcaatgaggatttttgcagacattaatgcaactatccataaagctctattatctaagctatttgtaaacatcatatgcctgtgataggtttgaaattgtgccttaaaatattatgtctgtgagaaaacatacctagaccaaatgttatattattaggtacaagagtttatatatatatatatattttttttttctttccaccttttattttaggttgagggagtacatgtgcagatttgttacatgggaaaattgtgtgttgcaggggtttggtgtacagattatttcatcactcaggtaatgagcatagtacccaataggtagtttttcagtcttcaccctcctcctacccttccaccctcaaagaggcctctgtgtctattgttcccttctttgtgtccacaggtattcagtgtttaacttccacttataaacaagcatatgtggtatttagttatctgtctttgcattaatttgcttagaataacagcctccagctccatccatgttgctacaaaggacgtgattccatttttttatggctgcatggtatttcatggtatataggtaccaccttttgaatgaatccaatgttgatgggctcctgcgttgagtccatgaccctgctattgtgaatagtgctgcagtgaacatacacatgcatgtgtctttatggtaaaatgatttatattcctttgagtatatactcagtgatggggttgctggatcgagtgatagttctaagttctttgagacatctctgaactgttttcgacagtgactgaaataatttatatattcccaccagcagtgtataagcgttccctttttttccgcagctttgccagcatctgttatttttttgactttttaataatagcccctctcactggtgtgagatggtatctcattgtggttctgaattgcatttctctaataatttgtaaggttcagcatttattcatatgcttgttggctgcatgtatctcttctttggagaagtgtctgttcatgtcctttgcccattttttaatagggttgtttagtttttgcttattaatttgtttaaattgcttacagattctggatattagacctttgttggatgcagagtttgcaaatttttttcccattctctagattgtctgtttgctctatcggtagtttcttttgctgtgaagaagctctttagtttaattaggttccaattgtcaatttttgtttttgtttttgttgcaattgcatttggattctttgttataaatctttgccatggcctatgtccagaatgatatttcctagcttttcttctagggtttttatggttttaagttttacatttaagtctttaatccactatgagctgatttttatacatggtaaaagaaagggatccagtttcaatcttctgcatatgactagccaattatcccagtaccatttattgaatagggagtcatttccccaatgcttgttttcttcaatgttgtcaaagatctggtggttgtaggtgtgcagctttatttctggtttctgtagcctgttccattggtctatgtgtctgtttttatactagtaccatgctgttttggttaccgtagctgccttgtggtgtgtttgaaatcaggtagtgtgatgcctccagctttgttcttttcttaggattgctttggctattgcctctcttttggttccatatgaattaaaaaaatttttttttctatttctgtgtaaaatgtcattggtagtttgataggagtatcattgaatttgtaaattgctttgagtagtatggctgtttttttatttgtatttgtatttttttgagacagagtcttgctctgccgcccaggctggagcgcagtggtgcaatcttcactcactgtgaccacctcccaagttcaagtgattctccctgcctcagcctcccgagtatctgggactacaggtgcatgccaccatggctggctaattttttgtatttttagtagagatggggtttcaccatgttagccaggatggtctcgatctcctgacctcgtgaggagaactccagtgagtttagaatttaatgacaaatgtgtgatatgttttgaaacataatttctcttcctccagtactcatttttgctaaaaaacaaaacgaaacaaatcatgataggactgagttgtttgcaacatagactttagtcttatacttatcctgactatttgcataaagtacagcaagaataactatttctacataggctttttagattggtttcgatggaactctgttccacaaggaatctcagataagaccttttaaagctgagcccagccatgggtttgtatcctcaaataccctgtgagttgggtaaccctctcttaaggtcccaagataaacttggagttcgtaggcctgttagaaagtgacattctttactgaccatgggttaggagcactgtacaagaactgcgtaggcaatggtatgaggccagtttttaccatggggcttttattagctatgcaagttgagcttgactctttaaagggaagcataccgttccagtgaaatcttggtaaaacaaccagtttctccaattgtgtcctgctgcaaaagaaaaatggattcttattgcactgatgcaaacatctatattgccataagttaagaatactcacagatagtttccaggttcatgaggaatcaggcagagagaaacaaacatgctccaaattttgttcacaggaatataccttactcaattattaaaggctataaatagtttaaaataagtttccttcacactgaaaaacaaaacaaggatcagcaatatttcaagcagaagtcaaaaataattgcttcagctttctgagttcagtccatttagttcttgatttcttgatattcatgaacatttcagctcttcatgagtcctgtacattttttctttattccaatattacaatctacaaagttatcagaaacctgtatttgagagcacctgtcaaagttctatcacttactataaaccatcttttgaaaagaattagaagaagacaacaattatctgtgaatagaaatgtccagggtagttacagttagaaacataattgacaaagaagtttggtgatctctgtggtttataatagcttaaccttatgtttgctaacatatacttagacattaaattttagaaattccatacagttttggagcaaatattagtattcaccaaaatataacctaaagaagattgaacatcattctggcaatcccatgtaactaaacatgtcagatgatcctgtttacctcttttctggaggctccaggggccctctaaagccttccaaaagccaggtatcaggaaaggcaattatgaggctcaagtttgattttgggaagcctgttaaatatgttagaggattaacacacttgatgttatgaaattgatttccagattaccataaattatttgactgagaaattttaatgaagcaaaaaccttttataaccctttccaaattttgccaaagggcagatcagtgccccaagagtaccctgttgtgctttcattccaatgctcaacccacagagaaaccacataataacccccagaacctagtcaacatgttcacacagaaagcctcttctgcaagaatcatttccacgatccttctgccacttgtttgaaccttcagctttaccttatctaattcaaaacaattctttaaccctagccaatactttacattttcctatcttctaataatctttcattaaaaacacattttactgttcttatacacctagcatgtaaatctatttccagtagtttcaattatgtgttttaatggtacctcctagcaatttgaactttaatgtaaatcctggcaagttgttttaattgtgtgccagatacagccagcataattgactccttccagcataagtaagggtgtggttaattctatatgtctataaggggacagacatatagttctatatgtttgtaaggaagtatatgtcccttacagacatatagaactatgtctatatgtcaattgccttaccagttgtgaagcaagcaagtcaaatagttcttaaaacccaaaaggcagtttgtaaccttaaaacatttagtgagcctagtatctaacctgcataatttagtcctcctatttacatattggtgacatctgcattttactaataatctttaaggctgttgttatttcccaaagattaaagtcacgtgaactaaaaggtaccatagcttttatcttccctttaaaaaatatttcatccaagcacttttcttcctttaggccaattacttagaggtctttttatagacatcacactcaacacatatatagctacactgacaggcagactagaagaagattcagtagttgcaagacctttcatttgccagtctttatgtatctctcataatgtgaagtaatttctgatactcccaaaagtaaaaaatgccagataacacaatgcaaaacagaacagaaccctaaattctgagagggatttatccacttccagttcctggggtttcatgaggaaaacagaggttttttgcaaaatggggtatctggcgccccgtgtttttcccaaggagtcccaggctgttggagcttgaatatctgcttttaattaaactgacttttagccatagcactctttaataaggtccttttaaaatttcttaatacctgactttagccaggccaaacagctgatatttctggctttcaaactttactaaaggctcagagaaagaaaatccaagtcagtttgtggaggggcagggaatcaaaaaatggcaaaggtcctgcagatatcaaactagaaagaactcatttcctaaggcaggattgaactcctggctgccattgtaaaatggtgaggctagaacaaaacattgccacgtggttgcaggccttgctcccaaggatgtaaaacagaatggaggcctgccacaaagtttgctatggaaagatggacaaagtacactagattggctacagattaagaccagcctcacaaatcctttttcacaattaaaactctactgagaatataaacagtgatccttatcattcctagcctagttaaaatgtcttctaaaaggaaaaaaaagctaatttaaaagtcaactgctgatctggtggagaaaaggaaagaaaaaaccagtttaaaatgcctaaagaggaacctcttatttttatgcaaatggatgcctccatcagtgagaaagacttcattactgttcaagggagtgggaccttctggctgggggagcggaaggctctatggatgcatggcagggagagctgcctgctgttgggcacccttggttcacgcaccccagccttggcagggaggggagggtggcgggagctgctgctcgcccttccgtcacaaaaaagaaaggaaaatgccatggagactgaggctgaccttctcaacacctgggagtgacaggggttggggcatggtttcccctgccctcagaagtctgaggatgaaaaggcttaaaaatgagataaaaatagatttggtttgcatctcactcaccctttcttaagccccacgttgggtgctaaactgttgtaggactttctccttagttcacctaaaaatggggtccttgtcacacaaccatgagagattaggcttgcaggcactttaaagggcaagaaaaatttatcgggcaaaaaggaaaacaaaggtaaacagagagtctcagcaaagccaaagtcttgctagctggcttccgcctcatagattgaatcctaggtaccaccctggaacaggggagatcaggctcctccctctggcaaacagtgcgcacttcctgaggctccaccccgttgcacactcctcccagtgtgcaggccagttggaagttctctggggacctctttatgcttgctgtctcattcctgaaatgaggccagtacaccaggagcaggaggggggaagggaagagcagttagaataaacagaaagaggaagaggaacaatttcagcagcacttttcattttaaaagtcactttataaaattttacattttccttttgcaaagaaataactttgtcagaacctcttttagaaacttctaagtatcattgaaaatagctctcctagttattttattttagagctagctttttaaaattgagagtacagataaactagttgaggtattttaaaagtacactatttcgaccgttgtaatttggggtcgtctttagttacgtgtgaccagttttctaaatgttagcatgaagaggcaccataagcattaaatataaatccagctggtgtttctaaaggtgggtcaccctttaaggacaaagtctaggttttagagatagttgtccataattttcgttttccttcctgaatgaccagaaacctagtgggactcatgagagccttttattattttggtcactcaagaacattttagatttatcaattgaaccaagcttcagaatttaactggtttttaaaattacatgtttttcacttaagcctcaaagattcacttcctcttttcaaagaccaaagtttaaactatagaaaaggttgaaaaactccaactagtagttcaaaataaaaccttaacttcagagaaaaatgaaagtcacaaatccgaggtcaacagatctctagagaataacaaatgaaactcttgccttttatagagcttcacttccaacctcaactagttaagaatatgtacaaattgaataaagtcttaatccttaatcaagccaggaggattcagatcccaacaggggccttagcagagattcctgctgactttggcaaggttgggtgaaggaggacttatcgtattggtaccaaggtgctgattgctggtaaagtggtggggctctctagaggtccacttccgatctcatctagggtaccaaaatgttaaccttaaataactagattccgaaaatgtgattcattatagagtattcaagcctaaatctatgtggaagcatagatagaagctgccctgaatatatcttctgattagcatcagttacaggtggattttaaaggaaagaggcagcttctaagttgtgtttccagtaacttatattaatataataaaagttattgattagctctatattgttctttgtatcacaaattccaggaactggaagataatgggtaaggcagctagtcaggaacaaaaatgcctgtaaacatggcccttgggtgtgggtgcataggaaggaaagtgtgattgaagtcccttactcttgtcttcctgagcctggtaagttttgcatacctcacctagctcagtctgctctgagctatttttctcctatcattgataagttttattttactttgtgatgtttgcgtatagacataatgcgaatgggaaaagcatggaaaagaaaaattaacattttacaatttcatttcaattggaacatttagtagaattttctgttattttgtagctctttaatttgctttgggaattcatgctctattaattgctgtctccatttttactggcattgatgctttccagatgtcctatttttgtttaaaatgttaacattgattacttttcctttgacttagatttgtggtattgtttaccataaattgtgtagaacatccttgttaattgtgtagaacatccttgtttaattttatgtagttactttagaaacaatacaatgatgatcactaaaataataacatttatctaaccaagctgttcttgacttatcatgggcgttctttgaatgtataatttagatgattttacttttacccttttctgctatgctttgaacatcttctatttttcctcttactgaatagatacttattttcttgagaggtctgattttccttttgtttatttattgttgcctctaacagaactcctttttttttttttttaagaaaaattagatgacagaatcactatagtcccttagttcttaaatatcctagcacttttaaaaataaatatttttaaatctaaaatcttggtataaatatcatcaaaacaatctctcaaaatcaattcacctaccattgtaatgcaggttgatttaagtttgcatattctatatccatatgctcatgtatcatttaattttaatggaattatatactcagctcttggtgatttatgttttgtatgtaaagcaaaatactacctctactaatagagatctaaataaaaacagaaatgttacccgcaattcttccacctcagcaaaggtgtcccctttaatttttatatatacatatgcacaatttataaattatgattatttgtacctaatttattttctttcatagtgaatgagcttcactgggagtgtatagactcctagagcttattaccttatgctctagcagtggcatattactcctttctgattgccaggctacccatatgcttatacctgcctggagctagttgaatacaggaaggcaagggcatgactggagggggctgggtcctttcctttgaagcaggaaaggagtactgatgttctgtatgttgataggtctctccgttcctcactatggacccattcctgttggtgccattgtgaatactcttgtaagaaaatcttcttttcgctcagagcaagtcttatctacaaattacctatcttttcagcagaagataatgagactgttgcctgaatgtataggccctttctttacgttcttcttattgttactatctgcgtaaacataaaggcttcccaaaaccttggctttaaactaggatgttggacacagcaattttatgagcataaaggctttaattttctttaaaaacagaatcttaatctgtgccaatgtgatttctgccactaggtaaattataggttcatttttgtgctatgttcttagactatatggtatacattacctgaatccagagatggattaattgtgaccttgagttgtttttaatttctgagtgcttttaacaagaatgagagacagtacttagtctatcttttcaacaaaagataatgagactgttgcctgaatgtatacactctttctttactttcttcttaatgttactatctgcctaaacataaaggcttcccaaaaccttggctttaaactagcgtgttggacatagcaattttatgagtataaaggctttaattttctttaaaaacagaatcttaatctgtgccaatgtgatttccccaactaggtaaattataggttcatttttgtgctatgttcttaggctatatggtatacattacctgaatccagaggtggattaattgtgaccttgagatgtttataatttctgattgcttttaacaagaacgagagacagtacatagtctgatggctgaaggttcagatgtctgtctttcagttagcagttgagaaagtgcactagtcaagtgaacaattttctatatccattttgtggcaaattatcatgattattgtgtattttgtagcttttgagcagctgactctgctaacacctttgagtagttttcaaggctgagaagtagaaatgatctgcttatagtacagataataaggcaagaatatcatctccctgggagaaagtagaggattaggaatttcagcatgaaacctagctgaatattcgtggagtggatggctttggagtatgtgaacattatcttctttccttgagggtttgggggtatgattatttgagaaaaatttgtgtaatgaaacattagcataaggaatgaagtttggatttatggtcccataattagacatatttcttaataactagaatctattgacaaatgactaccacatgagtattagtgacacttagttgtttggaccatgtacacatcagttagttggattgagtgctggaggtaagggtgggaatatcccatgacatttcaagttcttctgtatttattttcaaaggtactttattccccctcttgttcccccagcaagaaggtttacaagtagtaaagtatggtacttcacataaaataatggaagttagattaagcactgcttcttcatttgtttagagtttttctttgtttatctttgtgaaaatgactgaatttgatgggtttttattttttcttttaggctcagtttatgaacctcttaaaagcattaatcttccaagacctgataatgaaactctctgggataagttggaccattattacagaattggtgagtaaaacctgaggaaaacgtgtccttaggtatctgcgattagtattccccttgccctagttaaattatgtacattatgtggatgatattgttctgtcattgggatttggggtactttcagtgcttaagtagctgtgtattccaattgtatgtcgatatcaggactataaaaggaatctggcagatcatatctggcccttgaagaatttgaaaactgtcaccaatatcttctgtgtttttttaatcttcctaaacattaccagatttgagaccttgaggatgtttcttgattaatacacagatatttcatataagtattaatttgctcatttacctaaacatggttcccagatagtcctaaactttttatatccgtttctaattcattgagatacaagagataatcacaagttagtattattaatatcagggcgcttgtgttttgtttgttttattttgtttttccaggaccagccttgcaaattttgtttttcaatgtgagtaagcaactttcagatatgtgtataagggcctcctctttgtttgtcagaccatctattagaatgcatattaatctttttgtcagtttaccttttatgccatttacttgtactaggatggcagaaaacataaaatttgatttctctccccctaagatgatggattttttggtctatttcaacttcatatgaaacttcaatcttacttcttttggtcaagattcttgcttgcattaagttgcccattttattatctttttggcaataactagctaaagagaactaactatatttttttatgtcaattgtgtattttggactcttaggactaattttttacactgggaaaaataataaataccctggttttctgaaagaaatgattatgataagatcaatttagaggctgggcatggtggctcacgcctgtaatcccagcactttgggaggctgaggcgggtggatcacaaggtcaggagtttgagaccagcctgaccaacatggagaaaccccgtctctactaaaaatacaaaaatcagccatgagtggtggtgcactcctgtgatcccagctccagaacagaatgttttctgcctttggaaaactatcctaaaaagtagataacatggctaggtgtgatctctcatgcctgtaatcctagccctttgggagaccagcatgtgaggactgcttgaacccaagagttcgagaccagcctgggcaacataacaagccctccatctctacaaaaagtttaaaaattagcctggcatggtggcgattgcctgtagacccagctacttgggagtctaagttgggaggatcactgaagcccaggggttagaggctgcagtgagcttatgatcatgcaactgcattccagcctgggttatagagtgagaccctgtctcaaaacaaaagggtagttgccaatctagataaggttaatgtaatgcattttaggaaaagcattacccatccatttatagttagatagcaataaaatagtttttagtaaatgtaattttagtgtttgtgttttcctattttagagctcatttataaaagataataaaatattaatttcagacttaagtaaaatgttcataaaaaattatttacttgctgctgtgttcatgttatatatggatggaattcagttttaaaatgttaaacattttcctaacctgtacaataaagtaaaatgaatactgtagactccctctgaagaccaggcacaatttagtcatcagtgaaacacaggattccagcctgttctgtgatcttcccctcgcccttcctacattgttgatcatttactgtagcagttgaggtggctttgtgatttactaaatgtatgctactctttcttgtgcatttgctttaagtttacctattgaactgatttttaaaaaatattatacttagtcttttgcttcatctctttttccctctgtacctgatgttgtcctaataagatttctaacacacattgacattactggagatgtgctaaaggctttttaagtcctaattagctgagtcctttcctaaaactggaaagatttctttatgtagggtggattcccactaaggctggagtgacatgaagttgtttccacatcttcagaagtattgtactatagcaagtttagaaacaaaatcgtcagaagtgggatgaggaaaccaaagaagattaaaacatttagcccaaggaaagtcgctgactgtacagttcattctttgtcttgtcctcaattgcagtcaagtcaacattgctgctgtatcaaagtccaactaccggtctctttcccactaaaacatgcggtggtgaccagaaggccaagatccaggacagcctatactgcgctgctggggcctgggctttggctcttgcatacaggtgagctggtgtgtgttctcctcgtaactttgagagtggataatagggttttgtaggaccaagactaattgagccgctatcttttggctctgctgctgactcactgtgcgacctatgactgctcacatccctttttaggcctctaaaccttttcattttctttttttttttgagatgaggttacccaggctgcaatgcagtggcatgaccttggctcactgcaacctctgccccctgggttcaagcaattctgctgcctcagcctccctactagctgggattacaggcatgcactaccacgcctggctaatttttgtatttttgatagagatggggtttctgttggccaggctggtctcgaaatcttgacctcaagtgatctgccagccttggcctcccaaagtgctgggattacaggtgtgaaccaccatgcccagcctaaaccgtttcatttttctaagagcttatatcagaccagttctaagattttatgactttgtgaccaaaacttcttgtctctaggtttgtaaatcaccatttttagtcattggtagaatgaactacctgcccactctcattgtgttgattggtttcaataatggagagaactgatgatgactaaatgttgcagataataaaattagaaccccaagtacttaacaaatttgttcaaaatgatgcaactcattaatgatagagccagggtcagaattcttttcccctacccaatttctggttttatcactgcacttcagcatagtatctcttattaagtttggtcataagtgaaataattgtataaagttaaaaaaaaaaaagaaatagttagacaatacaaaatttctcctttatttatttcattatatgtagaaagcactgaatgtggatgctaacacataattgtaatacattttaaccataattaagatcagtaagattaactttctgaatattaatttcctgaaagcgatccatagttatgtttctgatttaaaaattgtatcttccacatgaacacgatttatctgtttgaaattactgatgtgttggattttaaaaagaaaatcaaacactgagataagatgcagtagtcttctttagcacacttgaatgctgacatcactaaaagcatttccttacatattctaggtaaggacaatatggctttattaaatgtaaaactggtactgatcttaggagtacagggagcatcagtagcaccttcaccaaatggtgaagccaataatgagacagactgatgttaattgccattcctgatttgacacaatgggaaatacaccttgtgctaacatcttaccaagttatctaacatgagtctacatatgaacaaagctgaattgtggctgtttataagacaacttgcctggactctttaaaaatgtcagtattacagatgactaggaaataagtatgaggatggctagactaaaagagactaaagaaatacaacagccaaatgcaatacatgatccttaattgggtcatgcatttaaaaatactgtaaagtatgaaagtatgtttttgggacacttcagtatttgagccaagactatgtattagatcatatagtatcagtattaaatttcttaggtataataatggtattatggttatgtaggcaaatctccttgttttctagagatacttctgaagtgtgtaggagtgaagggtcatgatgttcgtagcttactttcaaacaatgaagaaaatattatagagaatgcaagctaatgttaaaatggtgaatctaagtgacgaccaaaagacttattcattatagcatccttttaacttttttgtagatttgaaatttttctaaataaaatgtttacaggaaaattgctttaacaaatacaagaggataggcagcatatggacaaaagtcagatattaaccttttcccagaatgcttctaacatcagatagagactttaaagtcctcattttgcaggcacactatctatgtagaatatgcctctattaaaacacttgtgtctgacctcaaggggaaaagtactgtatagagcaaattcatgctaatttttgtgcaatgccagcatgaaaaagaaggtatgatgtgctaatgatgaataacttactttttactgacattcaccatactatgtcaaaataataatcattcttcccaatagtgaatggtatatgcaatctatgatttaactgggaggtaattataatatactttttaaggagagaagtgatactttttaatcatgtgagaatgattgccagatatttttagttaagattaagtgaaacaatgaataaatcacttttattttttagtagtgggtgattctcatccacctttggaaagttactgatttataataaaaagcaacttgtggacagaaggaacatcttaaccaaactaggtttggttaaggtatttaggttaatctaactattaaactaaatagttagattttaggtgttctttatttttaaaagcaagagatgtaaaatatgctcaattgattttaaattaaaaccaaagaatataaagctctatgccaaaatacatcatgtatcatcctggatgtgtgtttagttgaaggcatccttgactatgactaaatgcctgctctgatggtattgaacacactgcagagcaaagaaaggcagcacctaccttaacttgtggctgctacttaaatccaagcggccattgcataacctacagggatagctaataaaaatcagctttagttcataacagtgaatttaaaacaatctgttggtggatttttttccaatagaaatattctttaaagtttcagccaaatcgctgtagaaatattgtatactatttttaaaagaagttggcttgcttccttgaaagaaggaaaaatctgcctaagtttcatcataggatttttttttcattgcagcatttctacttttgctgggaaaatggagtttcactgtgacagaattggtagacatcaccagaacacaggattagccagatagttaaatacttaattatcaaaagctctgcttccttttcaaatgcatttccaattagtttcatgagttatctctctcacccaggcgaattgatgatgacaagggaaggacccatgagctggagcactcagctataaaatgcatgagaggaattctctactgctatatgcgtcaggccgataaggtaaaacattgtggtgtggacgggaattctcccatcattctgaaggattaatttaactagtatcgcaatggtttcttctgaagaagaatgtacttttcaaagggaaagccacatcctagggcggcctagataggttaacagcctttgccattctagcccagggtttgaaatcctgagattgaaggaacaccttaagcaagaggtgattgagaattgttatttagacttggatttgtttgtgttttgcatctggtgttgcttgataaagacccagtttctcaggaacctcacaatatcgataattctaaccaatattttattaaagaatatccttgtcagaattacttttggacatgtgaattgctctggcttaagtgaactttagtttaaaaatgtaacacttcattcatttacatacaaaaaggctaggaattataggcttagaaaacagctttacaggccaggcgcagtggctcacgcctgtaatcccagcactttgggaggccgaagtgggtggatcacgaggtcaagagatcgagaccatcctggccaacatggtgaaaccctgtctctactaaaaatacaaaaattagccgggcatggtggtgtgcacctgtagtctcagctactcgggaggctgaggcaggagaatcgcttgaacctgggaggcggaggttgcagtgagccaagatcatgccaatgcactccagcctggcgacagagcaagtctctgtctcaaaaaacaaaaagaaaaaaaagaaaacagctttacagcgttatgtggaaattaaagaaaataatgtacataacaacatttaaaaaactataaagctctatacaaatataatggctattcccttacttacctacatctctgtgatcccaggtcctaatatagtaagtgcccatacgtgtacatcaatgcatatgggtccctaagaccatccacaggtttgatgcttcattaggaggactcacatgactcatcagatagtcatagttgtggctatggtttattacatgagaggagacaaagcataatcagcaaagggtcaaggtgcatggaacacagtctggaggaagccagatgctagcacctaggagtcctccccagtggggtcacacagatgcacttcattcccccagcaactgattgtgactaattgtaacatatgtaaaatgtctgtcagggaagttcaatagaagcttgagatttttattgctcagggtttttgttagtggttggtcatgtgggtatcctctgtctagcactcaccaaagttccagacatccagaaggaaaccaggtgtgtagtatcaaccatattgttaatgtaaacactttaggtttacatttaggtttagcccctcttgtgagagaatagtggaaaccctttcatgatctgagtgtccacatatcagccaaggggcaaccttacaaacaattctttctgtggttagcagtctcaggcctactatattaactcttttcaggacaatctgcataaatgaatgtactggtttccagtctgcttccaactgtgtgatgttggacaaattatttaatttccatgtgccccgtttttttcctctgttaaatatggataccagtaatactgcccttattaggttttgtaaggattaagaaataactcatgtgagtgagtcagtgttttgcaagaaagccgccttggcgcagtgaaggtgaaggccagcgcactccctggctgaggtgggatcccgaggcctctccagtcccctgagggtgcaccactggcccatctcacccagggcggtgccccagaggtggagcaccagggcacgtgttaggacctgaaagatgatgaactgtgcctggtcagggcaaagctggaggaaactagtggaagtccctagcagtcctgatgtgtaaatcgattggtcatccaacctgggtataggggtgaaagactgatggaaccatctagtgtctggttccctccaaggtttctctcaggatggctggcactcttccaaaacccaccccacatggtttcatctgtaaagtgaatgattggaggttttacgacccaaaggatctccacctactctcacactttagttgggtaagaagcccggcttgctggcgtgtggagccgggtatggaatgtgagtgcctagtgggccgcttctggtaagcagacctggctctgcgggatgaaccgaatgccggattaaggtgcccaatgcccacacactcatcagaccccagaaaaggtgttggttgatacaggaggagggcggccacggaagtcagagtgggtgggggtggggaagggcagagaatgtatagagaacatggtgtctgcccccataccaccctgaacgccctatctcgtctgatcccagaagctaagtagggtcaggcctggtcagtacttggatgagagagagcacatagcacaagggctggtaccgggtgaacatacagtaaatatttgtgtcgttatcattagtagtattccctttcccttctagaccccgtgtttcagatgcgtttccaacttctgtattttagcagagatgcacacaagtaactttgcaggcagttttgatcacttaatattttgtttattttttatcatacaaacatattgttttaatttgcacttgaaaataataggccaggcatggtggctcacgcctaaaatcacagcactttgagaggcagagacgggtggatcgcttgaggccaggagttcgagagcagcctggccaacatggtgaaactccgtctctaccaaaaatacaaaaattagccagatttggtggtgcgcacccatagtcccacctgctcaggaagctgaggcacaaaatcacttgaacctgggagggagaggttgcagtgagctgagatctcattgcttcccagcatgggcaacagaggggaaactgtctcaaaaaaaaaaaaaaaaaagaaaaaagaaaaaagagaaaataataagctgggcatgatggctcacgcctgtaatcccagcactttgggaggctgaggcaggcaggtaatgaggtcaggagttcgagaccagcctgggcaacagagtgagactccgcctcaaaaaaaaaagaaaagaaagaaaaaaaataataaaaagagtgataacaagtcttcttcttcaggcctgtaattcaagtcaaaataaaaaaaaatcattaatattctgctactagaatatggcaacaagaaaatgttatagagaaaaagtatatttattcataagctgataatagagacatatgaaaaacctttaatttgtctattgagatttgtacaaatcaatattgcaaaggtttttcagatgcttgaaataaagtagtatgtcacagattgacatactggaattaaactagtatgtcatatgttatgttgaaataattgtgattaaagttaattttttcctaagtgtgagatgttattgtttgtttcatttgtatcatttcatgaatgcataatgtctttatgaattcaacttttctctctaggacacattgtgaaaatcaaaatcatgactttcatgggtttgccaaacaagctgacaaagtagaattatcagaaggaagtctaataatgtattagtttaaggcaggggtttccaatcttttggcttccctgggccatatgggaaggagaagaattgttttgggccacacataaaatacactaacaccaaccatagctgatgagctaaaaaaagaacaaaattgcaaaacaaatctcataatgttttaagaaagtttacgaatctgtgcttgactgcattcaaagctgtcatgctctgctggttgacaagcttggattaaggttttttccttgtggcacggttagccagttggtttttttattgttgtttggctggttttttgagacaaggtctctctgggtcacccaggcttgaatgcagtggtgtaatcacagctcactgcagccttgacctcccaggctcaatcaaccctcccacctcagcctcccaagtagctggggctacaggcatgcaccaacacacccagctaatttttgtattttttgtagagacagggtttctccatgtttccccaagctggtcttgaactcctgggctcaagcaatccttccacctaagcctcccaaagtgcaagggttacaggcgtgagccaccatgcctggccaacttaagctactttaaattccttaaattataaaggattatcattttttttttcctatgtagctatgatgtagaccattagcacctggccattagccaattgttagtggccttttctactgagatttgactttacaaaggtgttttgactttataatggcatttcttactcaaccttattaaccagtcatcacaattgtaatatgttttcttttgatacagtttgagtgtgacctaaggttgtttttgttttttaattttaaaaatagagacagggtctcactatattgcccaagctggtctcaaactcctgggctcaagcaatccttccacctcagcctcccaaagtgctaggattacaggcatgagccaccatgtctggcccagttaagctatcttacattctttaaattacaagggattattatttctttcctatgtagctatgatatagaccattaatgtaaatatgaaatgtaaggagtatattattctagtgcatatgagtgtgagggactgactcagggagattgaagcatgcacccagctcaaagcctctcaccataccttcacatcttgttgctgcttgccgttcttttcctcctgtcttggccatttcctttacaatactgttgcaagaggaaatataaacatatcttgaaatgtgaaatatttctgtgttggtcttcccttgaaactgaagcaaagcacattagtagtgttcattcactgtttgacctctagcctcatgttgtcttttgaagtaaaatcatgacctagaaagtctcccttctccacttctattgatttctcatcataaaacatgcttcctgatgtattttctaaaaatactagctaaaagagatattttaaattgattatgaatttgagtgaatacaaagacttattcttgatttatttaaagaatttagagcagtctgttttctgggttttattgtcttgacacttatcttaatgcctgcttattaatgtcagctatgttttacctctcagtgtgcagatacctattctcttatttactgtcttttataattctgcctacagagaggcattcagagtttttcagagttgattcaatctgcaattagtttggagggcagacatttgctttataataggctataaatgttgctgtatctatctactgaaaattttttttaaatgctagtttctaattaatgagaaatcattaacttttataaaatttatttttccaggattcccttatgagaagatttttttctctaaatgaatgttttaaggctataagttaaaaatggatgacaaaatactcaattacctcttcccaaatgataaactgtttattcacaataataaaagttttcaggaaaaatctaagcaaaatacgagtggaagaggcattattctagatttattttagtctagaaacttttgctttaattattatctttatttttatttgccagatgccagaatcatacaaaatactaattagcatcctcttgtttttgactgctttcaagagaactttttgtttgtaattgacatacagcatgccccattaatcttcaaagcttatactttggaccttatttttttctgaaattttaaattacttgtcttttaatggctttaaaactcaaaatgtacttatgtaatcccccatttgagcaactttaatcatttagtagttgcttttcccctgacatagtgattgaatataaattgtcctgctgggttcttgcatgtcttgaagacaaatgacaaacaccaccttgtcaactgcaggagtcactttattaaactgataaaaccttatccttttagatctgtatcaagtggttaaaatgtgttttgcttcaattttacctattttttatataggagctcagaataatattcaggacttcaagataatagtgcaaaaagagtgaccacattgatttctatttgtgtaggttcagattactgccagcagtttcagatattgagaagggatagtcatcttctctgaattaacaccagatggctttgtcactttatcagtagagaacttacatccctaactgtacccattctctaggtcctgattacatactgataggttcagacttttattttgctgattaggttctttaatcataaggagggctgtatttgtttgtgtagggcacttggagatggtaaagatgtaacctccctctagaacaatattgcccaatagaactttttatgagcatacaaatgttccatattactcttgagcaatacagtacccactagtgacatgtggctattgatttcatgaaatgtggccattgtgactgaagagcttaattttttatttaatttaatataattaattgtaatttaatttagtcagtcacatgtagctagtgcctaccatgttggacagcatagcttctagaagcttacaagatattgggactctacagctatactgtttctctactaacaacacttctgacaccaaatgtgtggattttccataccaagcagttcttgaatttgagacaccaactgggtatatacagtttgttgcaattcttccagtaatgacctggagttaaaacagatcctataggttcagactcagtcccacaagactacccccggcttccgacaccaattgtaagtagtagatccccaggctacccacaattctctctgacttggctataataattccttggtgtcaatactttgttataacagctcacagaacttgggagacactttacttactattaccagtttgttttaaaggatataagcaaacaccagatgaagtggtagaaggtgcagaaggtcctgagcacaggatcatctgtccccgtggtatctggggtgcattaccctcttggcatgcagatgtgttcacagacccagaagccctccagacatcatcatctagggttttatagcaaccgtgttatgtaggcatgattgattaaatcactggctattggtgattgactcaatcaccagcttttcctttctgcacgtcccctgaagtaaggagtggaggtgaggagctgaaagttccaaccctctgatcccttggttggttcctctgtcaatcagtcccccatcttgaagctatctagggacctatcaagagtcacattattagcaaaaactcaggtatggttgaaagggacttatatgaacaaacgacattctttttgcccctgttgctcaggaaattcgaagggttcttggagccgtgtgcccagaactaggaaggtagaccaaatgtgtattatatgatttcacagggagatacacacagctagtaaaagtataaaacaggaaaaataattgagtgacaactacattgatgtgggagtccagaggaaggaattttggtgagggttcaaaaagtataaaagaagatttttttaagatagtattttaaggagaagaagaatttttaaagatggagaggaaaagatggttctatatagtttcatagtgaattgaaacaaagcaagaatgcaaccacttaggtattatcatcacttatttctcttatttctctttaaaagagaagtaaattattgcatttacctagaggtatatatctttgaattcatttttttgttcttatttatctcagacttccaggaattagcacagtacttgtcacatcactggcatcagtaaatgtttgccatgttgaattgaacaggccgtaaagaaatgggtggattttttggtccccagagtttttctgttggattatttaggtatttacttattctaaaatggtaaaattttatgtctagctaataaataatggcgtggcctatattctcttagagttggtgccttagtaatgagagtacaatatatatggaaggggaaatgaaagcatgttaacagtagcatacattaaaatttgcgacccttagagaaagaaattgtatttgaaatttgaacacttactgaactagaattggcctgtggtcctttttcattatgagtgtcatgtaggcatttccaaataacagctcagtggaatacaatcactgaaatcctgtctcacaacataaagcagaattttactctaaaacaaaataagatgcaaaacattgcaaaagccattgctactacattaacctgctccatactatacctgagttgctgtgcatgtgaaatatcaattgagaatcatgttaactctatcaagttagtagttatgaactttttgtattttttcttgagaaaaggtaacgtttctgctttgttcggtcctctgccttagctttgttcattaaaaagtttcatgaaaaatagcttttaatctatagtcttggataagtttatgaattactaatgttgtttaattttatatttcattctaggtccagcagtttaagcaggatccacgcccaacaacatgtcttcactctgttttcaatgtgcatacaggagatgagttgctttcctatgaggaatatggtcatcttcaggtaaaaagagattatacattttattctccttatattatatagcatagaacagtgatccccaacctttttggcaccagggactagttttgtggaaaacaagttttccacggatggggtaggggctagatggttttgggatgaaaccgttccatctcatatcatcaggcattagattctcataaggagagcacaacctggatccctcgcatgtgcagctcacaatagggtttgcactcctctgagaatctaatgccactgctgatctgagaggaggcagagctcaggcggtaatgcttgctcactgctgctcacctcctgctgtgcggccccattccaaacaggatgtggacccatagcagtctgtggcccaggggtgggggagccctgtcatagaagatttgaggctgtttaaaaataattttcaaattacattctataaattgttcaaaatagaagtatagaatcaactctgaaacagagaagaaagtgaaatggcagccaccagggctgagttagttgtggcaattgaacatgaaatccgagtgaattcttggtcttcaagcaaaaagggtaaatggatagattataaaattatttatgtgcaaaagaaggaagactacagttctttccgtgacaaaagtttttacatgttatcaaatttagaagaatttcaacatttaggaactaggggaaaaaagacagttcacagtggtgtcatagcaaatcagttttgttacacagcagttcatttcttaatgtgtcatccttcagtgaagctaaaaacatgccactgaaatgtaattccaaaaggtatttctgaagtccataaattttgtcttatataatatattaaattttatacctatgcttagaacacactggaggttttagatatatttttttcattttattcccctctcacatcagtgtattgttttttagctggacagtctgttgtttctgggatacaaatatattctatttatgtttaattgattttctgctcatcatttggttctctgtctttgggacagagtacttaactattcatctattccttactaaataaagagtatctcctttttatagtccctctcactttagatacctgaaatttcttactttagtatgtcttctctaaacacagaaagtgtggtgctctcatttatatgcaggaaagactcttgtacttatttgtaaacagctccttggagagttagtgttacatgaatatgtagtttctcaaccttaacctttaatcagattttatgtgtcttttcctttgataaatatgtttgctatcagaagtagggttttcagaagataatagcttatttatctttgtatcccagattcagctcagtgcttggcacatagttggccttaaataaattttggtcaacctgttatgtggcagtccctttacaacttgccatgtactgacattttcttacagaagcatcccacaagtcagagcagagagctcttagaggtccctgtaaaaggctgcccataggagtgaaatttctttgaagtcatttttgacaggcttgtgtcaatgctgtaagagaacatataggggagcctggcagtgggatgaaacccttctcaccatgcaaccatgttttaagaagagtcactaaaatgttagtgtaagtctaaaaaacctaaaagatgcagactactgcatcttcctgtgtggcccacttggaccttgacaagaccctgatatccaatggactcttgactgccaggaagtcaggagacacccagaatcagcctggttcctcagagggccaccagcagtgccaagccctgggctcctctgcccaaagcctccagggcaccaataattttctgccccaatttcccatctattactcagttgggctggaggagagtcatgggagacatagccactggagctgtcagagggaaataatctatgttagaattctatggaaacaaaattacatcttgctttctctttgtttttaactcaggcttacagtttcctggctgaaagtttttcactgcctttttaaaaatttacttatttaataacagttttattgagatacaattcacgtaacatgtaattcacctatttaaagtatatagtttgatggtttttagtatattcagagtttctcaaccattatcactataaattttagaacattgtcatcaccccagaaagaaacattgtacccattaggttgcaaaaagaaactttgtattccctatattctccaaagccccccagctctaggcagcaaccagtctttctgtccctgtggatttgcctactcttggcatttcatatacaataaatgatctttttgtgactggctttttaaatttagcgttgtgttttcaagatgtattggtcaggattctccaaagggacagaactaataggtggaggagaggagagagggacagagggagggagggagggaaggagaggttggaggaattgacccacacaattatggaggctgagaagtcccatgagaggccatctgcaagctgcaaaagcaaggatgccactaatgtggcttagtccacatctgaaagcctcagaaccatacaagccagtggtgtaactctctgttggaggatgaaggcccaaaagcccagcgagccactgatggaagccctggaaccaaaagctggataacctggagttctgatgtccaaaggcaggagaagaagagtgtatgagagcaagaattcacccttcctctgcctttttgttccatctgggtggcccccagtcaattgggtggcacctgccgaccttgagaataggtcttccccactcagacagccaactcacgtgccagcttcctccagaaacatcctcacagatgtacccagaaataatgctttgccagctgtctaggtatccctttatccagtcaaattgacacctaaaatgaaccacacagggttgtgcctgttgtggcacgtacctttcctgcttctttacctgagacaattcacacatcccattcaggattctgtgagtatccttttttgttaaagtgatattagtatttttttgtttagatcataaaatatctatttttaatacactaaaataatacctcctttgttcataaaactaatttgttcataaacatgttttaaattatattataccattaacattaatatgttcctgcagttgtttacagaaattctgtatttgttgaatatgagactgttttcaagatgcactgcctattgtttatggggtactggcatcatcatagtgtcttgcttaccaaatatcttttttcatttccatgtatttgagatggattggcatttcatactgcctgtggggccagactattccaaagtagagtagaagtactttagacccaaagcttgaaaataaatcttaaaaaacaaatgatatgttcctatttttttcaaagttctttttgccatgtaaagaaaccaaatgatgtagaaacagttgttaacagttttatttgaagccgtttccctaatccagtgttatccattacaatgaatttgagaatttagaattttacatacaaagctgggatttttattatgaactaaattcacaacacctttattcacagtaggaaaggaaatagttttatgacactattagagcaaatgacttgtaattttagccttaattgattaattttataacttgttttggttgtttcctttaaccttttaatgtttctgtttgttgcagataaatgcagtgtcactttatctcctttaccttgtggaaatgatttcctcaggactccagattatctacaacactgatgaggtatgctttccccaaattttctattactaaatttcacctctgaaaatatctatttttttttttagttttcacaacttatttttagtttatgtaaaatgtattcctgttacatttatataatcagatagtagatgttggttgttgaatgaaaaagtctttatatcttcaatgcattgcacttttaaaatgaacacaatgtgtaacaggttgtaaaactttactcccgtgaagactctatttcaggtgatctaaaataaaacatgtaacttttaaaaaattttagtaacaatgaaagcaaaataacatttgcagattttctcaattattgtctttttttttttttttgagatggagtcttgctctgtcacggggctggagtgcagtggtatgatctcagctcactgcaacctctgcctcccaggttcaagcgattcccctgcctcagcctccaaagtatctgggattataggcatgtgccactacgcctggctaattttttgtattttagtagagacggggtttcaccatgttggccaaggcagtcttgatctcctgaccttgtgatccgcccacctcggcctcccaaagtgctgggattacaggagtgagccaccgtgcccggcctctttcttttgttttacatcgttgcatttcataactcaccctttgaaaagtaaagagaaacttttatcctgttatattatttttatttgtaggatctcagtaggattcttcatgtttttcaaaagacaaataccatgttcttattcttattaggaaaattgtaaagaattcatatcccaaagatgagaagcatttctttcacaggcattaatgcttgaacaaacacacaagcacatgcgctgatgtactttgaaatgtgccatagtgggagcaaaaaagcttttattgtttggtacatgcagtgagaactctgtgaaagggtagatgtactatatatgtttgttactattcctctcctgtgatccatgcaagggagaacaattacatcagacactcaacaccaaaattgtcattggaccgtactgagggtactacaaaataggtgcatgtagccctgccctctagtagtttatattctcatacacacttatagtgtatgagtttatagtctcatacaataaataaattctatttagaagtgaagataaataatgaagaagaaattatggtcgtaagaaattaataatacccagtatggtttcttctatttgatttgtcaaagaattctatggtttcatttcatccaaataattgttagtgtttataatattgtgaagtgggattattcaagcatttgggatcagggaggagctgggaaactcctgttttagtccaattttaaggagcatgctaaaatataaaacaaataagggaaaggagctgggaaactcctgttttagatcaatcttaaagagcatgccaatatataaaacaaataaaagaagcatgactctgactgaggagaggaggccttccagaaccagcccacttagcttctcaatttttccacccataatatctccaaagcactgggagaaatatcctagatccctgtggaacatcttatgataaccgtttacaattagtggcaactaatattgcttacaagtggctttgttttgttcagtaatttttttttttttttttgagacagtgtatcactctgtctgcccaggctggagtgcagtaacaccgtttcagctcattgcagcctcaacttcctgggctcaggtgattctcccacctcagcctcctcagtagctgggactgcagatgcacaccaccatgcccggctaatttcttttgtattttttgtagagatgggtttaccatgttgcccaggctgttctcgatctcctgggctcaagcaatcagcccacctcagtctcctaaagtactgggattacatctgggagccactgcacctggccttgtttagtaatttatttttaattgtaaaaattttactttttgctttctcaatatatgtcataattcattttgtatttttatttgtcaactgccatttttcatgaatattatatcactttagccattccatttggttttatatggcttatgtaagctttaaaatttttggatagttccttaccttcttaaactgctttttttaaaaaaatttcttatttgtggtttttcttggccttatggtttttatttactatatgtgaagtttttatgcagctaattatcaatagccttcaatatgtacacttaaaaatcctagagtaataaaacatgtcatttccgctcaccatctttttccttgagattctgtataatgtgttggatcatatggagaggcagtaaatggacctgcatagaatcagttaatgaaattctttttatctaaagatctcagaggattcaattctttgaaaagtggtatgacttggaagccttttcttttttaactgtatcttaggctctggtttggctagttcataaccctaccacatcttcagttcctagttatactcacattttaagacaatctaaggacccaggatgtcagtgggattaccgtttatttccttctctatttactataaaatttaaaatttgccctaatgcttctttttcttaggattgaagaattcagagtttggagatatacatatgtgcacacacacacacatacacatacatatgtaatgaaatataggtactgcattgtctggactttggggtttttgataagcctttgttttgcagctcatcatacctttactggttctgttgtttttataaaatttgtatctatactgtagttcctttgggagagggccatggtcttaagggtcatgtgcacctttacaaaggggcagtgaacctactgagtggccatgtttgtggtgatgaactttgctgcagaatgtattttctaagggcaggcacagtaatgtatgctaattttctaacatctttcgttgcctacacaggcgtaccatgtttccttggtatcagtatttcctagtgtctgtaatagtcttgctgtgtatattggtcatactcattttttattaaaaataaaaactttgaaaaagacaaagttctgtagttctgcccttgtactgctgtttgctttcttcatctagagagaaactcatcatatatgttaaacttagacctaaatataaatttacctaagtcaatccttttgatagagataacttatttacatctgttggaggggggcaaagtaatgaactgctacgtggcgttccatgtctcgtttcatgacattctccattaataaatatactctaaaagtagattcatagaaataagaaagaaatcatttagaagtgggtccagagaaacttacttcatttaaagtcaaagtaccccctcaaatttgtataacaatgaaattttgttttgtgtttgagatacttttttatgtctcttatggaagttgttaagagcacatttaggttgcaagccttataataaaaattgtgcacaaaactgtaggtgcttgttcaacataagacctgtgaaagtcccctttatgaactcaagtgtcatttacttttttttgcaaagatgttttctaccatatgacctagcagctcttttcaagtatgtcatgtttcagattggatgacacatggaatttctctcttattgtattagtcatctttgctatgtaacaaactacctcagaacttagtttaaaagattaaacatttattatttcacagcccatgggtcaggaaatatgggagcagctaagttgggtggtgctggcttggggtctctcatgaagctgcacttaagatgtcagctggctctgcactcatctgaagggtttactgagactggaagacccacttctgagatggctcagtcatatggctgttggcaggaagcctcagtttctccccagctgttattagcaagagacctttccaactgagctgctttgagtgtcctcatgacatagcagatggtttcctccagagcaagtgatccaagaaaacgagataaaaaaatacagtgctttttatgacctagcctcagaagtcacatttatatacagtatcctatttattacacaagtcatccctattcagtgtaggcaggatttacacaagggcttagatactaggagttacgtatgatcaggagccagcctgctatttttagcagtagtttttagttgaacttcgttagagagattttttaaggtgggattttttttccttgtacactaagacttttattttaaagataggtattttattctattattttctattactatttactaagttgttgtgtacatgtttttgtgtacatgttttgtgtacatgttttctctttaaaatattaaattttttttctggcttttatttgttgtatggaagctttgtgtcctagattctaccttttgctatgagatggttatcaggctgaacttgaggggtttctatctcaaaagttggaacaaatcttttctataagtaatcttagaggcattataaggtattcttagctcctgcttgtcatcagtttacacagagaaataagtaagttgttcaaaactatttatggatggtttttcctctaaaaatagaaagataacactgtccttgtttctaaaattatatgtagcaatagtaataatgactaacattatatagaacttatgtgctgtcactgttcaaagtgctttgcatatagaaaaacttatttaatccttacagcaactctgtcaggtaggtacagttactatcttcattttacaaatgaccaaaataatgcagagagccactaagtggcttatcaaggtcgcacatgtagtacgtggcagggcttggatttaaaccaagtagtctgactcaagagttcattttctatgctgacagtgagtgttagatctctgtttaacctgtacagatatgagtgacatatatgtcatgtggcaacatcatattcaagcttcaaaggcagccaaagagacctaaggcttacaggtttattcatgtatagttgtttctatttggtcatgcatccttgcatggattatacaactatctgataaacatttattgagtttccataatgggccaaacagtgagaatataaaaatgaaaaaagaatttagtctgtaacatcatgcagtccatattattgtggggaaaacagagaatgtgttgtgttttcattttcttgataatatcatttgaagctcaaagctttttattaattttgattaagtctcatttatctaattttttgttgttgcttgtgctttaggtgtcataggtcttttaaaatttcttctaatgtggttttgtagtttttaatacattattctttcattcttttaagttcttcctgcatattttattctgtatactaggttaaatggagctttttaattttattatcagaatgttcattgctatcatatagaaattcatttgatttttataaattgatcttgtgttctgcaatcttgaactcgtgtttaagctttaatcgtttttatgagttctttaggttttctatgtagaatattatgtcatttgcatatagtaatagtttacttcttcatatccaatatggatagcttttaaatctttttcttacctaatttccctggatagatgctccaatacaatcttgaaaataagggctgcgagtggacatccttgtcttgttcctgattttagggcaaaaccttttaatctttcaccattaaatgttacctgtgggctgggtgcggtggctcacccctgtaatcccagcacttagggaagccgaggcaggtggatcacatgaggtcaggagttcaagaccagcctgaccaatgtgatgaaaccctgtctctactgaaaaatacaaaaattagcttggcttggtggcgtacacctgtaatcccagctactggagaggctgaaacaggagaattgcttgaacccgggaggcggaggttgtggtaagctgagattgtgccattgccctccagcctgggaaacaagagcgaaactacgtctcaaaaaaaaaaaaggaaagaaaagaaaaatgttatctgtgggtttttttggagatgcccttcatcagattgagaaagtttccttctattcctcgtttcttgagtgctttcatcatggaaagttgttagatttttaatattttttctatatctgttgagatgattatgtgatctttgttttttatttaattaatatatactacttcattgattgattttcttattttgaacccatctaaaatatctgggataaatcttacttggtcatgatgtataatcctttttaaatgtcactgcattcatttgctgatactttgttgagtatttttacattaatagtcataatggatattggtatatatccattctgtgttttgttggtttatatatgtggatgagatacctttgtctggtgttggtaccagggccaataatggactcctaggatgggttaggaaatgtttcctcttctattttttgaaggattggtattaattctttaaatgtttgatagattttatcagtaaagcttgctgggtctgggattttctttatggaaatgtttttgattaccatttctcttcagattttctatttcttcttcagtcagttttagtagtttgtgtttctccaggaatttgtctatttaatctagattatctaatttgttggcacatattagttcatagtatcctatttaagtcctctttatttctctaagattgatgttaatgtcccttatttcatccttcctttaatagtttgagtcttatccctttttttcttggtcagcctagctaaaggtttattgatttttgttagccttttcaaaaaatcaatttttggttttatttttaaaattatttttctcttctccattttatttattttttttttagtctttattatttttttccttctggttggtttaggttcatttttctcttattttttctagtttcttgtgctaaaagattaaattattgacttgagatcattcttctttttaaaatacaggcattttcaattataaatttccctctacttatctgcatgccattagttttgatattctgtggtttttttattcattcatctcaatgtgttttttgatttctctcgtgagtttttctttgacccattgtttatttagtagtacagtttttaattttcacatatttgtgaatttttaaatttctttctgttactgatttataatttcattccatgatggtgggaaaacatccttggtatgatctctgtacattattgaacatggttattcacattattgccttttcaagtcaattttttttttttttttttttagtaatttctgtctctattgattttgtctatttggtgtgacatctttctcaggagttccttttgttctttgtacatgatttccttcagccctttgagcatatttagaatatttgatttaaagtctttgtctagtaagtccagtgtttggactttatcagggacagtgtctattaatttcatttttcagatatacagaccacaatttcttgtttctttgcatgtctcatctttctttgttaaaactggacatttagaataatatattaactccagaaatcaggtctccctacttcaaagtgtggtggtgttgatgtttatatttgtggagttgcctgtttgtttagcatctttcctgaaaattttctgtgaattatgtattctttgtcataggtggccattgaggtctttgctgagttagcttactggtcagttaatgattgaacaggaatttacttaaatgctttgaacgaatcagtctcctagcctttgcagagtttctcactgtatgtgttaggcataacttgaaagctctcataggaagtgcccaattctacttgagctttcacttcctgcttttgtagagcatccagttcagccagaggtgtgggagtattagctcaggtctttacttactataggcccacacctatgtgtgtgcatagctttctgactttccaggaatatgttggagattttcagtggcccccgtggacacttcatcccccaggtttaagaagatttgttttaggcagctgcagtgttaaatggttgcaactgattatttcctttatatgcctagaaaaaaggccatttgcatctatgtgagctctgaggtcatttaaagaaaagctcttaatgcctgtgttcaaggagctgtcagacattcaaatagtaacagtttactaagatggtgatttgggggagttctaaagctgttctgttcctccttcatgttgttgctagtctgctggtttttcatgtgtactatgattttgtggctgttgatatataaacctactacagagttggggagaagggttgagaatagggcaatttcacataccccaaagctcactctacttagtgaggtttcagccatttttcttgatttaatgctcggatcgttgtatgctcttgttgaatttccggagttctgaaaaagtttgatgagttttgtcaatattcttactgcttgtgtgaacaattggatttcctgaggcctttcctctgctgttccgtgatttggattccgtttgtttttcagtaattattgtttatgtaactttatatttgtaccttcccctactgccaaagaaaacctttttatcctgcagttcagtcattttataagatccattaaccctggagtcccagtgtgttttttaactgccttaaaaaaaatactttaatatgctgcatacattttgctacatttaaacatctatatacaacacttttaatggctgtctgacattctgtaacatgtgtcagaaatatacaaccaggctgggtggggtggctcacgcctgtaatcccagcactttgagaggctgaggctggtggatcacctgaggtcaggagttcgagaccagcctggccaacatagtgaaaccctgtatctactaaaaatacaaaaattacctgggagtggtggtgcgtgcctttttctttgcagtatctgtgtattttgaatcagttactattgaccacatattctcagccaccatgggaatgaagctactaatgataagattaggggctaacgttagtattcatttgtgtttgatctgctaataacattctttgaggatattttttccagttctgaaattccttcattcagtatccccgtgttgcctgactgggaagtcttaaaagggaacactttaatatttttctttttactatatcatgaaaattctacttgactcacttacgatttttaaaaatcttttaaaatttttttaaaaattcttttatgggaatttttaaatcaagttatattatttgttatccagtggtattgaaaagtggctattactttttagttggctttagtattctgagtcaggcaaagtttgtgaattttcagtagaatttttattataattacataaattatccattttttccctaaaatcttgaaatcctgggatgaaagttctttagtattgcatacggttcacttgtcacctgcaggagagggagaattccccaaggacaaactattttaatattttgagcaggaggcagatacagtttagttgagaaaagatttattctttgattttaatatgtctggagtttttacccacaaatgatcactattttaggaaaggggtggctttttcttcaataaggcagagcattaaaaagataactactttctatcagtgttaagagatgtataaataggaaaaaatatatgaaataaggtaaatctatttcaaaatggagagaattggggaaaagcactgtttgaagagatgatgactgtcaatctgaattgaacaaaacacatcttgtacaaaatacataaaaataactcttttctcccctgcctaagaaaactcctagggaacaagagatggaaggaacttgggtccctaaatgaccttatggtgttaatccattaatctgccccaccgtgtgttttatgagctttaaggattttttttgctagccgaaaacaacgcaatgatgaaaagcacaaatctttgttcatcttaagtgaaatgcccaactcttcattattcatctttagatgaagtgcactctgtttgtcatttatagctgtgaatgaaagcccccatgtagggctacacagggagttgtaccagaggacaggtgaacagcaagcttcaacagtagggaacagtttataaaagcataatgaggaagggagggttagctaggtttcttgggctccctatggattagctaatttgagtactttctgtggctcctgtatacgggttttctcactttgtaggatagctggccctggggcagttagggtagatacataatggtccagtgtgagagctaatccgggaagtggttggggtatagatctgctactcaagaagaactaaccagcctctaaccagggcctcaaaattgggttaaaaaaaatgactaggccatctgggtgcggtggctcatgcccgtaatcccagcactttgggaggccaaggcggatggatatctgaggtcaggagttcgagaccagcctggccaacatggtgaaaccctgtctctactaaaaatgcaaaaattatctgggcatggtggcgggcacctgtaatcccagctgctcgcgaggctgaggcagggagaattgcttgaatccgagaggcagagtttgcagtgagccgagatcgtgccattgcactccagcccgggcgacagagtgagattcttctaaaaaaaaaaaaaaattattcaccgttgctgataagctcaaccttcagttcctggaggttgagagttgggactgaaagtttcaatcctgtaatcatatagctggtttccttcccaaccaggccccatcgtcaagagttcaaggctgtagtgaacggtcagggcaccactgaactctagcccgagtgacagagcaagattccatctcttaaacaaaaaagcaaaaagaaaaaaaaatagcttttattttatggtttttcaagaaaaaatgaaaatggaaattgagaaataccatggaacaaaaatgaaaacacatcatatcaatacttgtagcatatagcggaagtgttattggtgagcagtttttagccttgaatgttgtattaggccgttcttgcattgctataaagaaatacctgagactgggtaatttgtaaagaaaaaaggtttaattggctcacaggtctgcaggctctataagcatagcactggcatcagctcagcttctggagaggcctcagggaacttttcctcaaggcagaagacaaaacaggagaaggcaagtcacatggccagagcaggagcaagagggagtggggagggaggtgccacagtcttaaaccaccagatctcatgagaactcacccactatctctaggaaagcactaaggggatggtgctaaaccatttataagaaatctgcctccgtgagttactcgcctctaaccaggtcccacctccaacactgggaattacaattcaacatgagattagaggggacacacatccaaactatatcacatgcagatagtagaaaagagttatgatggaaaattgataagttaaatattagattttaaatgttaggaaaagtatgccttagtaaacacaaagcaagtagaaggaagaaagtaataaagataaatataggaataatggtatcaaatataaaggtaggatagagactctcaaaaccaacagctttattttttaaaaaagattaacaatataaactgacctcttaaaaaatttaccaagcagataaggaagagttaaacagagaaacaatattcacaatgaaaaggagaacataactgtaaataagtagagattaaaagagaaaaaaggaatcttctataagaaagtgcacggcaataaattttaaaactttccaaatggaatgtgttctagaaacaccataatttactgttttgggttgaattatgtcccgtcaaaattcatacattggagctgtagcccctgctacctcagaatgtgactatttggagatataaacatagtgttttaaaggtagggtctttaaagaggtaaattaaaatgaggcccttgggtgaaacctaatccagtctgactggtgtcctcataagggaagtaaattttgatgtagaaaggaataccaggggtgtgtgtgcacaaaggaaaggccacatgaggacaaagcagcaggaggatggccttctgctagccaaagagcaaggtctcaggagaaaccagacctgccaacaccttggtcttagacttcccactgtcagaactgtggaaagagaaatttctgttacttaagccacacggactatggtattttatatggcagccttagcaaagaagtagttactgtaagtgacttagaaagaaatagaataatgaaatagacttataacagttcttaagctttttattgttgttgttatttttgttgcctccaaggaagggaaaactatttaatttaaattctccctaatgtgagaaattaaatactaaagagtaacattttgttgggtagaattgagctttgaagggtcagaccttattgtaatagctaagattttttttgccccttgctctcttgagaaccaatttcacctccctaggaatgcataatcagtagcctttgaagaaagtaaatcatttttcagaaatcttactttttctcttcatcttctccaaaaagagaatagctctctagctagttagttaataggcacattttatcaaagcttaaaggaagatataactcctgccttataaaataggaaaagctcctcaataaattttatgagattggtataattttataaaagttgatgatgttagtatgaataaatcaaattttaaaccaggctcaatttttttttttcgtgtattcttttggaaacatggagaatgagaatgtaaatgagtcatggataaggtatcatgtaaagtttcacttggctacaaataaaagaaaacccatcgaacagtggtttcaataaataaaggactttttctttttttttttttttttattttgacggagtctcactgtctcccaggctggagtgcagtggcatgatctcagttcactgcaacctctgccacccagattcaagcgattcttctgcctcagcctcccaagtaactgggattacaggcacctgccactgcaccgggtaatttttgtgtttttagtagagatggggtttcaccatcttggccagggtgatcttgaactcctgacctcatgatccacccacctcaacctcccaaagtgctgggattacaggcgtgaggaaccatgcctggccaggatttattttatacacaaaaaatgctggggattggaagtgttttcctaggctttaacagtcatcaaggatatggattccttttctatccctctgctgtatttggcatgagacatttatccaaataatcataatataggtggtattcctctaggtatcatgtctacacttgtatgtaagaatcaaaaaagaagaggctttaaagaagtttcttggccaggtgcagtggctcacatctctaatcccaagtctttgggaggctgaggtgggaggatcacttgaagccaaaaatttgagaccagccttggcaataaagcaagaactcatcgctacaaaaatctttaaaaaataattttttttttttttttttttggagacagagtcttgctctgttgccaggctagggtacaatggtgtgatattggctcactgcaatatccgccttctgggttcaagcaattcccctgcctcggcctcccaagtagctgggactacaggcacgcactaccacatctggctaactttttgtattttagtggagacagggtttcaccttgttggccaggatggtctcgatctcctgacctcgtgatccgcccaccttgcctcccaaagtgctgggattacaggcatgagccaccgcacccagcctaaaaaacatacatattttttaagtttctagaagcttggtcccatgacatctgtataatctcattggccagaacttggtcacacaaccattcctgctgctgtggagccttatgaagttaaaaatcagggttttattatcaagaaaggaagagagaccagatattggtggtcagttagcatcatgtgccaggaccaggtagtgtttaatcttagaaatgcaaggatgatttaaaatgggaacatccgttagtgtaactcattacattagcaaattaaggaagaaagaaaaaccatataaccatttcaataggtgcataaaacatatttggcaaagaattcatcacctattcatgaaaagcattctaataaaatggaattttcttaatctaataaaatatatctaccaaaaatctgcagcagatatcacattagaatcagaccctttagtttgagggacaagaaaaggagatactgattatataaactccttttttttttttttttttttccagacagagtcttgctctgtcacccaagctagatggcagtggcatgatctcggcttactgcaacctctgcctcctgagttcaagtaattttcatgtctcagccacctaagtagctgggatcacaggcgtgtgccaccatgcgcaactaatgtttgtatttttagtagagatgtggtttcgcccacccagtagagatgggttttgcccagactgtttttgaactcctggcctcaagtgatccgcctgcctcagcctcccaaagtgctgggattacaggggaaagccactgcgcctggccactaaactcctatttaacattgtacaggtgacctagccaaagcaataaggcaagaagtaataggtgtggatggcaatggcagaaatgaaaaagtttgcatttctagtgaattaaaatgaatttctagtaaattgaaatgaattcttagataaactactaaaagtcattaaaaatatagttgtaaagctggatacatgatcaacatatggagagcaataattttatctatagagcagcaataactagtcagaaaattggtctaatgtaaagtaaatattatactctaaagtacctgggaaagaacctaatagcagatggacaaaattataaaacttggatcataaaatgaagatctaaataaatattagcataaataatgtcaatacacaagaatgcttaataatgtaaagatactgattcttgctatattattaatctctaaactcaacaaaatttccgtagacgtctcaacagatttttaatggaatttgagaaactcatcctaaaatttatttagaagaataaactgtaaaatacacaaggtgattttggagaaggaaaaatatgaagggagacttcctttacctgatataaaccccatacatccatggaaattcaacaatgtgatattagtatggtgctagacatattgtcagtggaacagaattgagggcccagaaatgacttatatacaccccctcccgacacacacatacgtatatggagttagatttatgaaagtgtaggctttccagagccatagggtgacctcttcaataaatggattttcattatttttataaaagatattggaagccactttttatgtgataatcagttcccaggtgtgaattgtgaaaggcacaaaggttatacttttagagcaagggtgttcaaactttttgatctcaaggtcctttatattcttaaaattttgagaacccggtagagtttttgtttgaccttatatgcttacatttgttttgtgtgtgtttacatcccttgatagttactatattagaaagtaaaagatacattgagtgtatttattttattaattttaaaataatccattacaggctaacataaatactgtatttttaataaaaataacttttccaaaataaaaataattgagtgaaaataatagcattgctttacatttttggaaatctctaaattttggcttaatagaagacacttggattctctacccacttttgccatcaatgtattgcaatattacgtatataatgtagccactagaaaactcatgttacgtttgtgagacaatgagaggcaaaatagttttaacttcatggtctcttaattttcctatatcacaatctgagaactactattggagaggaaattttaggagagcatatgtttctgatttcagggaagggaggctttcttcagtaagacataaaagtataaaatgcatacacacataaaatcaatttgatccattaaagtaacaatctgctcatcaaaaaacaacaataaacaaggtgaaaagaaaagccaagacttgagagaagacatttgtaacacaggtatctgacacaagatatgtatctagaataaagaactattacttatcaatttaaaaaaccctcaatttaaaaaacaggaaattaggacccctaattagggaaattcaaatttaaaccccgatcatatgccacttcacatgcatcagacttgtgtaacaagagttagataaccctacttatcagtgaaggatacaaagcattgataattctctgccctcttgaggtgggcataagttcttgtaactaatttggagagcaatttgacaatatctagtaaaattgaaggtgcacttggtgtacaattcaccagttcagcgtttagatgataccctagtgttatggtgttatgggatccttggggtgttgcttttctggccagaaacctctgtggccagtggcacctttgcccaagttttgctccagtccactgggctcattccacttggctcatgctaccaggctggatcccatgcctgccaaggatgagccagatgtggagtggtgaggggtgtatgagcaagtgtagggtctggacactgcacagtcaaatatgctagctgctgcaacggagtgggcagctctaggtgttggcatgggtgccagctctctgtgaggctgcagctggaccaggtgcactgtaagcagcttccacagctggcactggggaatgcagtggcacccagaagcttggagatgtcaggaaccacaggaccccaaagagggagtcagccctggctcagggagctcccacgtctgggctccccaaagggccacaatgtggcaggcaaggggcacgtttcagccctatttgtgttacagctcttttagccccaccattttatgggtcccatgttcttgtcctgtgattgggaagagtgaggtatgcagtcaagtggagggtgagcaaaatgaagaagagctttattgagcagtggaacaacttagaggagacctgcagtgggtagcttctttctgcagccaggttatcctgataagtgttcaactcctagcagggaggagaccatggagtgggaagctcccctctgcaagcaggtcatcccatcatctctgcagctctcagcagagaggagtttctggagtgggttgctcctctctgcacctggttgtcctgacatctgcagtttttagcagagaggaagccttggagtaggtagctcctctctgcagctagtcatcccgatgcctgctcagctctggctgagcctggggcttttatgggcctcaggggtgaggaagtgcatgcccattggtccataggcaggctcaaaaaaggcaccacacgttctcaccccagtccacaggactggcagtccagccgccagccttcaggccctccctggcctgaaagtggggcctcaccaggaacctgcccccttctgcccaggaacctgtctgcctcctgcctgttcatggcacctaggctgtaggtgccaagagggcctgcaggccagtgccaggccgccctcaaccctgccttggcttcccttaggtgttcatcaatgcccagagtctggagggggccgaggctgcagggggctggcatgtttgcaccgccctgagcatgtgcacacttggctgggctgttatagcatctgggctcaaccctgactttgctccaagatcatagtgggtactgacagcagggagaagccaagcatcagtagcaggtacttccaagcctgcgagggcagggagggggtttcttgggcccccaagagtatagagatgcctgggtctgcagccacagtttgggcagccacagctgtgccagaggttcagggctcctgcctgctcttggcacccccaagagcacagagagacctgggtccacagccacaacttgggcagctgcagctgcaccagggagggcggggctcctgcctgctctgtggagcaggaggcctgggcccacagccacaacttgggcggctgcagctgcacccaggatggtggggctcccccctcctcccaggccccaagagtacagagataccctggtcttcagctgtggcttgggcggctgcagtggcatctggggagctcccacccaagctcggaaggggtgggactccctcctgttcctggctcccgccaaccccacagagcatgcagcccgggtgtacctacctgctgcagctggcgtgataacagcagccactccagatggcccaccgctgccatcactagcttagagctttcttactagggtaccacagacaggttacagatttgccatggtaatgagtcttcatcctaaaggtgttggtggggcctggacttagccatacctcactggccgataacctctggctgccaggagtcttgtccagttacttcaatgtatgtatagaaataatatttctatatgtaccatgatgtcaaaatgattgggaagctctttcctagagacatactaaaatttcattgcagcactgttgcattaaaaaactgttatggtaggattttaattcataaatgtagaaataaagagggaaatagaaaataacctttaggcaagaactggtgataattagtgtaaacaagatccactgataaatgctgaaattagtacataaaattatgaggagaaacaggatttatacatagttccaaagcatttccctcaagatatttattaactaccaagggaaaggtgataacattacaaagtaggagctactataactaagtgatcatggttgttaccaccagcaagaagatacattgacatcatgaatcctgtgctatggtgctttaagaaagtcacaacattatttctatgatattcttgccaaaaatgcattacttttgtccattcatgggaaagtattagacaaatcaaaattgagggacatgtggcagaataacataaaatttattgaggtcataagaaatgaggaatgagtgaggaagaaataagctaaggagaaatgacagtgaaatacaaggaggactaaaattacttcactttgggtatcagggagagagtttttgaagtaaatcaaggttacgcaaagctttgttgttcctgagcagttactcactgcaggtagggctcggttacactaaagagtgtgtgaaatcataaaaaccttaagcatttagctgtacaagacacaggggagaagaccttttaatcagcacttaccttcattaagacaaattaactgacaaatatctttttgaaacttggggaagagaaatcctgaaatgtttctagtggtaaaggaacagtaaatggaaatcatttgtatagtacccagtattactaatttaacatgtataacaaaaacttcctttaaacttagcatttgtgcttggtctgaattgttttactttagtgaacattcagtggtcatttataaactcagtatctccttatctaatttctccataataaatttcttgttaacaaattatattaccatagatgtttttaggagcctatccctcagaattgaggagttactatacagtttggttatactgatttattatactgattgtttttagtaacatatggagagagagttaaataattgtttgcttttggagttgcagtgaactaaaactgtattttatacaatataagtcccgctctatctctaacttgtttcttagcacacacaccttaaattttataaagtccattaagattttgatttttagtgcaatacttactctaattcaatctcaaacgttattgttgtatttcatttaactctgttttgaaagtatttcagatatttgcattattgtcttaatgatactcttaaaacatactgaaaacaccacagatgacatttggatctgactgttctagctctttccaattagaaatatttctctacatactttttgcagaagtggatatcaaaggtacatgctttcaaagcaaggtaacagaaattagaaattggtatgaagatgcaacaatgggctaacaacattgagtacataaactagagtcaggattgaaaataatacacagaataccctgaccatggaaatggttatgatatttatttatttatttggagatggagtttcactcttgttgcccaggctggagtgcagtggcgcgatctcggctcatagcaacctccggctcccgtgttcaagcgattctcctgtctcagcctcccaagtagctgggattacagtcatgtgccatcacacccagctaattttgtatttttagtagagacagagtttctccatgttggtcaggctggtctcgaacttctgacctcaggtgatccgcccacctcagcctcccaaagtgctgggattacaggcgtgagccaccgcacccggccgatctttatttttatattctagctagcaatgttatacttcctcaagaggccagttcttactaaatcatagtattatttgtgtgagaactacaagaagtttacatttctgagctcagagaagttatacaggaccacagtttcttatgtgaaaaaacatttagaaccaaatatgttttcgatttcaaaacttgctggatttaaataaaagtaatactgttttgataccttttattatatagtaaccccagcatggcttagggcagaatctgcacattaatatttttgcagtaagatgtatacatattcacacaaagtgaggaacataaggcagctaatctcatctcagttctgggttttgctgacaaatgagttaagaaaaaacaattggatttcagaacttgtggcattttagaattgcaaataagagatggtagacctgtgtactagttagaggtgagaaaaaaaacacacttggaacaaaaattaagagccgtggtcttggctctaagtatagtgagagttaggagaaattagagacttcactaagaaaagttttgaacgggggctgaaggaagattcatagaaaagtgttttcatttggaaatgagcaagactaatggccatccagcccaattagaacccaggttcctgtcggaggattgtggaataaatagagttctgtggggacagggtgggaagattatatagaggatttgaatgtcaaatatgagaattgtaatactctgtcagaattcacgaaacttttttgattaaagaagcaatgtgaaaaatagcagccttcctgtggaatgaatatggggttaaaaggaaacatagtagtgtcaaaagacaaaattgcaacaattcaaaagatctaattgacttattagtgactcatgaatcagtggcgtttcttccaaagatctagcaaaggctctccaatgaattatgcttaagaggttggcttcataggcagaaaagggctgaagaaagcagaaacagggaacaaaaagctgattggttgtttcaaagttactttccttataggattaaagtagaaaggacttctttatcatgccagctcagggaaactgggccccttctgattggctgctgtgaatctcctgcttttgtttgttcgtttttcttcagaaaactggcccttttcaatgttcagtttgactgtgtgtcacctagcataagtgactccattctggtttggtctggtttcttgggcctactgcaggagctcagtccaaatcaatgtcctcatataaattttattgaacagtagtcaaagttgatctcaagatttctagactgagagcctggaaaagagtggtctgatggggaaaaaagcagaattgaaaagtgcttcttggtggaagggtttagaacatactgtttaatgggaaattcaagtggaaatatttcaaagcaaaggtacaggttatatgtattcaggattagaatggaaaaatcactgaattgtaagcaggtattgtaaacatacgtggaaaattctctctctctctctctctctctctctctctttttaagttgaggcaaggtctctctctgtcatccaggctggagtgcagtggcgtgatcacagctcactgtcctcagcctcccaggctcaagcaatcttcccacctcagcctcccgagcagctgggaccacaagcatatgttaccatgcccagctaattttttaattttttttgtacagacagtgtcttgctatgttgcctaggctggtcttgaacttctgggctcaagttaactggctgcctcagcctcccgaagtgctaggattgtaggcatgagacactgcacctagccacaaagctttaaacttagagacctgaaaaactatcaagtattttctgttgtgttataaaatctaaataactttgaagaccatgaaatagctaacatcatgaaagtgagcaggttgtttacacaggaaggtttcccttaaggtatataggcaaggtagcccgagttgggtaagctgaggggaccctgatcaatattcaaaatttaaaaaagtttactgtgggatgtactgttctacccttgggtgaagagattctggaataggtgcatgttttggagaaatctagaaataactcacactctcttctatttctgtgaggccttaacaccctggttgctctttccttcactgaaatgagggaggtatgcttgcccctgagggcaaatgtctctgttggggaggagaatgtaaacatcatggattcaggtgccccagccattcgtccttcatgagataacctgggtagacttatccctgatcaactctttatctctgtgtttgttgactctgagcatagagatttcctggaggccctagaaaacaaggaagcaccattttgagaggctgtggtttcctctgctttgatttctccaccagttccctcccatgtgctttctcccttcctgtagtttctgaaagtttctggtctactgatggaatctcaccttggctttctgtgttattgtttccttcttaaaagtatatacattatattaattatgtgtgtgtaggatgaaggtgagacatgtgtattaccatttcagaagggttttgtgttgaagggtaggcagatgcatgtattcagtttgccatattgaacctaacacgatgactaaatttcaaaccctgtaatcagaacctgtagcccacataagaaattgtccttattaaaataaaggaacgttattaactaagaattcaccataatcttggttttccatagtttcttttgagagtataaattttgtcacatgtctgaaatctttacatggaagctctgactcctggccctttggttggagcccacttccacctgtgagctttgagtttataacaatgtacctgtagctatacaaaaggcaggaggaagattggatttcaggataatgaataaactcagaacttaaggttgacccaacatggaactggcactttacagaacagataagtactttttttttaatatctaaagttttagacttatttaacatttcatagggacatttcagattacacatattatatctagtataaaaacaatgttttatacttgtcttagtgcttaagatgtatagtccttataaacaataatagatacattgttgaagaatgtatctattggatacattccattggagcattgagaagatttaaattttatttctatactgtatattagactctaagcttaagtgagcttaatattagaaaaaatatataatagtattcatagcaatataataattgttgcaggaagtcagggaccccgaacggagggactggctggagccacggcagaggaacataaattgtgaagatttcatgggcatttatcacttcccaaataatacttccataatttcttacatcagtctttattttaatctcttaatcctgttgtctttgtaagctgaggacgtatgtcacgtcaggaccactgtgatgattgtgttagctgtacaaattgattgtaaaatgtgtgtttgaacaatgtgaaatcagtgcaccttgaaaaagaacagaataacagcgatttttagggaacaagggaagacacccataaggtctgactgtctgcagggtcgggcaaaaaaagccatattttacttcttgcagagagcctataaacggacgtgcaagtaggagagatatcactaaattcttttcctagcaaataatattaatattaagaccctaggaaaagaattgcattccttggggaaggtctataaacggccactgtgggagtgtctgtcttatgtggttgagataaggactgaaatatgccctggtctcctgcagtaccctcaggtttattagggtgtggaaaaacctccctcccccctccccggtaaatttgaggtcagaccagttctctgctctcgaactctgttttctgttgtttaaaatgtttatcaagacaatacgtgcacagctgaacatagacccttatcagtagttctgttttgccttttgtcctgtttcctcagaagcatgtgatctttgttctcctttttgccctttgaagcatgtgatcttgtgacctactccctgttcttgcaccacctccccttttgaaatcctaaataaaacttgctggttttgcagctcaagtgggcatcatggtcctaccgatatgtgatgtcacccctggcggcccagctgtaaaattcctctctttgtactctttctctttatttctcagactggccaacacttagggaaaataaaagaacctacattgaaatattggggacgggttcccccaataaaatactggggacaggttcccccgagaaataatcacacgtatttcagtatattaaaaatgtgttgggagacaagtatgtatttggatttcaaatgttatctaattattctctttagtatctaatctaaatgtcctgtttttttttttttttttttttttggagatagagtttcactcctgttgcccaggctggagtggcaatggggcgatcttggctcaccacaacctctgcctcctgtgttcaagcgattctcctgcctcagcctcccaagtagctgggattacaggcatacatcaccacgcctggctaatttttatttttttttattatactttaagttctagggtacatgtgcacaacatgcaagtttgtcacatgtgtatacatgtaccgtgttggtttgctatacccattaactcgtcatttacattaggtatttctcctaatgctaccccttccccatcacaccaccacatgacaggccccggtgtgtgatgttccccaccctgtgtccaagtgttctcattgttcaattcgcacctatgagtgagaacatgtggtgtttggttttctgtccttgcaatagtttgctgagaatgatggtttccagcttcatccatgtccccgcaaaggacatgagctcatccttttttatggctgcatagtattccatggtgtatatgtgccacattttcttaatccagtctatcattgatggacatttgggttggttccaagtctttgctattgtgaatagtgctgcaataaacatgtatctgcatgtgtctttatagtagcatgatttataatcctttgggaatatacccagtaatgggatggctgggtcaaatggtatttctagttctagatccttgaggaatcaccacactgtcttccacaatggttgaactagtttatactcccatcaacagtgtaaaagtgttcctatttctgcacatcttctcctgcatctattgtttcctgactttttaatgattgccattctaactggtgtgaggtgatatctcattgtggttttgatttgcatttctctgacgaccagtgatgatgagcattttttttcatgtgtctgttggctgcataaatgtcttcttttgaaaagtgtctgttcatatcctttgcccactttttgatggggttgtttaatttttttcttgtaaatttaagttctttgtagattctggatattagccctttgtcagatgggtagattgcaaaatttttctcccattctgtaggttgcctgcttactctgatggtagtttcttttgctgtgcagaagctctttagtttaattagataccatttgtctattttggcttttgttaccattgcttttggtgttttagtcattaagtccttgcccatgcctatgtcctgaatggtattgcctaggttttcctctagggtttttatggttttgggtcttatatttaagtctttaattcatcttgaattaattttcctataaggtataaggtataaggaagggatctagtttcagctttctgcgtatggctagccagttttcctagtaccattaaatagggaatcctttccccatttcttctttttgtaaggtttgtcaaagatcagatggttgtagatgtgtggtattatttctgaggcctctgttctgttccagtggtgtctatctctgttttggtaccagtaccatgctgttttggttattgtagccttgtagtatagtttgaagtcaggtagcgtgatgcctccagcttcattttttttgcttaggattctcttggcaatgcgggatcttttttggttccatatgaactttaaagtacttttttccaattctgtgaagaaagtccttggcagcttgttagggatggcattgaatctatgaattaccttgggcagtatggccgttttcacaatattgattcttcctatccatgagcatggaatgttcctccatttatttgtgtcctcttttatttcatttagcagtggtttgtagttttccttaaagaggtccttcagatcccttgtaagttggattcctgggtattttattctctttgtagaaattgtgaatgggagtttgctcatgatttggctctctgtttgtctgttattggtgtataagaatgcttgtgatttttgcacattgattttgtatcctgagactttgctgaagttgcttatcagcttaaggagattttgggctgagacagtggggttttctaaatatacaatcatgtcatctgcaaacagagagaatttgacttcctcttttcctaattgtatatcctttatttccttctcttgcctatttgccctggcccgaacttccaacattatgttgaataggagtggtgagagagggcatccctgtcttgtgccagttttcaaagggaatgcttccagtttttgcccattcagtgtgatattggctgtgggtttgtcataaatagctcttattattttgagatacattccatcaatacctagtttattgagagtttttagcatgaagggctgttggaatattgtcaaaggccttttctgcatctattgagataatggtgtggtttttgtctttggttctgtttatgtgatggatacgtttaatgattcacatgtattgaaccagccttgcatcccagggatgatgccaacttgatcgtgttggataagctttttgatgtgctgctggattcaatttggcagtattttattgaggatttttgcatcgatgttcttcagggatattggtctaaaattctcttttttttcttgtgtctgccaggctttagtatcaggatgatgctggcctcataaaatgagttagagaggattccctctttctctattgattggaatagtttcagaaggcatggtaccagctgctccttgtacctctggtacaattcggctgtgaatccatctggtcctggactttttttggttggtaggctattaattattgcctcaatttcagagcctattattgatctattcagctattcagcttcttcctggtttagtcatgggaggctgtaggtctccaggaatttatcaatttcttctagattttctactttatttgaatagaggtgtttgtagtattctctgatggtagtttgtatttctgtgggatcagtggtgatatcccctttatcatttttattacatctattcttacatctattttttacatctatgtaattattacatccatgtaatacatttattacatctatttttattacaatctattctatacattgattcttctctcttttcttctttattagtcttgctagtcgtctatcaattttgttgatcttttcaaaaaaccagctcctggattcattgattttttgaaggattttttgtttctctatctccttcatttctgctctgatcttagttatttattgccttctcctagcttttgaatgtgtttgctcttgcttttctagttcttttaattgtgatgttagggtgtcgattttggatctttcccagtttctccgataggcatttagtgctataaatttccctctacatactgctttaagtgtgtcccagagattctgttacgttgtgtctttgttttcgttggtttcaaagaacatctttatttctgccttcatttcgttatgtacccagtagtcattcaggagcaggttcttcagtttccatgtagttgtgcggttttgagtgagtttgttgatcctgagtcataagttgatcacactgtggtctcagagacagtttgttgtgattgttgttcttttacatttgctgaggagtgctttacttccacgtatgtggtcaattttgtaataagtgcgatgtgttgctgagaagaatatatattctgttgatttggggtgtagagttctgtagatgtctattacatgcaattgttccagagctgagttcacatcctggatatccttgttacccttctgtcttgttgatctgtctaatattgaccgtggggtgttaaagtctcccattattattgtgtgggagtctaagtctctttgtaagtctctaaggacttgctttatgaatctaggtgctcctgtattgggtgcacatatcatatatttaggatagttaggtgttcttgttgaactgatccctttaccattatgtaatggccttctttgtctcttttgatctttgttggtttaaagtctgttttatcagagactaggattgcaacccctgcttttttttgttttccatttgcttggtagatcttcctccatccttttattttgagcctatgtgcgtctctgcatgtgagatgggtctcctgagtacagcatactgatgagtcttgactctttatccagtttgccagtctgtgtattttaattggggcatttagcccatttacatttaaggttaatattgttatgtgtgaatttgatcctgtcattatgatgcttgctggttattttgcctgttaattgatgcagtttcttcctagcatcgatggtctttccatctggcatgtttttggagtggcttgtactggttgttcctttccatgtttagtgcttccttcaggagctcttgtaaggcaggcctggtggtgataaaatctctcagcatttgcttgtcagtaaaggattttatttctccttcacttatgaagcttagtttggctggatatgtaattctgggttgaaaattcttttctttacgaatggcgaatattggcccccactctcttctggcttgtatggtttctgccgtgaggtctgctgttagtctgatgggcttccctttgtgggtaacccgacctttctctctggctgctgttaatattttttccttcatttcaaccttggtgaatttgacaattatgtgtcttgaggttgctcttttcgaggagtatctttgtggtgttctctgtatttcctgaatttgaatgttggcctcccttgctaggttggggaagttctcctggataatatcttgaagcgtgttttccacttggttccattctctatccctttcaggtacacgaatcaaacgtagatttggtcttttcacatagtcccatatttcttggaggccttgttcgtttctttttactcttttttctctaaatatctcttctcacttcatttcattcatttgatcttcaatcactgataccctttcttccacttgatcgaattggctactgaagcttgtgcatgtgtcacgtagttcttgtgccatggttttcagctccatcagatcagttgaggtcttctctacactgtttattctagttagccattcatataatcttttttcaaagtttttagcttccttgcaatgggttctaacatcctccgttagctcggataattttgttattaccaactttctgaagcctacttctttgaactcgtcaaagtcattctccatccagcttttttccgttgctggtgaggagctacggttctttggagaagggtcactcctgtttttagaactttcagcttttctgctctggtttctccccgtctttgtggctttacctacctttggtctttatgatggtgacctacagatggggttttggtgtggatgtccttttcgttgatgtcgatgctattcctttctgtttgttagttttccttctaacaggcccctcagctgcagctctgttggggtttgctggaggtccactccagaccctgtttccctgggtatcaccagtggaggctgcagaacagcaaatattgcagaacaacaaatactgctgcctgaaccttcctctggaagctttgactcagaggggcacccagctgtatgaggtgttagtcagcccctactcggacgtgtctccaagttaggctacatgggggtcagggacccacttgaggaggcagtttgtctgttcttagagggcaaacactgtgctgggagaaccactgccctcttcagagctgttggactgggacgtttaactctgcagaagtttcagctgcctttttttcacctatgccatgcccccacaagtggagtctacagaagcaggggtcctccttgagctgtggtgggctccacctatagcttcctggctgctttgtttacctactcaagcctccacaatggtggacccccctcccccagccaggcttgctgccgtgcagttcgatctcggactgccgttctaacagtgagcaaggctccatggccatgggacccgctgagcaaggtgcaggatataatctcctggtgtgccgtttgccaagaccagtggaaaagcacagtatttaggtgacagtgtcccaatttttctggtacagtctgtcaaggcttcccttggctaggaaagggaaattccctgaccccttgcacttcctgggtgaagcgatgccccaccctgcttcagctcgccttccgtgggctgcatccactgtccgactattcccaatgaggtgaaccggttatctcagttggaaatgcagaaatcacccgtcttctgtgttgatcatgctgggagctgaagaccggagctgttcgtattcggctgtcttggaatggacccctaatttttgtattttttagtagagatgagtttctgcatgttggtcatgctggtctcaaactcccaacctcatgtaatccctcccctcagcctcccaaattgctgggattacaggcatgagccaccacacccggcctatgtcctgttattgagtatgtccttatgtttcatttctttttcttttaggtctcttttattcaaaaccttgtattttgtgtggaaagagtttaccgtgtgcctgactttggtgtctgggaaagaggaagcaaatataataatggcagcacagagctacattcgaggtaatttgctgatttctgaggttttttttttaaattaaatgtatggaatttgaatatgaagaaatactgaagcattagattggaactgtgattcatatgttaatttgtagcaatttttttctacctatgatgcagatggaagtcacttaaaattaacacaaaagagcccatcctcagtacccataaacagatgcaagaaagaagtaggtgtctttcccaacctcccaaggtgtcagtacatgcatgtcagccctcatcattaatccacagcttggcctttctgctcaaccaagtcattttctttttcctctttgaaattacctcatttgaaatgtcaagtacattaaaattttcaaacaccagttgtatatgcactgaatataaaatttccttccatgttatagagctgatttttatcctgaccacggatgcttacactgttcacataaaacttaacattcattgttaccagtaaggtgtgtgatcaacatcttgagctgtggtttactgcgtttgaataagcaacaatagctgataactgatgttagtagtttatgaatttcttttaatccttagggttaaggaagtagctttagtgactgattgtacctttcctaaatcctagttttatgcctaggagatcatattttaataacaaaataatatagttcaataagtcctatccatgttgcactaaaagatgtaagaatttaagctaaaagttatcactgtcagtttggattattgggacttaaattaagtaaagaaacagtctagaggctgggcacggtggctcacgcctgtaatccgggcactttgggaggccgaggtgggcagatcatgaggccaggagtttaagaccagcgtggccaacatggtgaaaccctgtctttaccaaaaatacaaaaagtagctgggcatggtggtgcgtgcctgtaatcccagcaactggggaggctgaggcaggagaatggcttgaatccaggaggtggaggttgcagtgaaccaagattgtgccactgcactccagcctgggtgacagagcaagactccgtctcaaaaaaaaaaaaaaaagaaacactgtagaaaacactggttgagaggaacccaaagtgttctctattttatgatagactaatcacacacacaaaaataagatgacataagatatttagtaaatcaaaaaccagctccagatcactagctgtgtaaccctcaacaagttatgtgacctttttatgattcagttttctcatctgtaaaataaagataataatttctactttatgtcattgttataataattgttgtcattgttgtaatagtatatataaagcatttgaatgtgtagcataagaactagaatgctagtgtacttacacatttaggaacattttaataaaaaataaaaaatatttaaattaaaaggactttcagattaatccttaactgacgtggaaacctttttctttaggttttgtgattcatgtgaggaatttttacagtatagaccagaatagtatcaatcaatgaaaaagtcagtgaagtagaggaataatttgtggtaaagctcatttcagacattaaacagattctggcaaatactaaaattaaatagatgatgttataattcagccctcatccaaattaagttctcaacattccagattatcactcaaattataagaaatttgatctgataagatgatttttaaaatttaccttttcagtacatatgattatcagatatcttccttgtttcttaataagcatttaatatatgtcagtctgaccccattgccatattttcagcgtgaaatatttggaatagaagtttttctgtttataaaaactgcagtaggccagatgcagtggctcacacctgtaatccaacactttgggaggccgaggcgggcagatcacctgacaccgggggtttgagattggtctgaccaacatggtgacaacctgtctctacttaaaaaaaaatacaaaaattagcctggcatggtggcatgcgcctgtaatcccagctacttgggaggctggggcaggagactctcttgaacctgggaggtggaggttgcagtgagccgagatcgtgccactgcactccagcctgggtgacagaatgagactccatcacaaaaagaaagaaaaaaaaatgctaacctgtagtaaactcagaaagaaccttaaataaaagttactactgaccctagaaagtgaggatgtcagaaggtccctggtgacaaaacaggctccaacttgtattcctataactgaggtggcagtctttaaattgattcattaaggtttttatttgaaggcttgaaaaatcattatgtgatttttttttgccatcgtttgcatgcaaaattaatctttttgtagtaggccgattttgttcaaatggatgagagatgaagtttgtcgtttaagtttggatgatgggttttatactttatttgacattgatgttctacttgtccatggtataacactttaaaattccccaaaagaactttaaccttaattttttatttgaaagtttccaaggtcaggtcttcacaagcctgttttgaatctatcacctctgatgtccaaaggatacattttgaaactgcgagagagttgaactccatgtgctcacggaggtagtgatggctgtggtagtgggcggccagtatccttctgtgcttaggcctgtgtagtggaatgtagagctgctactagcctgggatcaagtcacacctcttagtctgtctctgctgtaggataccccagatctatttgggattaattggatctattctttactgtttagtgcagtatccttgttatatcctgaaactgttctcataatttcagacagcttgaattaatacatagtaatacttgccataagtacttacacttccctttgtagtctgacactttctctgccgctctcctttctctgtgctatacagtcatctgtaccaggagtcagagagaaaacagagcataatctgagtgttgccttggtgctcactagggcctcagctgaagtgactggctcttcctttccttgccacactgagtacatcccttctaagctgtgaatccattttgtcctgggcttttgttggttggtaggcttttattggttattggctgttacgaggatgatcctggcctcataaagtgagttagggaggagtccctcttttctgttgtttggaatactttcagaaggagtggtaccagctccactttgtacctctggtagaattcaggtgtgagtccgtctggtcctggggtttttttggttggtaggctattaattactgcctcaatttcagaacttgttatcagtctattcagggattcgacttcttcctggtttagtcttgggagggtgtatgtgtccagcaatttatccatttcttctagattttctagtttatttgcgtagaggtgtttatagtattctctgatggtaatttctatttctgtgggatcagtgatgatatctcctttatcattttttattgtgtctatttgattcttctctcttttcttctttattagtcttggtagtggtctatttcgttaatcttttcaaaaaaccagctcttggattccttgatttttttgaagggttttttgtgtctctatctccttcagttctgctctgatcttagttatttcttgtcttctgctagcttttgaatttgtttgctcttgcttctctagttcttttaattgtgaagttagggcgtcgattttagatctttcccactttctcctgtgggcatttggtgctataaattttcctctaaacacggctttagctgtgtcccagagattctggtacattgtgtctttgttctcattggtttcaaagaacttatttatttctgccttcattttgtaatttacccagtagtcattcaggagcaagttcttcagtttccatgtagttttgtggttttgagtgagtttcttaatcctgagttctaatttgattgcactgtggtttgagagacagtttgttatgattgccattcttttgcatttgctgaggagtattttacttccaattatgtggtcaattttagaataagtgcgatgtggtgctgagaagaatgtatattctgttgatttggtggggagagttttgtagatgtctgttaggtccacttggtccagagctaagttcaagtcctgaatatccttgttaattttctgtctcgttatttgtctaatattgacagtcgggtgttaaagtcttccactattattgtgtgggagtgtaagtctctttgtaggtctctaagggcttgctttatgaatctgggtgctcctgtattgggtgcacatatatataggatagttagctcttcttgttgcattgatcactttaccattatgtaatggccttctttgtctttcttgatctttgttgatttaaagtctgttttatcagagactaggattgccaccctgctttcttttttttctttccatttgcttggtaaatactcctccatccgtttattttgagcctatgtgtctttgcacatgagatggatctcctgaatacagcacactgatgggtctttactctttatccagttttccagtctctgttttttaactggggcatttagcccatttacatttaaggttaatattggtatttcagaattggatcctgtcattatgatgttagctggttgttttgcccgttacttcatgcagtttcttcatagtgtcgatggtctttaccatttggcatgtttttgcagtggctggtattggtttttcctttccatatgtagtgcttccttcaggagctcttgtaaggcaggcctggtggtgacaaaatctctcagaatttgctcgtctgtaaaggattttatttctcctttgcttatgaagcttagtttggctggatatgaaattctgggtttaaaattcttttctttaagaatgttgaggccgtggtggctcacacctgtaatcccagcactttgggaagtcaagtcaggtggatcacaaggtcaggagttcgagaccagcctggccaagatggtgataccttgtctctactaaaaatacaaaaattagccgagtgtggtggcgggtgcctgtaatcccagcaattcgggaggctgaggcagagaattgcttgaacccattgaaatcaagaggcagagtttgtggtgagccaagattgtgtcactgtgacaaagaccccatctcaaacacacacacacacacacacacacacacacaccaaaaaacaaagaatgttgaatattgatccccactctctcctggcatgtagggtttctgcagagagatctgctgttagtctgatgggcttccctttgtgggtaacccaacctttctctctggctgcccttaacattttttccttcatttcaaccttggtgagtctgacaattatgtgtcttggggttgttcttctcaaggagtatctttgtggtgttctctgtatttcctgaatttgaatttgttcagtcttgctaggttggggaagttctcctggataatatctcgaagagtgttttccagcctggttccattctccccattactttcaggtacaccaaccaaacataggtttggtctttccacatagtcccatattttttggaagctttgttcattccttttcattattttttctctaatcttgtcttctcgctttatttcattaagttgatcttcaatctctgatatcctttcttccgcttgatcgattcggctcttgataacgtgtgtatgtgtcatgaagttctcgtactgtgtttttcagtttcgtcaggtcatttatgttcttctctaagctggttattctagttagcaattcatctaacctgttttcaaagttgttagcttccttgcatttggttagaacatagtcctttagctcagaggagcttgttattacccaccttctgaagcctacttctgtcagttcatcaaacattctccatccagttttgttcccttgctggcaaggacttgtgatcctttggaggagaagaggctaatggtttttggaagtttcagcgtttttgcactggtttctccccctgttcgtcgatttatctacctttagtcttttatgttggtgaccttcagatggggtctctgagtggacatcctttttgttaagatattgatgctattcctttctgtttattagttttgcttctaacagtcagggccctctgccacaggtctgctggactttgctggaggtccactccagaccctgtttgcctgggtatcaccagcggaggcagcagaacgtcaaagattgccacctgtttcttcctctggaaggtttgtcccagaggggcacccgccagatgccagctggatctctcctgtatgagatatctgtcggcccctgctgggaaatgtctcccagtcaggagacacaggtgtcaggaacccacctgaggaggcagtctgacccttagcagacttgaggtccactgctctcttcacagcttgcaagaagggacgtttaagtctgctgaagctgcgcccacagctgccccttccctctgtcccagggagatggaagttttatgtataagcccctgactgtggctgctgcctttttttcagagatgccctacccagagaggaggaatctagagaggcagtctggctacagcagctttgctgagctgtggtggactctgcccagttggaacttccccatgactttgtttacactgtgaggggaaaactacctactcaagcctcagtaatggtgtacgcccctttccccaccaagctggagtgtcccaggtcaacttcagactgctgtgctggcaacgagaatttcaagccagtggatcttagcttgctgggctctatgggggtgggatctgctgagctagaccacttggtgccctggcttcagccccctttccaggggagtgaacggttctgtctccgcggagttccaggtgccactggtgtatgaaaaaaatctcctgcagctagctcggtgtcttcccaaatggccacccagttttgtgcttgaaacccagggccctggtggtgtaggcacctaagggaatctcctggtctgtgtgttgcaaagactatgggaaaagtgtagtatctgggccagattgtatcgttcctcgcagcatagtccctcaccgcttcctttggctaggggagggagttccctgaagccttgcatttcctgggagaggcgacgccccaccctgcttcagctcgctctctgtgggctgcacccactatctaaccagtcccagtgagatgagctggatacctcagttggaaatgcagaaatcacccgccttctgcattggtcttgctgggagctgcagaccagagctgttcctatttggccatcttgccagactcctgacttttagctttttaaagtggttttatgttctattctcttcgcttttctaataaagaaagccatcactaaaatatcagataaataacaatcatagcaccactttactcagtttaagaggctttcagtgacccttttattccatatggtgcttattacttaaggtaactacttagtcttcttaagtcatttttgatattttcttcatcgaactatgatagaagctactgtccaaccattctgcttcattttatgtatctttgccatactgaacaattcacttgtattttttgaaaccatagtactgtgaagtccttgttcttctaggaaatgtgattggtagctcagggatttaaaacagtgttaatgaacagaagattgtgaatttagttctcatgcctgccagttacttttgtgaattccatggtaggtgtgaaattaaatagatagacctatcttttccataaaagctttgatttatgcaacaaatcactatctcccaaacaaatgttgctttattttagctctcttcagtgaatattagaataaagatgttaaggtaccatcttgcaataatcaaatcagtcaatgttctattgatattagtcatctgctattaatatgttcaatagcttataatagaataatttagtttcttgagagtgtcttgtaccattaaaatattttgaatttcttacaacaatatatattgccaacaatagaaattgccattaaaatgtaagatcatgttggcttaggattgacttggcgatgtgggctcgtttttggttccatatgaactttaaagtagttttttccaattctgtgaagaaagtcgttggtagcttgatggggatggcattgaatctataaattaccatgggcagtatggccattttcacgatattgattcttcctacccatgagcatggaatgttcttccatttctttgtatcctcttttatttcattgagcagtggtttgtaattctccttgaagaggtccttcatgtcccttgtaagttggattcctaggtattttattctctttgaagccattgtgaatgggagttcactcatgatttggctgtttgtctgttattggtgtctaagaatgcttgtgatttttgtacattgattttgtatcctgagactttgctgaagttgcttatcagcttgagattttgggctgagacaatggagttttctagatatacaatcatgtcatctgcaaacagggacagtttgatttcctcttttcctaattgaatgccctttatttccttctcctgcctaattgccctggccagaacttttaacactatgttgaataggagtggtgagagagggcatccctgtcttgtgcccatattcaaagggaatgcttccagtttttgcccattcagtatgatattggctgtgggtttgtcatagatagctcttattattttgagatatgtctcatcaatacctaatttattgagagtttttagcatgaagcgttgttgaattttgtccaaggccttttctgcatctattgagataatcatgtggtttttgtcgttggttctgtttatatgctggattacatttattgattttcatatattgaaccagccttgcatcccagggatgaagcccacttgatcatggtggataagctttttgatgtgctgctggattcggtttgccagtatttcattgaggatttttgcatcaatgttcatcaaggatattggtctaaaattctcttttttggttgtgtctctgccaggctttggtatcaggatgatgctggcctcataaagtgagttagggaggattccctctttttctattgattggaatagcttcagaaggaatggtaccagctcctccttgtacctcaggtagaattcggctgtgaatccatctggtcctggactctttttggttggcaagctattgattattgccacaatttcagatcctgttattggtctattcagagatgcaacttcttcgtggtttagtcttgggagggtgtatgtgtcaaggaatttatccatttcagaaatatagatcaatggaacagaacagagccctcagaaataatgccgcgtatctacaactacttgatctttgacaaacctgagaaaaacaagcaatggggaaaggattccctatttaataaatggtgctgggaaaactggctagccatatgtagaaatctgaaactggatcccttccttacaccttatacaaaaattaattcaagatggattaaagacttacacgttagacctaaagccataaaaaccctagaagaaaacctaggcattaccattcaggacataggcatgggcaaggacttcatgtctaaaacaccaaaagcaatggcaacaaaagccaaaattgacaaatgggacctaattaaactaaagagcttctgcacagcaaaagaaactaccaccagagtgaacaggcagcctacaaaatgggagaaaattttcgcaacctactcatctgacaaagggctaatatccagaatctacaatgaactcaaacaaattgacaagaaaaaaacaaacaaccccatcaaaaagtgggcaaaggacatgaacagacacttctcaaaagaagacatttatgcagccaaaaagcacatgaaaaaatgctcaccatcactggccatcagagaaatgcaaatcaaaaccacagtgagataccatctcacaccagttagaatggcgatcattaaaaagtcaggaaacaacaggtgctggagaggatgtggagaaataggaacacttttacactgttggtgagactgtaaactagttcaaccattgtggaagtcagtgtggcgattcctcagggatctagaactagaaataccatttgacccagccatcccattactgggtatattcccaaggaattataaatcatgctgctataaagacacatgcacacatatgtttattgcggtactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacactgcatgttctcactcataggtgggacttgaacaatgagaacacatggacacaggaaggggaacatcactctggggactgttgtggggtcgggggaggggggagggatagcattaggagatatatctaatgctaaatgacgagttaatgggtgcagcacaccagcatggcacaggtatacatatgtaactaacctgcacgttgtgcacatgtaccctaaaacttaaagtataataataataaaataaaaataaatttaaaaaaatgtgaggtcatgttatgattgtgtttgggtttctaaatagcttgctgttgccagagatttgaataactagtggataataaattaacatatttgtgaattttactctagttcagatacagtatttgtttctgtcttttgtttgtttttgttgttttgagacagagtctcactctgttgctctggctggagtgcagtggtgcgatcttggctcactgcaacctctgctcttgggttcaagcaagtctcctgcctcagcctctctagtagctgggattacaggcatgtgctaccaagcctggagaatatttgtatttgtagtagagacagggtttcgccatgttggccaggctggtcttgagcccctgacctcaagtggtcttgcccaccttggcctcccaaagtgctgggattacaggcatgagccactgtgcccagccttgtttcttttaaaatgccacatttagatgacaatttccaaattcatcccatagctgtttttttataccattaaagacagaaccttggactggctacattgtgtttctaagtactgaatttcatatgtgttcgccttttgaataagttattttctctttacatttcaaaatactgtaaatatttaataaaatatgtacctcacactgtaggaggaagttttatggtattactgggttaactgaatgtaagtttttatgcattggggcctaagggagctcctgggtcatcgggaacacattcttaaggaagaaagcaagttaacaatgaatgtttttacacaaacagtccaaatatacaaccccaaggggcttttctaacccttagggtctaaggctctaaaattcttgttccagtactaccgtaatttggttactattttacagtattcaaaattgtaattggcctaattgttctgggtacatggtagagttagcaaactgacttaagcttttttccagttacctattgttgcaaataaacccaaacttagaggcataaaaacaacaacaatcttttattattattgtcttacattattatttattattaagatggtagactgggttaagctaggcagtttttgctcagggtctctaatgtgtttgtcatcattgtgactggggctgggcttatcttgaaggctttgtcactcaggtatctgagtgttgactaagaccttggcaggacctgtccactggaaggcctatgtgaagtttttccatataggcttcctaacagcatggtggctgggctccaaggcccagaatcccaggcagagagttaggtgggagctgttttcctgtctatgacctagactcagaagtcatgcagtgtaaactccaccacatcctatttgttagagtcactaaggccagcccatagtctagcaggggatattagactccatctcttgatggggaggagtgtcaaagaatttcagatgtgctttaaaccaccacgggtccttcacttggattttactcctttaggttccagcccttgttatttctctccaaaaaaaactttggacctgcaaagagcctgctgccattagtgtgctaacagtaccatatgaattgtcatgaaatttgtttaacctgtggaagcaagtacttccttcactggcagggaaccttcactagcagtgatatgctaggctgcagattagattcattaggatagtatcttaaatccagattattggctcaattattcttgaaaaatcagggtaaattggtcagcatagattctagtagggtacaaagttttcaccaaagagcagaagtaagagtggattttaaagccgctctgggcttgttccctcatcttaaaagtagaggagattaacaaaagaagtgtaagacttgtataggttcttgtacttgtatattgaaaactgcaaagaaatgttgagagatattaaaggagacctaaataaatggaaagacatcctatgtttatgtaatctatgtaaaaaatccaactatctttgttgcagaaattgacgagctgattataaaatgcacaggaaaggttagggaaccaggctagccaaaacaacctcgaaaaagaacagaactggactcacacttttcaatttcaaaacttactgcaaagctacaataattaaaatagtgtggttctggcataaggacaaggagatcggtgaaacagaattaagagtacagaaataaacccacacatctgtaatcaatcgattttcatgaatgtgcaaagacaattcagggggaaaggatagttttcaacaaatagtgctgggacagctggatgtccacatacagaggaatgaatctggacccctatttcacaccatatacaaaaattaatatgaaagagatcaaagacctatacctatatgtaagagttaaaagtatagaattcttttttactccaaaaatttatatatttattttatatcaattgaaaagtaataatatgttatgatagggatggaaagatagaagatatattttgtgggaagatttttgcaaatatgtatatatggtataaggaaaaggaaaatgggatgacctgggatgttggaaggtgctcattcggtgttcaactaaaaacaagtgatttaaaaacatgatccatggtggttgtcttagtttaaggtgccacatgttcattcttttgccaagaaatttacttatttttggaaagaacctgaggatttaatccaaattcagcaaaattctgcaaacattttgggaaaattgttctcagtggaatactttaggaaatgaaagaaaaggaagagtcaaatgtgactatggagatttgaatcttcagtaacttaaaaaacagtgggcaggtagctgggtggacccattccagatgggcctgggcatcattgtacagttgtgattttcttgtaaaccaccatgactctcactggcttggattaaagaggttgctctgttttcactaaagccttctggctattatcacaactctgagttcttcccaaagaggaaagtgatgtcttttccaaatatcatgaggcggttttcaatgagaaattgtacaagagaaaccttttttgtgaattctcttttttaaagtcagagtcatcacactggactttttgtgaatgcattttctagttttgagctgcaggaagtggacagctgaagaatgcttggggctatacatgttgataaattataagcttttatctgattggatgaggaatattcagtgtgtacactccaaaaaggtatctcaagagaacaacattggcagctggtctaaaagcctctggatagcaattattttctcctcttcattcccttgatgaatacaccaagccattcatcatagagactggatgaaaatatacttccttggatattctttcatttaagaatgatgtttccagaagaatggactcaaattgtccaagttcactttatctgcagaatttagtttctcctttagggctcgatatgattttatatttgccaattttctgaagataccttctgttgagtggccctttttggttgctttttaaaaaggcatatccagagaggggtgggtatgttgtcattctcacaaacatctgtgagagaagctccaaagagctggcctagctttaaggctggtagagtcatgcataggttgtcctggcaagtgttagacccctgccaaaagaagggctcctgaaagatggaaggagagatggagttcactgtccctgtggcaggagcataatggcttgaggatggctcattttaattctgtaagaatgcttgtgcccaatgagtggacatggggcctttttcatgccagaagtgacccacagctggtaatcttcagagcccaaaatgtggccacgaagttcgccatgggccagcccaagagaagggacctcccagtagagatgtggccattccccactttgtccacatagctagctgtccacaggttgttcagcactattttattttttatcttaaaggatttcctgcacttggtagacaaaagcaacaaattgctgaacaaaaagagatgcagcttctgcctcctccagcctctgttgagttgagaatcagcagggtaagatcagcaccctccagtgatgtggttttgtcattgtgggtgtccatcttggaaaaaggactttcccttagttaaaaatacattattgcttaaacatgctaacagtcatctgaaccttcagtgagttgtaaacttcttgctgatggaaggtcttgcctcagtcttgatggctgctgactgatcaggctgatggttgctgaagattggaatggctgtgacactttctcaaaataagacaacaatgaagtttgccacattgaaggactcttcctttcacaatagatttctctgtaacacatgatgctgtttgatagcattatacccacattagaacttttctcaaaatcagagtcagtcctcccaaaccctgccactgctttatcagctaagtatgtgaagcattctaaatcctttgttgtcaactcaataatattcacagctgtttaccaggggtaaatttcatctcaagaaccactttctttgctcatccataagaatcaattcctcatccattcaagttttatcttgagtttacaggaatttagtctcattttatggtccacttctaattctagttcttttgctatttccaccacatctgctcactcttcttccattgaagtcttgaactcctcacgcttatccatgacatttggaatcagcttcttccaaactcctgttagtattgacattttgacttcctctcatgaatcttgaatgttcttagtggcatctagaatggcgagtccttccctgattttcagtttactttgctcaaatccatcagaggaatcactatctatggcagctgttgccttgcaagacatttcttaaataataaaacttgaaagtaaaattaatccttgatccatggaactgcagaatgaatgttgtgttagtagaaatgaaaacattaatctccttgtgcatctccattagagctcttggataaccaggtatattgtcaataagtagtaatattttcaagggaatcatttttttctgagcatcaggtcttaccagtgggcttaaaatattcaggaaaccatgctgtaaaaagatgtgctgtcattcagactttgttgttccatttctagagcatagagtaggtttaacattctttcttaatatttgaaccctactttctttttttctttttccttttaaaattgtatttctatttagggatacaaatggtttttggttacatggatgaattttatactgaggaagtctgggcgttaagggtacccatcacccaaataatgtacattgtactcagtatgtaattatttatccctcagccccctctcaccctccagtcttctgagcctccagtgtcccctataccattctgtatgcctttgtgtacccttcatttagctcccacttgcaagggagaagatgtggcatttggtttttcattcctgagatacttcacctaggataaggcccccaattgcatccagattgctgcaaaagacattatttcattcttttttttttttttttttttggctgagtagcaatccatggtgtgtgtgtgtttgtcacatttttttttaatccacttatgggttgataggcacttaagttgattctatgtctttataattttgaattatgctgtgataaatatacacatgcaggtatcttttttatataatgactttttttcctttggtagatacccagtagtgggattgctggattgaatggtagatctacttttagttcttggagaaatttccatactgtctttcataaatatcgtactaactttcattcccatcaatagtgtataagtgttcccgtttcactgcatccacaccaacatctgttgttttttgactttttaataatggtaattctggctggagtaaggaggtatctcactgtggttttaatatgcatttccctgatgattactgacattagtggcatttttttcatgttggttggccatttgtgtatcttttgagaaatgtctgctcttgtcgtttgcccactttttaatgggattttttcctttcttgctgatttgcttgagttccttatggactctgtagataccctgtagtgggattgctggatccattggtggtttagttacatgtcatttacaggtttttgttacatttgcttttggggtcttagtcataagttctttgcctaggccaatgtccagaagagtttttccaggttttcttctagaatttttatgatttcaggttttagacttatgtctttaatccatcttgagttaatttttgtatatagtgaaagataggaatccattttcattctttgcatgttgttgttcaattttcccagcaccatttattgaatggagtattctttccccagtgtgtgtttttatgtgctttgctaaagatgagttggttttaggtatttggcttatttctgggctgtttattctgttccattggtctgtgtgtctttttttttttttcccccaggagatggtgagttttattttgtcttgtctggatagaggtttgatttgctctctaatgttccagggtgcagagaaagtaggagaaagcacaggatgttgaggtctatttggtgtaatcttctccctcgttttcattttcaccatcaacggagacagcagcatacttgcttgcagaactgaacttggaagctagattttccttgggtttatatggctcaggtgcagatctggactcttgatcctttttgccatctttcctatctgactccgttcagtggtctttgttccctctgtctcctggaccatggctagagttcccagtttggtctttggggacattcatcccatctactttattttcatcttttcttgctgttccttcctcagatggttgagctggagctacttttcccccaccacttgtagggattgctgctctgtatctgagctctgtgatagagcaggagggttagaacttcacttcacccaagcattctcctttggtggaggggctggcattacctttaggggctgatcaggtttgggagttttagaagttggagagtgacagtcttcctccttattgagtgtttcattttctaaagacttctcactctccctcgtgcatttctgccggatgtggcagaggtcccggtctgtgatgactcacttcctgtcctcgaccatccctgttcctgagtttcttcactttgccagtttgggtgtctctcccgaggccatcgttctagttttggctcatccagctgatgctgcaacttctcttgttccttctgtagctgttctacttctctttctctagcagctgtgtcaatgggctttgtccctccaaagacagaagcagcttgactggactgggaggtactagcagaggaattatcttccttaggagtactctgaggctttagattcagtttgggtctttgtgggggacctctatcatcacgcctataatcatcccaagagtaatcatctctggagctctatgaccgatcatcccgtctgttggatcagtcttcatcacagtcctcacctcctctgtagtcatcatccctgtggtacccactgccaaatgcttttttgccattgcctatctgggaatcatagcctctatcataatctctgctgccttggtcatcatagcgatcccagtcgccgtatcaatccatatccctgcatgggccatcccaatactcatcacaataccaatctgaatcataacgatctcgatacttgtctccaaagctatcatcacctcttctaggtgagtagtcatcaaagctgtctgtggcaggacgagcccttcagtctgtatctgttttgtcataatccccatttctatcacagccagaagaatgatcattcctgtctttatcctgtgcttgatcagcaacgtccactcaaattctcctgttacctagagactcttcattgagactcagggcactgagcagggaatccaggtcctcaaattcagcataaccaaaacctttcaacttctctggattgctgggttcacgtggtaaaagcactgcactgatatttagtcctctaaagaattctttaatgtactcttctgtcacatcatagggtaggttccctagaaaagcaatgtagggtgacaatttgggaagatggctccagtcgatattgggttcccaagcagcccctggagcagtgggaaggatggaacggtcaattggaggtgccctatacacatcttcatcattactgttccaagttgttgaaatatctccttccaggtcatctgtttcatgagcccagctgactggtttggaaacataagtgcttcctccaccagtccctccatcctcagccagagagtctgttagggagagagtcttccccttcttattcttcttttttgcttagttcttgaaggtcaataatgggtcacactggaaactggtattgttgaggctgccatgttgggagaggctttgtgtgtctatttttgtactgttttagttactatagccttgtagtataattttaagtcaggtaatgtgatatctccagatttcttctttttgctttggattactttgactattcaggatggtttttggttgcatatgaaccttaggattgtttttttctaaatctgtgaaaaaatgaccttagtattttgataggagttgcattgaatctatagattgctttgggcagtattgtcagtttcacaatattgattcttccaatccctgagcatggcatgtttttccatttgtgtcatctttgatttctttcgtcactgttttgtagttcttttttttttcttcgcaactattgtaaatgggattgagttattgatttgattctcagcttgttcgttattgatacatagcagtgctatggatttgtgtactttgattttgtaacctgagacattactgaatttataaaatctgggagtcttttagaggagtctttagagttttctaggtgtaaaatcagagatataaaaagagatagtttgacttcctctttttcaatttacatgccctttatttctgtcttttgcctgattgctctggctaggacttccagtgctatgttgaatagaagtgatgaaagcaggcattcttgtcttgttctagttcttaggcggaaaggctttcaccttctccctattcaatatgatgttggctgtggatttgtcttattttggcttttgtaattttaaggtatatttcttctatgcctagtttgttcaaggtttttatcatgaagggatgctggattttatcgaatgctttttccgcatcttttaaaataatcgtatggtttctgttttttattctgtttatgtgatgaatcaatttattgacttgcatttgttgaaccatccttgtatccctgggatgaagcccagttgatcaggttgaattatcttttcaacgcgctgttggattcagtttgctagtattttattgaggctttttgcatctgtatttattaggaattttggtctgtatttctttattgttgttgttatgtcctttccttgctttggtatcagggtgataccgactttgtagaatgagtgagggaatcctgctctgtcttttggaatagttttactaggattggtaccagttatttgaaatgtctggtagaattcagctgtgaatatgtctgatcctagtctttatcttgttgggagatgttttgttactgattgaatctcactccttgttactgatcagctcaagatttctttatctttttgattcaagcttaggaggttgtgtgtttctaggaatctatccatttcctgtagattttctagcttgtgcacatagaagtgttcatagtagtcttgcatgatcttttgtatttctgcagtatcagttataatgtctgcattttcatttctgattcagtttgtttgaatcttctctcttcttttcttgattagctagtggtctgtcatttttgtttatgttttcaaagaaccaacctgttgtttcattgatcttttgtattgtcttttggtttcaatttcatttagttctactctgatctctcttgtttttcttctgctagctttgggtttggtttgttgtttctctggtttcttgaggtgtgacattatgttgccagtctttgatctttctgtctttttgatgtaggcatttagcattataaacttttctcatagcgctgcttttgctgtatcccaggaatttgggtaacttgtgtcactgttattattcatttcaaaattttttaaaatttcatcttgattatattgttgactcaaaaatcattcaggagcatatggtttaattttcatgtatttgtgtagttttgagagttccccttagaattaatttctagttttgttctgctgtagtctaagaagatacttggtatgattttgattttttaaatttattgcgatttgtgttgtgtcctgttatatggtctatcttggaaaatgttccatgtgctgatgagaatgtataccctgcagttttcaggtagaatgttctgtgaatgtctgttaggtccatttgttttagagtccagtttatgtccagtgtttctttgttgacattctacctcagtgatctatgtagtgctgtcaatgaagtgttgaagtctcctactattattgtcttgctgtctacctctcttcttaggtctagcagaatttgtttgatgactatgggtgctccagtgttagctgcatatgtatttagaattattatatcttcttgttgaattgttctgttataatataatgactttctttgtctttttatttaaagtctgttttttctcatataaaatagctactcctgctctcttttggtgtccattcatgtgtaatatatttttttccatatctttccttgactctacaagaatctttctatgggttaggtgggtctcttgaaggcagcagatgtttggtctgtgttttttaaaatccattctgccaatctgtatcttttaagtggggcattacaccatttacattcgaaaatagtattgatatggagctactcttgcagtcatcatattgattgttacctagttgctttgttttctttactgtgttattgttataagccctttcatttatgtatgtgtctatatatgtatttatttgttgggatggagtcactctgtcacccaggctggagtgcagtggcatgatcttggctcactacaaactctgccctcccaggcttaagcgatcctcctacctcagcctccccagtagctgggacttacaggtgcacgccaccacgcctggctaatttttgtatttttagtaaagacgatgtttcacccatgttgaccaggctggtcttgaacttctgacctcaagtgatccacctgcctcggcctcccaaagtgctggtattacaggcatgagccaccatgcctggcctagccctttcatttagatgtttagaactccattgagcatttcttatagagctggcctactggtgacggattccctcagcatttgcttttctttgaaagtctttattttgccttcatttcttaaacttagttttgctctgtgcagaattcttgtctgacagctcttctgtttgaggagactaaagataggacctgaatcccttctgccttacaagatttcagctgagaagttagtctgatagtttttcctttatcatttatttgatgcttttatctcactgcccttagaattcttgcctttgcattggctttagatagcctgatgaccatatgccttggtgatctccttttttcaatgaatctcccaggagttttttgagcttctggtatttggatgtctaaatctctagcaagattaggaaagtttttgtcagttattccttgaagtaggttttctaaactttttgctttttcttctccctgaggaacaactttgattcttagatttggatgttttacatggtcccgtatttcttggagattttatttgtttctttgtattctttttccttaatttttgtctgactggtttaatttgaaagccttgccttcagactctgaaattctttcttctacttgatccagtctgttgttaaaaatttccactgcattttgtaactccctaaatgagtccttcatttccagaagttctgttttttttttaatatcgacctctctagaaaatttcattcatatcctgtattttttttttatttctttatattggttttcaactttctcttggatctcattgagtaactttataatgaatattttgacttctttatctggtatttcaaagatttaattttgttttggatccattgctggagagttagtatgtattggggagggggtagtattgtaaataaaactgttttttcatattgccagaattatttttctggtttcttcccatctggataaactattttttattattattattgaatttacttttgatttgactgggttctttttttttcccccgttaaggatgtgactttaatgtgtatcatttgtaatcacctagcttcagctctgggtgctttcagtggcaaagtctctgttgagtttcttggttatagagaatctgtgtgtgatggctttctcaggtgctggttttagtagtagtgtacttagtgtgtgggaaggttcactgtctcctgtggggccagagtggcagagatctcaggaagcttatcttgttccccagtagtgtgtactactctcctccccaagtctttttttcactagggtagaatacttcagcctttaggccagtaggaggcacccatgggtgaaaaccagctgcagctgaagcaggtggtgggtatatgcagtaccccagtggtggacaaaagtctcaaccttgacagaggcagctgggggcagggagctcccagtgaaatgcactgaggtcttcactgtgggaggggagggagccacctcagcttcactaccaggccagcaggaaagcaacctccctgtcgttccccctcatccctatattctggacatttagatcagacaagcacctctgtccatctgcaggaacactgacattccatatccagagacagtgggactctatctctcatgaaagcctgagcccagagggcactcctcccaaggcgatgcagtcaccccaaagtgcttgagaaaggtcctccataggtctactctcactgagctcctgtgggagaaggcccagctgtatctgcgttgttgaacaagagggagagaagccccttcacaagtaccggggctcctccactgctagagtagaaccttagtctttccccacggagcccagtactgcacctgttcctctgctgaaagaaacttcccataggcaggaagttgtggtactcaaggttcatactttggtttcttttgtcccaaggggtgttccctttgtgtggtgcactccccattcccatgggaatggtgatctatgcgggccagactactgtgaatccagctgcttatctgggtttagccacctcagggactgccacaatccaggcctgtgctggagaatcttggcaagggatatagtcatggggaagacacaagggctgaaggtcctcaagcaaaacaaatgatccacaatgggtgcacacccagtatgttgcctgctactacagctcaggaccagagggaaagggaggggactttgtgtgagcaaggacccaagaagtccccagattgcagcccactccagcatttggactcatgagggcagcgaagctctccttgagtttggataccagcagtcaaaggctagagaataccctttccacagaatacttgagtctctcagggtttgatactcttccagcttcttgttactttctcttatgtgcatgttgtggattcttccagtgaattctccgatggactccagccctctccctgtaacactctatttgggatgtgactatttatttatgattttgtttctttcttctgaggtgaattggttactagcatctatagtcaaccatctggagaagctctggagaagctctttagtgcttcaggctatggacaggtctgcggaatgtgtaatggtttggtccctactcttagctccagagatgggtgatgttgggtggagctgggcaaggctgacctgtcctctcatctcataagggcaggttcaagcaccaactctgatggtggcagtaggggagtggcatagactctgtaagatttccttggttataagtagccttagtgcagtggctttctcaattgtcagatgtagtagtaatgtactgggtacatgaacaggcccaaggcctcctgagcagcctgattggtgtgagtaatagtgttagctgaggtcatgcaaaagttttctccttcctgagcaccgtgttatgatgttagcagacattgtagagggctgtgtcagttgacctccaactacaatttagggacttgttgaggccattatcttgctcatacaaggtcctttccctttctgcctggtcctaagctgtaggagtgggcaccatactggatgcgtacccattgcagaagtttgttctgctcaagtaccttcaacccttgtgtcttctcatcactagatcccttgtaaacagcccccaataccagactggcttgagacagctgcacaggatagacaaattcagaggagcagtaggattcacagtgaagtggcactagcaggagagagccagctacagtggtggccttggggatttatacttggcttatgttaccctggggaaacactcatatcccaggcaatgggcagggtcatggaactccctaaagtccctgtctgtggtgttaggctaggggcatagcctgtggggcctggatcaggcaagtcctcactctggctcaccaggtgtggactcaggctgtgaccccagtggcgatccgagggcagttccctggccactggggtaatgttccacggaggagcggaactgcctctgttgcataaaagaatcctcagggaggggagaggggtaacaggcagcagtgagacccacccagctctcactttcttaacacattgggtctcacactcacagacttctggcaacagctgggtcccaggcagtctgccctcagcatgcaaaactgcccctggttgtaagtccttctgcccaagacaaagaccaaggcttccaggccacacccctcccagtttgcctgcaaagcaggggctcccagcacctgcctctgtggcaaaagcctgcttcctgctcacctctcatttctgatcaatggggtttatacccacagtagattagattgcttattttagttggcagcttcttccaacctgtgaccactgtctgagttagctggcagaattctgtgaggtcccttatgaagtaggatcagcaatggcttccctccatccctgctagggtgtgggagtgcacgcaaaacaatttttttttcttttatatgtgaagtcttgctctgttgcccaagctggattgcagtggtgcgatcttggctcactgcaacctccacctcccgggtccaagcgattctcctgtctcagcctcctgagtagctgagattacaggcatgcaccgccacacccagctaatttttgtatttttagtagagacagggtttcgccatgttgaccaggctggtcttgaactcttgacctcaggtgacccacccgtttcagcctcccaaagttctgggattacaggcatgagccatcacttctcatatgctccttgtggctcaccaaatcagcaccagtgcttggtagggttgagacattcccctgtggcctggattgcccagttccccagtgtcaatgtgtaatcatggaggcagtctccccgctttcacaccctggagacatattttcacctgactcaccatgtaggttgccacccacagctttcaaagtgtctgaagtttctttcattttttctgttgagttactgtgtttcttcttggataaaagtttacagcataaatctctgcacgttattttgctctttgcaagtgggtgaggcatgctaacaatgcctccaatctggagcctgggtagtttataaagaaaagaggtttatttggctcacagttttgcaggctgtatatacaagaagctcaggacagaagactaagtggaactggagtatagaaatcacatgacaagagagggaataataggtgccaggttcttttcaacaaccagttctcacgggaactcagactaagaactcactcaatcccatgggaatgacaccaagccattcatgaggatcctgacacctcccaccttgccacacctccaacattggggatcagatttcaacatgagacttggcaggatcaaacaaaccacattcaaatcatagcatatgtcatctgcaaagaaacagtttcatttctacctttctcagctatattctttttatttccttttcttgccctattttaccacatagaacttccagtactatgttagtcatggtgagagcagacatttttgttttgagagggagcattcagtttttctttcaccatcaagtagagttagctgtagaagttttgtaaatcaaattgcagaatttatacaaatggccaacaagcatgtgaaaaaatgctcaacatcactaatcatcagagaaatgcaaattaaaaccacagtgatatattgttacaccagtcagaatagctgttattaaaaagtcaaaaactaacatattggaagggtttggagaaaagggaacactgatacattgttggtgggaatgtaaattaacacaacctctatggaaaacagtatggaggtttctcgaataacttaaaatagcactacctttcaatccagtaatcccactactggatatctacccaaaagaaaggaaattattatatcaaaaagataacctgtactcatatgtttatcgcagcataattcacaattgcaaagatatgaatcaacctacgtattcatcaacagatgattggataaagaaaatgtgtatatgtacacaaaaaaatactgttcagccataaaatgaatgaaatcacatcttttatagcaacatggatgacactggaggctattatctttagtaaaactaaactaactcagaaagagaaagtcaaatactatatattctcacttaaaagtgggagctaaataatgtgtacacatggacatagagtgtggaatgatagacattggagcctggagagggtggaagggtgggaagagtttgaaggataagaaattacttaatagatacaatgaacattattcaggcaatggttacactaaaagcccaggcctgatgtggtggctaatgcctgtaatcccagcactttgggaggccgagacaggcggatcacctgaggttgggagttcaagaccagcctgatcaacatgaagaaaccctgtctctactaaaaatacaaaatcagccgggtgtggtggtgcatgcctgtactcccagctactcaggaggctgaggcaggagaatcacttgaacccgggaggcggaggttgtggtgagccgagatcgcgccattgcactccagcttgggcaacaagagcgaaactctgtctcaaaaaacaaaacaaaacaaaacaacaacagcaaaaaaaacccagacttcatcactatgcactatttccatgtaacaaaactgcacttgtgccccttaaatttttatagattaaaagaaagacacatcattaaagaaattgtggaatttccctctattcctagttttctgagagttttgtcataaatagatgttgaattttgtttgatgcattttctgcatcaattgatatgaccatgttattttgttttgctttagccagttaacatggtaattatattaattgggtttttattattgaaccggccttgtttccctggagtaaaccctacttagtcatggtgataattcagcttacatattgctgaatattgtttgcaaatgtgtttttaaggattttgaatgtcaatgctcatttagttcctctgtatccttgctggttttctgtctagttgttctaccaattgttgagagaaaaggagaaaagtgtgcaagtatccaactataactgtggttttgtctattctttcagttctgtcagttttatttcacacattttgcaactctggcgcatacacatttaggattgctatgtcttcttcgtggattgatctttttcattatgtattataatatccttctctgtctctgataattttctttgctctaaagtctcctttatctattattaatatagtcactcctgcattattttgattgtgtgatatatctttttccatcctttaactttaagcatgtctatattgttatatttgaggggacttttttatagacaatacataggtgagccatattttaactctgcaaatctctttctttcaattggtgtatttcatgcttttaaatttaattaatttctcatatgtttgggcttcagtctgccattttcttttttatttgtcttttttaatgttatttttaactgttttccaccttttcttaacttagctgatgccattttattgatttttttgtttgtttattctatttttcatctttctgttttatttttcctaccttcctgtgggtacttaaagatttttttaaaatctctttttgatttatcaatagtggttttgattgtatcattttgtataactttttagtgattgctgtaggtaacacttcagtgtagtgatgtcatcattttattagttcaaatgaagtatagaaaacttactttcatttatgtcttattaccattctgaatttataatagttatcttaaatatttcctccatacacatttagaatcatatcagacagtgttataatttttgcttcaactgtcaaaattcaagaggagaagaaacatgtattgtatttacccatatttatgcttaccatgttttttgtttctttttggtgttctgatatatgttttttcctctttttaaaaaattacctttctgtttagagaatggagtttatccattctttcagggtaggtctgctggtgatagaatctcttattttccttcatctgagattgtcttggtttcttcctgattgctaagtgatgtatttactggtataactttctgagtgggtagtttttttctttcaatcactggaaactcttgtgccacatcctagccttcatggtttctaataaacaatccgttgtcattctaattatttttcccctataggtaatgtgttatctctggctactgtcaagatttttttctttgtctttaattttcagaagttacgatgtgtcttagcatggacattttaaaatttattctgtttgtgtttcactcagcttcttgaatctgtaggtttatggctcttgctaagtgggaattttctgctttgccctctgtctctctcctttaggaactcaggtgacatgaatgttagatactttgttatgatcccacaaatccctgaggcgctgatcatttttttccattctattttctttgttttgatcaaattggataatttctgttgttctgtcttccagtttgtttattctttcctctgtcctcatcattctgctgttgagcctatctactgaactttttatttacactattatatttctcaattttaaaaactttgctgatactttctgtttcttacttaaggatttctggttttttgatttgtttcaagcatgttcgtaattgcttattgaagcacttttatcatggctgctttaaaatctttgtcagataattctaacaactctttcttctcaacgttagcatccattgattgtatttttttcatttggtttgagatctttcagtttccaggtatgaggagtgttttttgattgacgtataggtattttgggcataatagtataagaccctagatcttattttaactttctgttttagctgtattttcttataccactctggtagaagaaggggtgagggcacatcacctcattactgccaggtaggaatataaggccattatttttgttgacatccaggtccccagtaggcctccactaatacctccttgctgggaaatataggagtgcttcattactggttctcatttggcctccatttatagggcaggagaaaaggtgtgacctcttgattggtgatgaaatggtttcttatcacctattggaaatgaaagtgttgacttcttccttgtagttttctgacaccaccatgactaagagagttgggagttgagcattgtgcctcatgatagactcaggaatgtagaagtctcggtttctactcagcctttgctggaatggatgggggtagggtaaagttttttctgagtggttattgtctaaaagttttatttttgctaggctgctcttctcctgtcctttggctagagagacaggcttttgttggggattttttgtatgcatgtgctggcatttctcagtggttggctcctttgactttaagactggtataaataaggcaaaaaggaaacccagggcagttaccatagtgtcgttcatagagtcctgaagttcatagctagactgccttctacccatgtttctaagtctttttgtgtttgttttatatgtaatgtccaagcttcttggttgtacttagtgagaagactagggaaaattatgtctactccatcttcccatccatgtatctttaaaataagtgtctgacctatttattgtcctgcaataaaagtgatgatttcttaaaaacaggttatgaaacaacttataggatgtagatgatgatgacatgaatagcttagaacagtagctctcaaacttaaagtgcattcaaacacctggaaggctttttaacactgattatggagccctactcccaagaagaaatgggaactagcatttctaacaagttcccaggtaatactgaaggtgctgctctggggaccatagtttgataatctgtttcagagaaatgctgaatagatgacagatcattagctttaaatgatattaatggcaaatacacttgctttgagtaaaacaaataaaaatttgtaataattaaactgagtattagatataaaatatttaaaggtagatacttaaaagatgatatcatatttttaatgaaatgggtcttcccattttccagcactatagtatatggcatttgagaggccaaaagagtaggacactaagggaaatagtattcattttattataaagggaagaatatagcaaaaaataagagataaggtgatcagttgttctgtgagcataaaataatgcctattttttggatgttaggcaagagtgtttgaaggatactttaagccacactctgatagttgtatgatatgcaagatctttcttaagactcagatttgatgtcagaaaagctccattacattgatctgaactaatgatttcctgctaattactgcacttatcatcataatataccttcctctaaagttcgtctttttttcttgagttagtgaataaaaatgattctggaattaaaactactcccatcaatagtatgaccattagtttagatcaaggtgaacctagaaatatttttcccaggtgatcactaactataaaaaagaaaaattaaaatagtgaaatgtcagaatgaggtctcttagacattattcttcttacagaagttgttataaatgttaataaagaaatttgctcgtgaatattcatcagataatggttctgattttgtagccacatacattagagtaataaagcatttccttttctcttttagctcggttggtttagcaaaagcagctctagaagcaattaatggattcaacctttttggcaaccaggtaaaaaataagacccccagaatctttgattatttgaattgcacatttaattaatttggctattcattaacaaagtcatttccttataatcagagaatgtccaaaatttatgtagaagctcatgcttgaacttttcctttgaaaatgatttgccagttaaattttagttttctaactaaagaccattgcttaatttctttaaaaaaaaaaaaaaaaagaaaattttttttgataaagaattctgatttccttggttcagtgacttttccctcaaatctattactcattttgtagaaggtttcacattttttaatgtatttggcattgtatatatatatttttatgtcagttttcatgttggtttcaatgtaatgtatttcaatgtatatctcatgtagaagagaatttgtgtgatgtgtttagccagataattgggagttttgatcctagcttcaccttcaactggctataatcaaatgtctaaaatctcattttctctggggatgaaaaaaaaaccctgaaggtcgtcttaaattttcattagatctttaaccagtttttatactgaaagaatctaatcaagtgaccatggattgagttgtcagtggaaaggaataaaatgtaggaatagaggttactactctggatcaagaagtaggccaattttctttagcagtttttataaagattcctaagatggtgaagtaaagtgaagtttctaactgagaataaaattaatcctaagctactgaaatgctaagtcagtaaagaaacattttaggaggttacacagttgtgcaaaaaaaacgacatggtttttgttatggcaattataatactatctactcaagtcttgaatttaagaatgtttttaattgtagtatattaatgcagccacctctcttctccttcttacgtacacaagcactcttctcatcccaactccctctagaggatggatgggctctgtctatatgaaggtcatgaggaattaccacacactctggatcacccattttcatattcctggatggatggatggatggatgaatagatagacagacaggagtaggaggataaaatgactttaaagaatggcattatattaggggtcaggagacaggatcactgcatgctctgtactcaattccaccagtgagtatggctatttaactaagcctcagcttcctcgtctaaaaaaataaagataatgataataggacctaactcaggaggttttcatgcaaataaaagttagttagcatagtgctttgcagagattaaacttttaataaatgccatctcttgttgctattgttttttttatttttgttttttgagacaaagtctcgctcttgtctcccaggctggagtgcgatggcgcgatctcggctcactgcgacctccgcctcccgggttcaagcagttcttctgcctcggacccccgagtagctgggattacaggcggctgccaccacgcccggctaatttttgtatttttagttgagacggggtttcaccatgttggccaggctggtctcgaactcctgacctcaggtgatccacccatctcggcctcccaaagtgctgggatcacaggcatgagccactatgcgcggccgactcttgttgctattatttatgaagtaatagtaatacaaaggaagggaaatgagaaagaactgaaagctttctagagcatatatcaaggagactgagaggaggcatggattaaaccagagctgatgttaacagcagtctggaaaggtacaggtcttgctaacctggcttctgtgacataccaaatactgagctgaatggagctgagtgtctcttggttggctgttacatggtagtagccagctcttttttgcaatagtgtcatctcctttgaagtacctgagtcttagtgtatgttgcttacatacctgtatgcaccccttcctattgtgtgtatactcacacacatacatacaagctacatttcctaactctacccatctttcagtgctctacttttcccaggaagctttcataaattgctcagctataattctaaaatcgctaaattactttactctgcatttggattctgagttataactgtattgctgatattgttcctcagccagtttctcaatcttgactatgcattggaatcatttgaggaattaaaaaaaatactcatatatgagctctacttccagggattctgatttaattggtgtagggggaggccttggcattgagattttttggaacttctcaggaattctaatatacaatcaagggcgagaacaactgctctaagccgagttaatttttggccttgttcaggtcacgtctatttccagtggagctatgcaccaaatatttgctgaattgactactacttgattgtttcagatagaaatatggacagataatgtcttctttctttctttctttcttttttgagacagcttcttgctcttgtcacccaggctggagtgcagtggcacgatctcggctcactgcaatctccacctcctgggttcaagcgattctcctgcctcagcctcccgagtagctgggagtacaggcatgtgccaccacacccgactaatttttggatttttaatagaggtggggtttcaccacgttggccaggctggtcttgaactccttacctcaggtgatccacccgccttggcctcccaaagtgctgggattacagccatgagccaccacgccgggccatgtcttatttctttagccacaagaatatcacatgttgccagtaaagtcccttcatcttccatttttacaaggtagtgtcagtgtccttgttttacaaattccctttcgtctcttttttctgatgtggagaattgcagaaatatgactttgaaaatgttactattaccacctctacagcagttaaattaataatgtgcctgctaaacagtggcacatttaaaagtgcatgtgatctttttagtgtttaatcattttataatgtcattgtatatacttaaaagagctgtgatctaattaaaagtcagttgctgggaaaagaattgacataaagaaatgcttttattcaaatgaaaatccatagaaaccacctcaagacttgagggatttcagatcatattgatattcactgttatttctaaaggccattggtataaggttttggaagacctgatcgtgtgtctttaactaaattaattagaactttcaaaaagtacattccttcttggtggcaactcaagagagatggtagagcccctctctcaaaatgaatgatcggaagattgaggtagtgtttctcagatcacaccacacaggggcaaaaccaggagtaaaaccaatgccactccataatgaatctattaatagaagatcaatttgttggtatgggaaatttcagctgttggacactttctacttttagaattgggagctgtgcattttctttgaaaactcttaagctgttttttgcttaataattattgagcttctgaaagaggtatccatttcacaaatagtgtgaaaggcttgccttttgcccctggcttcagcatatgagataaaacaaatgttaattttatttttacgggcagttgttgggtggtaaagttttttgctttggttatgattattatgcgttcctatacttcctcctttttttccaataataacttattattcaaggaaaaaaaaaacactttaaatctttttctgaaactattttccaaatttatttttctttgggacactgagaataagatgtgataaaaaggcctagtttccataatgatttgtttacaataaaagccaatttggggcagagctacatttagaaacatatataatcctcaatatgggaatcacatatttcatcatgatctcaaatatattctgtataaatttcatgacaaatatatttaaatattatttaaataatgtttgataatatttaaacagtaatattttagtctatcagaatttattttcatcaaatgtcatagtcatagtaagcaacagttttgtgattcctgggtttgagtctcagctctgctcttttgagaccctgaaaattcatgttcaaatttatctttctctgtagtttgagaattcctttcacagtatgtgcatgaggacgaagaagcttgggttgtgagaggggctgctggaaagagctgttgggtcagtaagcaaaagttggctatttacacatctattgccaccacagccttggtgcagaagggaaattcctatcagtaaataccctttccggaagaatacatttctccaggctctgctacagagctcagtgacagcctcataactgaactaggggagaaaatctcctgaccatagttttgcggtgtggttttgttccagaataagaatgtgaagatcatgtacgataggtagatccaatgaccagttgtaccttgttttattttttgagtctagatgagggcagcaagtcccttagctcaggctctgagaagtgattaatgaagaaaagaaagatcagtcttcaaattgttttctttttaattgagaccagtgagatcagcaaagtcttatgtttacagttggtacccttggccttagggactgtctcaaaagtggttgttctggtcatgggattaagggaagtgcagtgcagcccttccccaccactggaactcaagtccccatgacagtggtcaggtttcagaatcatcttccagtcccagtgcatttactagactaaaacaattatagaaacttggctagggagtaaagtttgagctgtcagtcttaaaataagctctttaggtggagtcaggatattatggcagaattataatgttttcaggaaatggaagatgaaaataaaatatccaaagttaatctgatactctgaagtgacatatacatataaaacatcctttcatattcctatccttaattggggaaatcaagatactgacaaatgagccgagaccagaatctaaaaggtaatgactagagagattgctcatgttatgcaaagtgttcaaagcagtgcagacatctagcttcctttgaaatttgcaggccttaaattaatgtgtctgattatttaaagtaggtgataattaattccatttgtgggttctccttgatgactcttaaaaagacttgcttctggattgggaatagctgcccatgacctggggagattttaccctcctggaaatctggaccgtaatgcctaaagcatgggatatttttgtaagaagacagccaaacaatatagttaatcaccctttggtcttggtgttaaaatatggtaacattataagattatttttccctttgggcatatttcttaggttggcagagaaaaattgagagctgaataaatactttgatgaatttagacaaataagccatttatttacggccagaaaatagaagttggctgtttacattaatcaagtaacatagagaattgccaaatttgccatttcacttcattatttataaattatcctacttagattgtatcttttgaaaatttaattccaggcagatagtttggtatgcaattaactttattaattcttggcctaaagataaattatagctcctattttttgtgtattcataggctcctaacatattatatccatttatttctctgctgttttgttctaactaccctacttgctcccatttcaccaaaattcagagcctagctatggtcctcaccttctctatgaagtgccccaacttccctggggacttgttttataattttcttctcccccttaaaccactaactttggtgaaactaagtcatgtgttgtggtatgctgcctttttgttttcttaataatcttgttcaggactgttgcctgggtcagcttcttgagagcacaggtcaaatttgatcttgtctgttttcctgaaagcagagtgcacagtaccttgccagcggcagctgctgctgaaccagtagagatgggaggttggaactccggagtgacagaaaggacagtttaccattcatctggtggttgagagacagcctcaccgaatcactgttcatttattaatttacttgtcagattttaaaaagattttaaaatgatattctgaatgagaaatcattctattttatgagctaattttcatgtacaaacatgggctactaggaaaaaaatacctctagtgaatctgacatctggatatggggtctggtgctgctagattttgaagttcagtgtaggtgattggttggagatatttttgtttcagtttgaatgcatctgtgaagttgttgagaattaggatgagattcagaaaatagtattaaagtaacatgaaatttataattctcttctccctttccccatgtatttttctgagtattctccttattcccatccagttctatgtgatttcaaatatttagctccccagtaaagctgttgaatatggaatgcactagttttaacctggttagcagatagattaagattttctgttacacctatttgtttcattcaagcttttttttttcttacttgaaatatatatatgtgtgtgtgcatatatacgtatatgggggaattgtataaaaaatatatatatgggggaattgtataatctagtgtttaaagaatgggcctctgtgtcagagacttgattttgaaactttactctgttaaagtaagtcttaatgtccttttcagtaaaatggggaaaacaatatctacatacggatgttaaatgagacaatccatgtgacacataaagcatagtgcctgatgtggtgaatatttgttcagattagttgctttattgttatttgagattctcctgtcttcatattttaatccagtattcttttacattcatctagattgtatctaaatttgtttagtttgatcatatagtcaatatttatgaggaatgtacaactcggattttatgaatctgcattctcattctttgtcatgttagctaaactaattgtattttcattaaaataaatgtcactaatatattggctatcttgtaatcagtacattttgatttataagaaagtcaaggaaaactagggaaaacaaaaataacatttttatgattataaaattaatgtttattgcaggatatttgagaaatattgaaagtacaaacaaaatttaaatcttctggaactccacactcaagatgcagacaatgtcagtatttttgtgaagttttcacagtcaaaatgccaaagttctacaagtcttttttcttaatttaggaaatgtttttctttttctctgtccagggctgttcgtggtcagttatatttgtggatctcgatgctcacaatcgcaacaggcaaactttgtgctcgctgttacccagagaatcaagatcacatgtgagacatttaataatgataaatttaacatgaactattgtttatgatttctatgtagttatatcttaatttccagtaaagtactctaaaatgttagtgatcgtccagaagggataagaggacatgatagatattgccccttactcctctggcctggggaggtcttagcaagtggacaagagttgtggacacggctgctttggcctttgaatcttttgcaggagaatagaaaaacagacttttcttttgggggagtagcaacattaggccaaggtgaattatttttttgccatggtatattagaaaaatatttttcatagtgtatatatcttttggataaaataaccttccattccttatttctgttctctcattcaattcactttttccccttgcctgatcaacttctgtatgcttatcctacctgattgcagaattttctagggactatttgtggttctgttatttagaaaacacccaaagtggaataatttagttattcaaaacaactcttttatgtaagtaatgtaagattatcattaaaaaaaaaaaagctccccaaataagcaaataatataatacccactcatgccactactctaatacaatcttgacaacatttgggtatatatgttttcacttatttttagacatatataatatttttattttacaaagctataagagtactttttatattgattgataacctagctctgtgaatggatattggatattgtcccataccagtaaacagatttctacaatataaattttaatagttgctaatttactcaactaattgttggacatttaggttgtttcctctttttcattattataagcaaattgttgtgaaaaactaagttgtgacaactgttaaatttttgcgcaccattttaattaatattttgacatttgagcccgttgaatcttgaaaatactatcaacaaataaagttttatctcctctgtaaggtttcctggaacatgccatagaaacatctgtctgatcctgggagcagagcgtgctcacttttgactgcataacctcactggcttttcatctctatcattctccttgggctgtgttgatcacatcgctgtggacactcacagtctctctttctcattgcctccagaatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaaggtattaaaaaatattccatggtaatcgcatatcagagcaatcaaaagcacagattcaggagactgaccattgggtttgaattctggctctgctacttactagctatgtggccctgggccagttaattaatctctgtctgtgtttaattttttcatttgtaaaataataatagtacctatatcatgaggttcttatgacgattaaataacttacataaaagtgcttagaatagtgcttggcacatagtgaatgctcagtaagtgttagctcttattaccagtgaggtatttactgataatgggccatgttcatttattgggtgaataatttttctattgcattttcagtcctatgtttgcctgatccatactatttgtcttatataatattaaatacctgtttgtaatattcctttcattctattaagcaaattcttttattaaaactgataggccattccatcttcccttatctgtttcatttagacactttcttttaaaatatagtcctctaaatgtttagttttaaaatattttgtatttcaaaacacatataccactatatgtagttttatactagctgcttttaagccatctagaaaatagcaccccaaaaaagtaagaagtcatgcacattgctgaagactttgctttaatgtagtgtattgaaaggtattttggttttttgtttctttccttttgagatggagtcttgctctgttgcccaggctggagagcagtggcatgatctcagctcactgtaacctccacctcctgggttcaagcaattctcctgcctcagcttcctgagtagctgggattacaggcacatgccacaatgcccagcccagctaatttttttgtgtttttagtagagatggggtttcaccatgttggccaggctggtcttcaactcctgaccaagtgatctgccctcctaggcctcctaaagtgctgggattacaagcgtgagccactgtgcctggctgaaaggtattttgtatgcatgggcataattggctcactcactgaaggtaggtaaggtccctaggaatctgtatgtagaaaatatgtaggcaacattataccttttaagttgtttggcaattaacatactattttaaaatttaacatacacttttgcagaaaaactagacaagctatttatcattttatttaactttttttttttttttttaatagagaccagatctccctatgttgcccaggctggactggaactccagggctcaagtgattctcctgcctcagcctcccaagtagctcggactacaggcatacaccaccacatccagctttatttaatttcacggttgactatcacttggaaaccattttattgtgtgcacttttgaaattttagcagtgttggcagtgttacagtctgttaggttgggccaaaagatccatttatctcttaaacaccttcaaatgtttctttcctatttaatacattttctgtgccaatatttacagcacttacatttgaattggaccacctgcaactaactaccacctcgcacacttccaactttggatctgtccagcaagctttcttgctttggatctgtccagcaagctttcttcaccttctgctgagcaccactaaggaaagccacagcactgtgggtaggagctgccccacagtcaggagatctttcttggttcagcctcatcattgctgtcggttcttgtcagtcctgctatctgactctgccaggaactccccatgaaagcttttccagctttttcctgtttgtactcaagttcgcagactttcctttttattttctacttgatagcctttcatttctgcatggtctcctccactgtgtctttccttcatccatacttacctccatctctcttgcctcacagaaggagctctctgttctaaggctaacccatcctgtgtataccccatcctattctcttttcctttcttgacaccctcacttgttttcttctgtgatagaaggatatctatttctctttcttttttctcctcatctccatttctacttctctgtcttgtttccccaacttaaattagcttttttcgtcattaagcacattgatgtttatcattaagaaaccaaacgaaacccttcctcagccctttccctgtccacctccatcctctttctcttggtgccacacatctgaaaagcatggcctctacttggtgtctccttgtttacatcccgcttactctttccccttacaaactggcttacttctgagcactccccagtagctgtgctggcttcaatccatttacattactgagtcggagtggatgcttttctgatctcgtttcacagaacttggcatttgagtgtctttgctgagtcttgtttgttggaacattctccattggctgtgacccctttctttattctccacttctctcacttacttcttagtctcctttgcaggttcctcctcttctgccccctcttaaaccttgctcttctcctagggcccatccacagccctagctctcttcattctggctgtgaactcttagcttcagctatagctattaaccacagatctccatccctaactcatacctctcctcaagtgcccaccccctgtatgcagctgccttgtgaacatcctcgcttagatgtcttacagtttgcctgtattcagcttccactcctgtgcccgagccctatacctgagagtcattctaggcacttccttctcacccatctacctttgtcaatcaccaaggctggcagatttagcctcctaaaaatcctaaaattctgttttttcctctctattactccctggtttaggctagtggatctggggcgattttgccctccaggagacatttgacaatgtctgcagacattttgggttatcacaatatagtaggtactactgacatctggaaggtagatactaggaatgctactaaacattcctgcaccacacaggacagcccaacaacaaagaattatttggccacaatgtcagtagtgctgaagttgagaaagctcagtttaggttgtcatcttttctctttggattttgctccagcagaattccagctggtcctgttttttgccctacaactctcttcggtattaccagctgctcagtctagcaagtaaatataatgagtaaatttgatcctgctgagtattcacctgtggttctcttttatttccagaccaaagtcttagctacttagcatgacctgcaaggcccttcccgatctggctggcctggcccatctgttgggtttcagttttcactacttcgtccttgcttattgcagaaatactgaattgctggtagattctttaacatactttgtgattctgtgcatctgtggtttgtaactgttacttcctttgccttgagttaccttagctcatctccccagtgaattccatccagcgttagctgaaacatctcctttcctgtaaacattccctgattccaaggcagactcaggtgttccactccctatgagcctgacataccatgtgtagatatttcctactgcatagtagttgtttatttacatgctggcctccctattaggctgtgagcctctgagggaagttctctgtcttttgtcttagtagctctctgtctagttggttccaggcattagtaagtattcagtaaatatttattgaaggactgcagtttgatggactgaatgagtgagcttttgaataataagatctgaggaaaaatttttttaaaaaaaggacaaggaaactgcttacaaaatcagttcaactttattgctataaacaaatctttgacatatcgcctaactatagttcttctaatgtaattgttagtggctggccacagtggttcatgcctgtaatgtctgtaatcccagcactttgggaggccaagataagaggatctcttgaggccaggggtttgagcagcttgggcaacagagggaggagaccacatctctgagaagaaagaaagaaagaaaaagaggggggggagggagagagagagagagaaaggaaggaaggagaaagaagaaagggagagggagagagagagagagggagggagagagagagagagggagaaagaaagaaagagggaaggagggagggagggagggaggaagggaaagaaagaaagagagagagagacagagatagccagatatagtggtttgtgtctatagtcccagccctcccacttgggaggctgaggcaggaaaaaggatcccttgagcccaggagggcaaggctgcagagagccgtgattgtgccactgcactccagcctgggccacagagtgagatcttgtctcaaaataataataataatttaattgttagtgtaaaatttaatgttttattttctgttttagctatttgatggcattgaatgtgaatttcccatatttttcctttatatgatgattgatggtaagtaagctttttcctgaaatttaagcaagctttttcctgaaatttaagctgtaggatttaagtggtttaaagaagagcagaaataaattatgactcttttcagctagaaaaatagactgcgcttcagtgatgttaattgccctgcatttgtatatactactcttttgctttctgagtgaatgctaaatcatttaaagaattaaaaaaacacttggaagcatttaaaaaatgatagcatatatattttcttcatatttacaaagaaaaatttttattagtagaaatcattaatactgtaatccatgataatgtgaatgtctgtaacatttatacttaggaatagggaaaattcaattaaaattcagttttcaattctaaatgctaacatgactttctaaaaccaatttcttggaaaaatatcacacagatttgcattttttttccactttaattttaccattggcatagaaaattaccaaaataattgtaactgggctaatatattttttctaaggtaaaatttttgagatccttattaagctcagctgctattggattttatattttatattttaggagtttttagaggcaatcctaagcaagtacaggaatatcaggatcttttgactccagtacttcatcataccacagaaggtatagttgtttttttaagaaattcttcctaccaacatttcctgaatgtttatttgaaatgtataagtgagtcctttgtaaaaaacaataatttgtattaaattgaaaaaaatgaatgatccctgatatgaaatcagaaagaagattaagcaagacaaagatggaaatgaatctaggtggacatggcaatagtcattccaaaatagtttgtcaggtggactgagttccttcatctgttatttactatgtaactccattactctgtatagaaagtgactagtttttatacaggtcaccaaaaatgctatagtcaggtgagtgcccctcctgcggagggctacctggagaggttctgctcttgtctaaaggcactagaattgccgagaatattctggccccctctttggagttttttctggggtccttagcattgtattttgaacatctgccatggtgctaaaacatcgtcctttgaggatggatttaatatttgagaaatggtcagaaggcccagtcttaggagtaagggtatattggtttcagtcaaacaccagcagggaccctcaaaaaacatagctgaattttctgtataactggaaaaccaattttcaaaggaattccaaatgagatgttctagatgtctttggggctttaaagtattgacaatcacagcagtgagccccattcctatctcacatgaaatttgtgatattctttggggttttccacagatatctcagagtaaatacttaatattatatgctcactaacatgcttgtaatgttaaaagttgtgaaatgtttatggataaacattgatttcaaagtgaatattaatttttaaaagttatctttgtctttatgctacaaataatcacttgtccaatgtgagaaataatgtattaaattttgtaatgcatgtaatatttgaaatcctttgaagcagatcttttaatatttagtattagatctttgatgcattgagatgtagtagtttaatgtacctcacttcaggcttcatcatgttcagagagtgatgttcaaagtattatctgtatatcatagaccttcttactgattttagacacaaatattgttgattgatatgtaaggaagcaaaattttagggaaatctgtgcaatttcattagaaaaattaagtttactgtgggctaatattgcaaaaagtctcctgtagcatcctacatagattgttgattattttcccattatatcatccacaaagattctactattaaataataattttagttcctaccaacccatttttaaatggtcacgggggagatggctttttctcttcggtgatattgaatggtagataatgggcttaatgtttaaatggggatttctttgctctagcaatggctcagagttataattcttcatttaagattacacagtatctcatttgtgaagcttctacagaataatcctattaaaaatagcttcctctgtggctctaagtatttgcatactgtgtatttgttgattcatttaaaggtattaaaattaaatgttgttgagggagattatgtactcattgttagccaaagcataacaatctgctgttgaattagtgttttaagtcaatttttttctccatgattttcactggcaatatctgaaaggaaccagaatatccagctttctatagcttatcaaatctgttgcctcctgtataagaattctctctccctgctttctaatcattacagtgtcttgaagggaaattttgggaaagacagtaattttgatatggttcggctgtatccccacccaaagctcagcttgaattacagtaattcccatgtgtcaagggtggggccaggtggagataattgaatcatggggggcggtttcccccatactgttctcatagtagtgaataagtctcaggagatctgatggttttgtaaatgcataagccctcttgcctgccaccatataaaacgtacctttgctcttccttcgccttccaccatgattgtgaggcctccccagccatgtggaactgtgaggccattaaaactccttcctttataaattacccagtcttgggtatatctttattagtagcatgagaatggactaatacagatttgttatattttaaatacttatttttaaactccataggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctgggtaagtggagaagattgggaatggtatttttttccttgttattaagctattagaaataaatatgcctttgctggtgtttatgttggatttgggtggtgtttcatggtcttgagaggtctttagggagtttcctagtatctagtggtatattaatatatctatttcactgaatgatgatggacagtttctggaaagaaagcgaaataggtatgggtaccatttgtgatcatttagggggctgcatttggcttactatataggtttcctgcagaagattatagaaactttgagttacttttatatgatatattaaaaattctgacttaagaaaacagtaacagtcatgcttggtcatacctttagtagaccacttgccaaaatgtattggtcatctcaaagttcttttctttccaataaatatatattggcaattttagttggaggtttaataggaccattattcattattctttgaagaattatttttcatcttctcctacaacttgaactgaatcatagcactcttggacactttgaaatgaagacaaatttgataaacacagaaaaagcattatgcattcttcctgcaaattccttgttcaaattttaaatgttgttagcatttacatcaaaaaggctatcactttagagtcagaattcctttatggcaaaatatattgaaataggctaactgtaaatactgtacctgcactaaaataactgcctactgtataaaatactgttatgatttttgttgtttctagcattactgcataaatgctaataaatttgtgccgtaagagtaatcatcttcggtttttaaaaaaatattccattagggaagaatatttcacaggacagatttccaatttgagctttacataaaatgatatgtaagaacaggcagaagctaaccaaataagtgaaaactaagttaatgctgttttcagtttgctcctttcctaactatattttctgggtctccatatatacctaatgctaatttaagaacatgaagaaacattttcttcctcctttaaagggacagctttttgacaaggtgttgatattatttataggctttccttttagaatttccaaagcgggggggaaagacacatgaaatagttttcttttttcttttttctttttttttttttttttttagtgattccgcttttaatttatagtcgtatgactaagatgttttgaatataagcctatccgtatgccagatataaatttcaggaactcttaatgtctcttttacagaaactctacctctatcctgatgtaattaggttaagaaaattaaaggccacggtccagaaaactaacttccacaaatgcaacaaaaggaaaaatttctccagtaacctctgtgcaatgggaaatctttcttttaagtaccaagtcaatttcttcaactgtacaatgtattctaatttgaaggttttcaaatataatatagtaacaacaaaatataataaaattaaaactatcagaaaacagagtaaatggtataattcaaataatgactaaaataaaatgacattatggattttgtaatcaacctataattatatatttaaattttgctttacatacataagatcacagctgaggttaaccataatttcaaattttatcaccagccacttgtgctattttatcacatttgaaaatattcactcatattatttacctcaaacagtgatctataaatttgtttagactataatagttaaggaccttttcttcttccagataacttgaaaaattaaatgatgtattgaacatactactaaagaaactttactttttgattatggtctctgcattgaagatctgtaggaatttttctttaataattttcaaatcttcccatgacctctctgttcatagaaatatcatctttgaaataacctgtgtgaatactttataaatcaaaaatggattcacatgaccatattaccataatcaccaattttaacactctcctacatattttctatatcacttttcttgattataaaatgtcagtaatatgaacacgccctcgatatagcagaatatttaattacatcagtttcccatcaacacaccaaagtcacttaataattatattggccatttccactgatcggcaggaggctcttccactaatggcgcccatggtttccactccctcatttttcttgccagatttagttcatgttcagcctaaagaatcacctcttctaattgactgccttgaagttggtcttctaattttttaacatctggttccgctttaaccatagccagcttctcatttgtaatctgttctgtatactttctatatgctgcatttttagggatttcctcaagaacgtcaagaatctttgtgtacaatattcttagcctctcatgtggagtattgcacacagccaatcccacaaggccagtggtcttcttcagcacaccctccctgacagcgccaacgattcgatcaacacatgaaatagttttcttagaatcaacccaagttgggaaggttatctctggttagaatgttatttccgtctcactagcataattacaaagaagctttgttgttacagttaagtaaaacatattttagtagagtactagttaacttatgtaaggataagaattttaacattagaattataggtttttatgttctatatttggaaattacaaatgagcatgaggaatttttttctgtgattctgaggctaaaaactggcacctgggatctgggatatgaaattaaaaccttctttatcctgctttttgccatatatccagcctgggtttagtacaactagaaagaatgttgtttgagcaaagcctctagataaaattgacaaggctagtgaattgagaaggtggaattgactacaccctacataagcaaattgagctttaaaaaaagaaaaagattgacaatagtatcagtaaaaaagcattgaactttccgtaataaatgtgttgaatgtagacaggtcttgagtgaagatagtattttctcatattaagaccagagtgaacagaagtagtacaggtcatgcctccatttctgtttcatgaccaaaaagaagaagaaatactgcagagctgccgttaaagaaagtcagtttctcttttccctgctgatcttctgaaaaggcagtgagaacatgaagaaggtattttgcatactatgaaaccacatacatatctccagctgaaaaaaagaaatattgcatattcattagtagtctagcctagctttgttatctggttaacaacccactggttaagacaaataacatctcagaaaattgaatcatttagttgctcttaactgttgtatactagccctaagaaccatcagacttctatggattttcattaagattccagatacaaatttacttaaaaagtctttattcattaaaggagcctcagctggatctctgcttgacaacattttgtggacagctaattgtggttactatttttacatgaaaataatataacagtgaatctttaaaaatatagtatatgactttcactaattcaggccagtttgtatctcagtgaagtctaataatattttgctttatgtatgcctaagtaaataattatataacaaaactctgtgacttctattcaattgttaaagaaaagacacagtatgctatttcctgaaccaaggcctgaactccccactgtgctcttaaaaaataagttaattattcacagtatttccttttctcttataaaatttatacttttagaaaatcaatattttctatatagctggtaaatatattataaacatgtacactttaaaccccgtaagacgtatcttaagatatatttgacgtgtcttagaataaaatggtcattagttatactttcaactgttattcaaatttgaaagtttagaaaccattcatgtaagaccagtctaaagaaagcagagtacctttttgagctatttgcaaaaataaataaccttaaaagtacagtcattcattgcttaatggtagggctacattctgagaattgtgtcattaggtgatttttagcctacgacgtacctagcctatatgatatagcctattgctcctagactataaacttgtagaacatgttactatactgagtactgtggacaattgtaacacaatggtaagtatctgtgtacctaacatatttaaacatagaaaatgtttatacgtgaagatgtctatacatgaagatacagtattgtaatcttatgggacatctttatgcatcatcacatgattgtatttattgcattaaaaatcacttgaggctgggtgcagtggctcacgcctgtgtcccagcatttggggaggctgaggcaggcagatggcttgagcccaggagttcgcgactagcctcgctagtagatgggactacaggtgtgtgccgccacgcctggctaattttttgtattcttagtagagatggggtttcaccgtgttacccaggctagtctcgaactcctgagctctgcccgccagccatgatggtgcatggctgtagtcccagctactcaggaggctgaggccagaggatcacctgagccctggaggtcaaggttgtggtgagccatgattgcaccactgcactgtagcctgggcaatagagtgagaccctgtctcaaaaaattgcttgaaaatcttgatgtttgaattgaaattttttttgagattcagaaaactaaagaaatataaagttaatgataacattactctaaaaccattagataaccattataaaggccattatataactttaatatatgttcttattcactatgtcctaaaaagagatactaacatatcagcttttaaaaatctgacttctagggccaggtgtggtggctcatgcctgtaatcccagcactttggaaggccgaggcaggcggatcatgaggtcaggagatcaagactatcctggctaacacagtgaaaccccatctctactaaaaatacaaaaaattagccagccatgatggcacgcacctgtagtcccaattactcaggaggctgaggcaggagaatcgcttgaacctgggaggcggaggttgcagtgagccaagatcatgccactgcactccagcctgggtgacagagcaagactccatctcaaaaaaaaaaaaaactgacttctagacttcagcttgtcttttccatatatgcaactaacttttcttatcctgtacatcagacattcatagtgatgatcttcattcaggtactactacattatcccagctcattaaagattagaactttacatattgtataatttaaggcaggtgaatacaataatttttttagggtggatattttgaaaacattaataaacattaatggttaaaacaagatatattctcttggtaaacttaaatattaagcaattttagttaactacaactttctctccaatatacacaaactcccagaatactcaggttaatgaaaatttgcttgaatctcacaacagaattttttttaagagacaagagagtttcactctgtcacctaggctggagtgcagtggtaccatcatagctcaatggagtcccaaactcctgggctcaagtgatcctcctacctcagcctcctgagtagctgggactatggccacagatcaccatgcctggcaggatctttttcttttggggatgggtattatttaatttccttggaacactaacaagctacttttaaagtgataaaatggatatagaagtactttaaaatatccaaagtgttatatatatacgaagttcccaacttaatttcttgggttcccaaagttctttggtaagtgattgtttggaagccaatttatttttcctgtagaaattatattttaaatgattattaacacccagcaaacttgtaaccatggggttacagattatttctctgacattatcatctttttcttctactttctccctccctagcttctcttccttttttttttttttttttttcttttcttacatttttcctgtgctgtagtgaaaggtgaagagtttgtggattatgagcttaggaatcagacagtccaggatttgaatgtaaaatctgccacttactacctgtgtgatctgagttttcttaacttccatgagcattaattttttatttttatgttataaggattagctggtaaggaaatacacataaagcatttactatgggacaaatacatgtttaaatggttcttccactttctgttcatactttaccattcatctacttgttgatctctgcttctatttatagaggcctactctttgatagtgactatggatatccagtagctcactaacaagagttataggaaatacttctctctgtctctctctctctctctaagggcaacctaattattctgacaaaccacttcctaattccagtgtatgtaacaaaaataagtccttttgcatttgattttattcatgacatttcttgcccaattgatctcaaatataaaagctactgagtaaacctggaaatctaatgctttttaaacttaaaatcattcatcaagtgtcccctagtgtatgtatataaggacataagaaactgaggtcttgattttctttgatctgttgtcttcaaatgcagttgactcttcaggatagcacgtggttttcttactgctccgttcaagataaaatgaatagaaaagagtgtacaggtatatttttacatgttggttgctaagagatttcccagttgttgcacttcaggaaacttcaagaatattttcattatctttctcatgttacccatgtgatggctagtgacctaaagtgggatttctgtgcagcaggcattataaacatcgggaagcacatgtagtattactttaaaggcttcacctgggaagactttctttagctttatgtataaataactgactttctttttttttttttttttggagatggagtctcgctgtgtcgcccaggctggtgtgcagtggcactatctcggctcactgcaacctctgcctccagggttcaagcaatcctcctgcctcagcctcccaagtagctggggctacaggtgctcaccaccacgcccggctaattttttgtatttttattggaggcggggtttcaccatgttgcccaggctggtctcgaactcctgagctcgggcaatctgcccgccttggcctcccaaagtgctgggattacaggcatgagccaccacgcttggccaataactgactttcttatatgtcacattctgtgctctgcctcttacaaacatcatcctaagtaatcctcctaacatctctctgagatgggtactatgtggcataggtgaggaaactaaggcccataagagtttaacaactcacccaaggttacagagctcatgactagcagagtttattgatttatcaggagtctacagggtgcttgtgtcacctgtaacctctgtggcattaaatattcctattaaaagcaaaaacattgctaacctaataagataataaattgagtcttgttttcatttatattctgactattagaaacatatttcttagtcactcttctgtgaattgtctagtaattttttttgcccatttaatcttggttttatggtttttcttatcagcctacatgaatgttttatatattaagtgtataaaacctctctgatattttcctagtttgtttgcctttaaattttgcttttgctatattttcatgagcagaagttaaaatctttacacactcagatctaccagtgttttcctatttagtttttgctgtggaatttaccatttaattttagaaagtccatccttgttaatcagttgactaaaatgcatacacacacacacacacatgtatttggaattttctggtataatatgaggttaaggatctgcattttctttttctccaaatagctcatttcataatacatgtgttactaatatgtgtcaccacagctgagaatcagctaggctttgaagtacataattttaccctgtaagtatctgctgagcctattttagtatgtcctatgtaatttttgtgttatgacaaaaaatacttgctctgttaagttttctttaaattattatttcattaaagaaacagatttttcttaatattttctttttacgctggacagtttttgcttggggtgagcccagggtatattttataaaccttctgtgaaaaaaaaattaattaacttaattcctattttctaaggatttaaagacagatatctccattttgtagaaattcttgattatcttggaggtgtggtgctgtactgtaaatgtagaaagccattatctcttaccctcgttcttttattttcatttgaaatattctgtagtttgttggatataagttctttcaggattgtcactcttcaccagaaaatcagtttcattgaattggcacaataaagaactctatttttgcctcctgaatgataaaaatcaatgcagtggggaaaaaatgtgcccataaacttgaccttttaatgatatttctcacatttaccattatggaaattaaagtaatgattatggcaattagtgtttctgtatttgctaaccgactaatttattattctgcttagtaagtgtattgagtgcctactaggtgctggtggctctgctaggtactgggcatcatgtataagaagcatacagtctatgagtttatacatgagcacgtggtgtaagtgggaacatcaagctagatgaagtgtggcacaaagagaaacacgaaggaaatgcaaagaaataagcttttggaagacttggttaaccattcaattcttaccaattttaatagattagcatttatgctttacaaggatataaggtttcttaatttatctgtcactatttataaataacaaaatactgtaataaagatagaatttagtttctatagcatgacagtgaaaacttgttcgttttagaaattttttcacatctcagtgatcatacaattgagatacggaaataatttactgcctatctagaatatcagtgtactaatcaaccctgtatcatgagctaaactgaaattagtacattaaagttatatgtcgatatctgctttcattggtttggtttaaattttgaaaaagtgtattttttttttcagagagaaaggagaacatttgtaatatgcaacctgatttcgataggaaaaatgtaacatgtctaaatagttttttttatttcatcctccttctgctattattttcacctatgttatgtagaatgtcagtgttcttaaagggcaggattagtatgtgattaagagcccagactctgggagtcgactgactgtgtctcagctttgctctataccaaccaccaggaagttgcctaaacactcaggtgcctctggttcatcatctataaagtgataaggttgttgtgaggattaatgaatgaatatatgtgaaatacttaaaacaatgcctggagcttaataactgtgtaggtattgctgctgctgcagaggcagcggtggctctggcagactctgcttctactcttcctccttcttgttattctactgttaatactactttaattattattgaaaagatcttccaagagttactaaaatcctttggtgattttgtctcaaataacaatgcagatgtgcctggaagataccccaggatagaaatctagtatagaaatattcctaaaactgcaaataaatttataaccattggttccttgctctgtcatattcactacctaaaagcaatttataaatagctatggaaaatgaactgtaatctttttagtaaatattatacatgggtacatttatacaaaactcagcatagtattgtttttaagtgatcagtgtagagccaaagatcaagaatgaaataaacatgttttatagcttacatgcagtaaaaatgaagaagtgtgccgactcactttagaagttggatttttgtttttgtttttgttcaattaatttgcacatgtgtgagcataactaagataactttacagatgcggacttgctgggttggaaaatacgctcactgtaaatttgtgtagataactgacaacttgcactccaaggaggttttgcagaattgcatttcaggggcttttcctaccactaccacccctcccctgcatgttctcttccaggcccatggagaaatcctgctgtagtgagtgagcctctggtgctgatggttatccttcaagtgtgttacagcagaagacagcagagaaccacagacttagtgccttcctccccactgcctctcactctaaatttccatcctcgttataccctaggattttatcaaaagttgccataaggaactaccatgttaaaagggcttccatttttatagtgcaacagcaattgaggatgttgccttcatgttggtcagtgccccataaaaaaacgccccttctcagaaatctcttttagaattttgtatcaggaaacattatttcttaacaaactgatttccttcctattatttttctgatttttctgaaagaaatctgacttctttcctattatttttaaaatagctttattgagatgtgatttacataccatatattttacctatttaaagtttacaattcagtgatttttggtatatttatagagttgtgcaaccatcactgccatcagttttacaatgttttcatcatctccctgccaaaaaacctcatgcccagtagtagtcactcctcatttccttctcatcacttcaccctcttcccccagcactaggcaatggctagcctactctctaattctatagatttgcctatttgggacctttcatgtaactcgaaactgataatggacctttgtgtctggcttctttcacttaacataatattttcaaggtttatccatgttgtagcatgtttcagcgattcattccttttttatggcagaacaatattccattgtatatatacattacattttatttacccattcatcaggagatgaacatttgggttgtttgcacttcttagctattatgaataatgctgctataaactttatataaaattattgtttaacatatttttcatttctcttgggtgtatacctaggcatgtaattgctgggtctatgctaagtcttacgtttaacattttgagcaacttccagactgttttccaaagctgctgtatcattttgctttcccatcaacactatttgagggtttctgtttctccacatctttgccaacacttgttcttacctattttctttttttaattgtagccttcctaatggatatgaagtgatacctcattgtggttttgattagcatttcccaaatgactaatgttgtgcattttttcatgtgcttattggtaatttgtatatctcctttggagaaaagcctatatagacactgtggctattttttaatgggttttttttttctttttattattatgttgttatgaattctttatatcttctaggtgtaaatcccttacaagatatctgatttgtgaatgttttctcaccattctttgggctgttatttcactttcttgatggatcttttgaggcaccagaaagttataattttgatgaaatccaatttatctctttacttcttttatcacttttgttatgatgccatagttttgtctaaatcagtcacaaagacttacttctatattgtcttctaacagttttatagttttaactcttacatttaactctttgatctattttgagttgattttatatatggtgtgaggaaaaggtccagcttcattcttttgcatttgaatatccaattgtctcagcactatttgtcaataaaaaaactttttttggctgggcatggtggctcacgcctgtaatcccaacacttttggaggctgaggtttgaggccaagagtttgagaccagcctggccaacatggcaaaaccttgtctctacaaaaaacacaaaaattaaccaggcatggtggtaaatgcctgtaatcccagctactcaggagactgaggcaccagaattgcttgaacttgggaggtgaaagttgcgattgtgccactgcactccacctgagcaacagagcaagactctgtctcaaaacaaaacaaagaaaaatcctttctctccctactgaattgttttggcaccctgtcaaaaatcagttgactatacatgcaagggtttatttttggactctgtattctatttctgtctctatccttatgctaatgccacactattaattaccatagcctttgtcctttccaatctgatactttttattactttttctttcccaatttccctggctggaacctccagttcaatgttgaatagaagtggtgagagtggatatccttgtcttattcctgatccttgggggaaagcattcagtcttttaccattgagtgtgagtgtgatattagctgtagctttttcatagattccctttattaggttgaatacattttcttctgttcctactttgttgaatgctttttattcaaggatgttgaattttgtcaaatgctttttctcagtctgttgaagtgatcacatagtgttttcccctttattttgttgatatggtctattagtaattaactttgtgatgttaagccatccttgcatttgtgggatagattctacttggttatgatgtgtaatcccttctttatgttactggattgggtttgctagtattttgttgaggatttttgtgtctatattcatacagattttgctttgtaattttcttgtgatactttgattttggtattagaataatactgacctcttagaatgagttgggaggtgttccctcttttttgtgggtggggggggggcacagtttgtgaaaggttggttttaatttttctttaactgcttggtagaattcaccagtgacgccatctagtcctgaactatgtgtggatgtgtgtgtgtgtttgtgtgtgtgtgtgtgtgtgtgtgtaaagtttcaatcactttatgtactttttaccaagctgtttagattttctattccttcttgagtcagttttggtagtttgtgtctttccgggaataattcatccatttcatctaggttatctaatttgatggcatgtatttgttgatattattctcttataatcctttagttctgtagtaatgtttctttcttgaattcttgatttagtaatttgagtcttctttcttcttttcttggtcaatctagctaaaggtttgcaagttttattgagctttttaagaaactacttttgattttcttgattctgtattgtttttctatactgtttcattaatttccactctaatctttattatttccttccttctgttgcttttgatttagtttgctctttttcatccactgtctttttttgtttgtttgttttgttttgagatggagtctctctctgttgcccaggctggagtacagtggcacaatcttggctcactgcaccttccacctcccaggttcaagcaattctcctgcctcagcctcctgagtagctgggattacaggcacacacaaccatgcccagctaatttttttttttttttttttttttgtatttttagtagagatggagtttcaccatgttggccaggctggtctcaaactcctgaccttgtgatccgcccacctcagcctcccaaagtgctgggattacaggcgtgacccactgtgcccagccatctcatccactgtcttaaggtggaaaaataggttattgatttgagatttttcttctgtttaatataggaatttatagctataattttttctctgagcattgttttacccacatcccattgattttggtgtttgtctttattttcattcatctcatcagaaagtatattagaatatattttctcatttcccttttgatttattatttgacccattagttatttagtagtatgttttcatttccacatatgtgtgaatttataagatttctttctgttattgatgcctaattccattcccttgtggtcagacaatatactttttatgattcagtccttttctatatattgaggcttattttatggcctagtatgtggtatatcctggtggaggatgtttcatgtacactgagaaaaatgtatattcttctcttgttggagtattttctaaaagtctagttggtttatagtgttatgcaaatgcattttcgataatgtcattccccttctttttttcagctgatgaacttattagtcctaaagacattgatcctgtccagcgctatgtcccactaaaggatcaacgtaacgtgagcatgaggttttccaatcaggtaaagaattattctatttcttgatttagactcgtccagagacatttaagcttaattgaagaggaaatttttgttctgaataggtttttgttgttccttctgacggaaaggtttctccctcttctggttagttaagatttacttgtggtgaagggctatttgttaatgaggaagtagatttcagatgggtccaacaaagtgccttgcaggtaaacatttccatcttcagaatgttgagtttaaggtgtcaagtgtctttgagaagaagcagtgcatctgggtggcaggaggaccaatgactgaagggagtgggattccccaaaaggcctgtgcttgatgtctctcctgtgctgtggctcttgacagggctgcgtgactgacagttgttacagcaacagtgacttggtgacgtgttgggcaaggaatagttttaaaatttttacatttagtagctatggattcagactgtgttgtgtcaacaaaataagtgtttgtaggatcagcaagattgatactgacttgagcaaaccctcaagtattaaatgataccagtaatgaggactgttaaaatgagaatgttgtggattgtggaaactgcctgaagagaaagggaatgaacctgcatgtgtgcctgggattctaagcagttaacatgcatttaataagattggtatcaacgcttacagaagataggcttacaaatggaaatgttccttatatttaaaaaaaaatgtgtattatacacacaaacacacacacacacacacagagcaataagtgcttgttttaataagagaaagggagagccaacagccccgttagattctattgcactgtttctctgactcttttgctggtcttcaacaaaacatgtaatgactctgagttgtttatggatgagaagctatctgagagacttgtaaataaatgctatggttttctcaagaacataaaattcctgtgttaatatgtgatgaaaatttctcactggcctgttagctctttatgtaagggggtatttggcctttatcttagttaccgctcatgttggtacaattggcagagttgttctcagcacttggcgacgtgttggggaaggaatagtttttaaatttttgcatttagtagctatggattcagaatgtgtcgtgtcaacaaaacaagtgtttgtaggtacagtgcaagtgtacagtctgtactgatttgaaatacaccattttacttgaagacatggcaaaatagagaattcatccaacttcatattaccagtgctatgactgagccattttaagactaatgtgtatcacttaaatagtatttcacatgtgtgacccacttctctagagtgatgaaacctcaaagccttttcttagaaaataaattaataggtcacagatttgaggtgtgcagacaggagccagagaacatcaaagcatttcataggcatatggctaacaaaatcatcagtttaaacagttgtttcatgcttgacacatataatgatggctgtgggttatgtgtaaattttggtgtacaatatactacttgcaactctttctctcctgctcaagaaagcttatcaggagatgagtgactgagagtgaattttaaagagaattcactctacaggtatgttttatctcaaaattactttgtactgctgctactgaattatctgtgtcatgcctcccaagtggagccacatcctagctaagagaaatgctcctctcctgtagccacgtggcagattacctctgtgcagtgttgtatacagtttccgagagggaggtgatggggagatttgcagcaaaaaactactgggagtggatatgtccccatgtggttggcagcttggttgtggtggtatataaaatactgaagctgccttgccactttctcagccattttaagcagtaggcaagacctggcatgcccatgtctgttcccggggctgggtgaagtggactgatgaaatagagtggtcagacatatccccagatgtgcagccctctgtttgaaatgttggtgtcagtagccacttagtcatgattgaccaggtcagattttgtaactaactgatctttgggaattcactaggtgctttaaaccctaccacaaattaggaaagtaaatagggaatagtaaagtccaagcagtttctgaaaatggtagaagtgcttgttcccgaaagaaggtatgtcagggatcccatgactgccctcagccactgtaattcactagaggactcacagaactcagaagctgttacacttagacttagggttgattactgtgaaaggatacagaataaaatcagcaaaaggaaaaggcatggggcaagtcctgaggaacctcagcacaggcttccaagtgtcttcttccagtggagtcaaatgagatgctcttacttactgtagtgaggatatgtcaacacatgcatagtgttgccaaccagggaagcttgctcaagcttcattgtgtatagtttttactaaaggtcggttatgtaggcatgcagcatctcaattgtttaagcaccagccagccccacagggaaaaaccagatgttcaccataaaccacattgttagtgccaactctctggacaaactggtacactgtggcccaaggcctcaggcatgcaaaacactcttatcatcttgtgagtcttttactttttctcaaatgttttctgtttctttatttttggctatattttacattaattacattttattaaaattttgtgtaattttgtgtaaccaccgtcacggtcaaaatacttaattgtaccatcccatatcaccataaggcttccttgtgttattcctttataatcatacccacttccttcaccccagttcttaacccgttgcaactactaatccgttctttattttataattttgtcattttaggaatgttataaaaattgaactgtacctaaccttttgggattggctttttttcactcaacataatttccatgagattcatccaagttgttgcatgtatcaacagtgtattagtccattctcaactgctataaagaaatacctgagactgggtaatttgtaaagaaaagaggtttaattggctcatggtaatttgtaaagaaaagaggtttaattgtaaaagaaaagaggttccacaggctgtacaggaagcatagcagcttccaggcttctggggaggcctcagggaggttttcctcatggaggaaggcaaagcaggagcaggagagtgagggggagggcctacacatttttaaacaaccagatcttatgagaactcactgtgcagtaccaaaaggggatggtgctaaaccattcatgagaactccacctccatgatccaatcacatcccaccagtccctaccttcaacactggagattacaactagacatgaaatttgggtggggacatagatccaaaccatatcacatagtttgtttctttttattgctgagttgtacgccatggtatggtggtacctttgtttaaccattcacacattgaagaatatcctacaggttattcgaacatttcttagaattccactttaattattcataatgttcatttataatgttttttcatatatcactttttaagttttcattagttggttgttctaggaattactgtatacatacataagttatcaaaagtgcagtggtatcattttgccactttaagtgaattatagaaaccttacttcttccattagtttcccttaccttcttcatttcttaaacataatttttaaaaatatttcctctgtcttcattgagcagcacatcaaattgtgtgaaaatttttgcttcaaccataaactttgattaaagaagttcatgggatgatggatagtctattgtactgacctcagtttttaccatttatgttctttcctttctgaatgtcccagccttcttctgttatcattttctttctgtttggagaccttcctttagacattatttatgggtaggtctgctagcaacaaatttcttagttttcctttgtctgagaatatctttatttcaccttcattactgaagggtagttacgttggatataggattcctagttaacaattgttttacttcagcactaagaaatattgtgccacttcctctggcttccgtagtttcaaatgagaaattccctgtcagttcaaatttgtttcctctacagataatgccccatttcttcttgtcctaagtctccttatgccactgggtagagggccagaagctaccaggctcaggtgacatgggaggatcaacctaattgctgttgcccctgctgtggagcaggggtcgagtagacctgtcattgctttgaaccctctgcaggtgaattggactgcccaagggtacctgagtagtagaacactgtggagtcaggaaagccgtctggggcttctttgttgatgctgcaaatatgttggcccatcagcgctgtggttgtgaagcagaggttgggttggctcaccaggactttgaagttgctgctaaagacagattgattggccaactggtacctcagttgaagagctgagattagagctccccacttggtctctgttgtgctttgcatttccctatcctctggtgagagaaaacagatttttctttttttctatgcctattggttatttcaggctgcagactcctgcactgcccagcctagcatatgtgtagtctcaagagtctcactgcattgccattcttcaagtgctgaggcctctggccagtccagtctgctttctttccagctttcagaatcctttaatagttatctgtctaggccatcttgttcctacttccaatttttatagtggataatgtatgttcgtaagtctttctacaagtaaaaaagatttattctgttcctttactcatcttttttcttcagagtaattttttaaacaataatggctatcatttattgagcatttattttttaatagcagctttattgaagtataatttgcatcccatacaattcactaatttaaagcatgcaatgaaatggtttttagtatatttaccagaaccaattttagaacatttggaactattcagatactgcggccattttttaattgtttctttttattattgtattgtaacagttctttatgtattctgagacctttatatgattgcaaatattttctcccattctgtggattatcattccagtttcttcttggtgtcatttgaagcacggaagtttctaattttgaagaagcctcatttatctatttttttcctttagttgcttgtgcttatggtgtcatgtctaagaaagtattgcctaatccaaggtcatgaagatttgtgtctgtgttttcttctaagaattttatagttttagctcgtatacttagacctgtgatccattctgagttaattttatatacggtgtgaggcatagagccagcttcattctttgtatgtggttatccagttgtcaccatttgttgattctccacagtaaattttttctttttttaaataaagtaaaatatatatgatatataatatatcaattaatatatattttatatatttatatgtaaatataaatatatatttataatatataaatataaatataaaacatatgttaatatatattttacatataaatatcatatattaatatataatattttacatataaatatcatatattaatatatgatattttacatataaatatcatatattaatatataatattttacatataaatattatatattgcccagaccagctcggctgtgtagaacctaacccagcggtgctagaggaattaaagacacacgcacagaaatatagagtgtggagtgggaaatcagggatctcactgccttcagagctgagagccttgaacagagatttacccacatatttattgacagcaagccagtcataagatttaaagggatgggctgaaataaagggatgggtctggctagttatctgcagcatgaacatgtccttaaggcacagatcacttgtgctattgtttgtggtttaagaacaccttaagtagttttctgccctgggtgggccaggtgttccttgccctcattctggtaaaccaacaaccttccagtgtgggcgtcaaggccatcatgagcatgtcacagtcctgcagagattttgtttatgtccagttttggggccagtttatggccagatttgggggcctattcccaagaatatataatgtataaatatacattatatataagtatatactaagtaatataaatatatttatataatataatgtatataaaatatataatatttatatataatataaatttttttatatatttacatataaaacgatatatatcatttcagtcattcataagtgtacaagtcagtggcaataagtacatttacaatgtatcattgtagctattgcctctatgtatatgaaaaccttttttatcatcctcaacaaaacttctgtacccattaagcagtgaccctctttctttcctccctccagcccctggtaatctctattctactttttgtgtgtatgaatttgcctattctagttacctcatataagtggaatcatgccatatttgtctttctgcgtgtggcttatttcattaagcataatttccatactaatgtttgtgtgtttcattaatatggtgtttttctttcctcccactggttattttgtcacatacctggtatttctcatcattcaatcatatattagtgtgataagtgggctgattattctcagtgtattaagtagtagtctgctactcccaccatcccatccagaggtgacggaaatgtgatgggagttttgtctcctggctaaccttattgatgagtcagggatctggttgggaacaaagaagactcttatcacccttgccaaatgccagaacatgaaaggctttaagaatctgttgtttgcagtggaagccttaactcatcccagccagcttgttctatatatttggagaaaagccctgctttattgctgaccgtgattccctgtgtggtacatggggctggccactgtggcctttaatcagtccttctattcacttccgcttctcccacctttactccattgtgcttgcaaatccagtgcccctctggggcccttctagttggtgagtcagctcccatacctgctgcagcactttggtgatactctaagtggtatcgtttgttttatgcaagttttctctgctctgctttattcgttaatgcatttttatttgccatcttttacactagaaatgtatttaaataccttgttgtctcatgaccttctttctttttttcattgctctggcttagtcttttttgtttattttaaatctgtaactggtcttttctctggggtctgaagagagatgagaactgagagcatatgtgcactctgctctctggaactaggagcccaggcctcacctgctgtgcttgagtctttcctcgttatttctgttgagtgtctttttctccttctatactcaatgtttcttcagatcttagggaataaactgaacactgtgatatatatgaatagagtagatatttactaaataattatgatgtccccaaatagatacaaaccaagtaaattaaacaccagacttatttatgttgtctgagaaagtcatatttgaaagaaaatttaccccaaactgttcgttggaccatcctttattcttataaacaggtgtttattcttataaactttattcttagaaaaacagtgtctgcttttctacccccacttttctatgtcacatttgatttggggaaaataaattatacaaaataccatattatcccatcctataaattactcccggaaaacaagtcatgtgtttagaagctgtgccattaagactgatttcttttgcatactttgtgttacaacacttgtcactattgcagttgttggtttacatgcctgacttcctcaaagaggtcctgagagtagagaatgtgtcttactcttgccttctcttagcctagtttggtatttgacaggaccagagaatagaagtgatagatacaatgataactactattgattgtgtttcttttgtttataggcactgtacatgccacttctacccacattatatctgattttaacatttttttctgagacaaatattatatccattttacaggtagacaacgtgagtctcagagaggtttagtaatctctccaaggtcccacagttgtcaagtgacagaaccaatatgaaggcgttaactgaagaatgaaaggaaggagggaatgtcaagcatttggaagcagtgatttttgtaatggtgtgaaggagttaacaggagaaatagcttgttcttgaacagcctggctgaatatcacatcataggaacacagttgcaccggtgccttaggatgctgagagttctgtgaaagtgatctgaaaaattaaacacaaagatgccccatcagtacaaaatgtatgctgggattcattatatcatcatgttaattatttccttctttcttcttccctgttatgctaggatgaaaccaagtccacaaatctataacagtaattttagtagggattttcttcttccttatccaaaggaaaacgctttcaggaggtgtttactccctctccccattcaccctaacttgttcctgttaaagggcccatcatcttctgttgcctaggtaattctagtgcccactgattatctacgaatgataccttcgttgttcatactgcagcgcctctgccatgctaatgtgagataatggtttcttgaagagtgtttgtttccagcctttgcagctcattcaaacttgggagagctctggttgcagcagaaactgcaagcagctggccatatgcattttattgatttattgtattttgcgttacagttgtccactaggtataaggtgacccttagagaacatctatttatagtaactaggggttgggtttctggagttctatagcaaatggacttatttttacatgtgtattatactaattagaatacagaagattcctggttaaataggaaaatacacctaatacctttttaaatgtttttggaatattgtctgaaactattatatttaacaggcaatagccagccaggaattgcttttttctcccttcattttgtttttaaaccaatttaagaaaaattgatgttttttctcaaaatagatgttgttggatgcagcagaatttttacataaataagccattctagtgtcaaaggaagaattatagaaaaaaatattctgatatgaaaatgctatttcaatattcaagagtacaaataggaaaggtttcatattgttggatgttctgcctagcaaaatggttaagaacacaggaggcacactgcatgcttctgaatccaaccttgggcttagcagttgttgttacttgtattttgatagttccaatgcagacatgacaattaattgaggtgcccagtagttaatataaataaaagatgcaagattgtattctattgaacatggttcatggtggaaattaacctatgggagcagacaattcttggaaggccaggctccaggcttcattctttcccacagtataggtaatgcagatgctggagtaaagagatgttctggccgggcatggtggctcacgcctgtaatcccagcacttggggaggccgaggcaagtggatcacgaggtcaggagttcaagaccagcctggccaacatggtgaaaccccgtctctactaaaaatacaaaaattagccaggtgtggtggcgtgtacttgtagtcccagctactcgggaggctgaagcaggagaattgcttgaacctaggaggcagaggttgcagtgagccaagattgtgccactgcagttcagcctgggcaacagagtgagactctgtctcaaaaaaataaaaaatataaaaaaaaagagatgttctaggaagggcaggacagtataatctagcaagaagtttaaaatggtataaagtgtaaagaattttgatttcttggttcaggaaggctgactacctcattggctgggaggagcagcaaagcactggcagaaattcaggtactagttctttagaccttgtgtgattcactgcagtataatctggggaaggactcctagcatctctggagtgtagttctctaatctgtaaaattatttggctgggtttaattcgtaaatccccttccagcgcttctgttgctggcttccataatctaggttattggtaacctttaagtgactttagtggagtagtgtgcccagtcgccagactgtagggagttaaaaaggaattatatggtggaagaccatctgctcaggaagttgagtttactgcaatccaagaaaggttataaacccctcctaatttggtagatacattatatagcactcctacaatatggacttgtagcgatttccctttttaaagttttgttctaaatctattcagtttttaaagatttattagtctttaaaaagatttaaggatatttaaggtgatttaaggaaatcatgcatgtggctcagttttatctggctcagtgtgttctaatgctctcaaatagtttaaccagtttgagacataatttctacttaaaagattaaaaaataacaacaacaacttcactagcttggcaaagaaataaagcgtttgtgtgggaccaaaaacccaagcatgggagtgaatttgagtactgaatagaagttcttatgattatcttagtaaaacagaataaaatagtcaaggcatcaaagatgcttctgagagagcctagcctgaatatgccacagccgcacagagtttctcctcaggtaattctgtctgctgtcttgaagggtaatgaagagtctcttatcaattggtatttatacctgagccaattaaaattcaatgccttgataaaaaaaatccagaactgagaaaagttgaattggaagtcaaaaaaatgagcttaaacacatttaataacatcattctaattaacccatttaacctattaaaattaaaagtttcaataataggcatgatgtataatgaaatatttcatctacaggatggaaacttcttatactcatggctaaaatgtaaaagaaggaaaaatagaagtaagaaagcaagatttatggtccagaataaagatatacaaggattattatgatctagtattgttttaatgaatctatatttctgacatttttctctaaggaaagaaatctcagttattcataaatatgaataaatttgtgaacttaacctgaaatttacctacttcacgttttttcctgttttgaatctattcacatttttaaaggtctagtgatctttgaagaaaacctatcaattaacgccttctagctccaccttgtttaataatctatatcctgacaagttgcccccttctaaaacaaaggattgggctttgggagtgtctactttcttgaggaatgatttttctctcatgaggtccttggagagttccatgtatttttgctgtcatgcaggtgaataaaatacaagtatttttggtcagctacttgaggcaatattttactttaatggcagaattattatgatagagcagatcatgtgtattgacacacccttgagagaattcagtttcgcattcagtgacacccaagctttgaatctgtgaagtagactagcccatttaatatgccaattaaaatggattgatctactttgacagtctttggagaaaaggccaatatgaaaggaatgctttttagtcataagagcttattttctgtgctgcaagtttccaaattgaggatgaaagtcagtacttgtttgctaaatcatgtacatatttatatagatctcagctaaaaacatatagtacacttggtctctcatttttcaaattaatgaggaagtgggagtttcatgctttctcctctaaatatacaaatgcatagaattttgcatgaattactttcttaaagatcaatgaacactgcatatatgtgtaataaatttttgtttttaaggaagtaatatagtatagtggctttgcatctcatacaggcctagctataaaacctgtctcttccacttattaaatgtgtgaccttggacaattgaattaatctctctaagccccacttttgtcatattttaaatgggaataatgatccctaactcagggttgtgtttatgattaaatgatagtttatgtaaacctcttaaccaaatgtctgacacattatgcaagctaaataaatattattgctgttttttatttcaataatttattatataagtaatatttctttctcattaaagagatgagaaaaaatcctaaaaagtctagaggaaaacattatattttcaacatttcggatatattttttagtctgtattcaacttagaaagaaattgaatgtttagcatttaacctgttagatttcttttatccctttgtgtgattaagactatcactgtatagacagaagccattgttttaatggcttttgaacttggtttttttttttttggttccattttttaatggagctaattttttaattagctccatatattgacagttttgatttttttttttttttttttttcttgagacggagtcttgctcttgttgcccaggctggagtgcaatggctcactggaatctctgcctcccgggttcatgtgattctcctgcctcagcttcctgagtagctgggattacagggacctgccatcatgcctggttaatttgtttttgtatttttaatagagatggagtttcaccaggttgaccaggttggtctcgaactcctgatctcaagtgatccacccgcctcagccttccaaagtactgggattacaggcgtgagccacctcgcccagcctgacagttttgatttgttatagataaaccttaattgcttatttcttcttctcagattacattattctgttgtgtcctatacttcttaagaatggtattgaattagaaatatcagaatataatgcctaagaaacctgccttttgaaaatgttttgtagaagctcaatgaaggctacatattcatataattcctataatttttgtatattttcatgaataattttcataaactttacgaatctccatgagttttgagcaaatatttatattttaatgttctcctcatttatttctgtgagcatctttattgtttccccaaccttatttaaaaacatcttttatgggatcctgtggtttatagaaccaactggtttatgaagatgaattgaaagggacactgtaacatggtcaggtatctggacactaattatggctcctaatcatatcattaatcagaagaaactataaattcagcccaagaagatgaatttaatatggcaaagaagaatgaataaccctatgtagcagaacatgagcccttccttgtacttaagtcaaaattgtgcaaagtgggagatggagctttaatttctcagaagggtttataaaagtaaaattaaaactagactaatgggttctagtacatgccaagatcattgcttctaattacaattggaactcttcctctgaatcccagaagactaagaaaaacctctatccccaggcattaactcacccagcttttttccctctacctttggctgttccaattgatattcagtctttcctctatattttgtacctttctctctacttacttctttccctgactgtatttaagtgctccgcagctattcacctctctcaagggcctgtcttacttcccttctttccttccctttcagacagcttagaaaaatgcttgcaccatcttcatgtcctcagttctcagtcactccttgtaatgcacagtctggcttcttacactgtcactctacaaaaaccacatgcaacaagttattaatctcctcctaatttgataactccaatgatctcttttcagatgccagtctatttgacttcaaagacattcaacacaattgaacactccttcctcctttaaaccctgtaaaagcatagaattaatctttgattcctgtctgcctgcctcacctcttctcttctaaatccagtcctatcagaattctgttttctaaatagtccccaaatattttcactagttccctcttcccgcctcttcacttcactatagtccaggtcaccattatctctcaactgcaggctccaactaatctccatatgtctactctgccccgtgcaagtcatctctatatggcagcaagagagccaccatcatgtgagttaatatgtatgtaaagtgtttaggcagggcctggcccatataagtaccatatatgtgtttattactattgttgtagaaatgtagattatattgagtcttttccttgtttgaaacccttttaagtagcttttcattccacttagatgaaagccaaatgccttgttgcctgtagggccctgtggggccttagctgtctccacccttatctcttgtcactcttttgcttgcctgttatgctccagacacactggtctcctcttagtttctccagcacttcagggtctctcctcctcagggcctttgcacactcttccttctgcctgaagtgcctgttaccagaccttagcacactccttttagtctctaagtctcagatttaatgacaccctctaagagttactttctgaccatcaatctaaagtagcctctgtcttcagttactctaatatattaccctttacttttattatgtttatttatataaatttaatcatctttctcactgaaatgtaagtttaattagaggactttattgtcttaatgacacatagtaaaatcactattaattgaatcaattcattaatggcaagtttttatcttcgagaacagctcagataccttttctataaagtccttgtcaattccctgaggctaagttggatgctccctgtcttgccctcaaagtacccattaagagcatcgtatttaatatcctactgaagtccttacgtagttgtcttctctcttatatggtgagttcataaagaatagagaaaatgtttcattcatctttctgccatcctagtgcttactaagtctggatgcatgaaaaactcagcaaactctcaagggttcctcactagcagaaacctttctagtgtataaaactgttaaattctctcattgatatagaaaacccttaggtttacttgcaaagagtgatggtggagtatctcctctgcagttgggtcccctgtgtgaatccgcactagaaacagtttggcctcaactcagtgaagatggctctgtggtgctaaaggcttgttggattctagagcctgctgggtgcctctgtagttgttgggtttgacccagtgatgataaatcttgcctcaagttggcccttgcattatctttccagcccagtctttttgtcatttagatgagcatcaagtgccaaagaagaaagtagagcaggttttcatgcccttcccctccaaggcctctcttcttaggtggctttcacactgtaataactgcacatatggcctttgcattcatttccactcctaagtggaatgctgcacttggcaattctctagtgaactgaaaagtttatggtacagccagtaagatgcagcagtctgacttagcgaagagaactctagaacaagtcagtccagaaacagagattctgcttctgggactgccactaacttgtaaagggacctgggctatttcccctctctgggcctcagtcttctcatccatcaagtggattatgattttatcaaggaaagccaattttcagacaaaatcttaagtagaatttcagcatataaaatagttgtgctgctctggctgaaatggagtcctgccactagtctctctcgtagacccctcctacagccaaatgatagaaatggccccctcccatctctgacattttcaactcaaatcccagggaacagatcccgttggtacaagcatccgaaggagaaaaattaaaaacacatcggtttactggacttgcttctttttctcccatgattctaaaacctggtttcttatggtttaccactagggacctttctttgcttgtaacccaccacctgaggtgtttctaaatgaccaaaaaacctgagagttaaatgactggattcttggaatctgttctcccctttctgcctcttcctgctctgtttcaccctcatcttacttatctttcctgatgttgatctttcctgttgtgtttctatggcgttctcgtcatttgttcttcccctttgtcatgattaaagctatgagaacaccgtaggtcagagtttctccacctgggttcatgtggccattttggcattgtttctatgcagtatgcaagactgttagcactgtcatttccttaagataaaaatatagaaacaccagttacagcaagtacttagaaaggggtgaaacagttttacaaattacaaatcaattcattgtgacaaagcgttcggtattctcttccactataatcgcagtcattgaaagaactgctgtcaaaaagcattgcctgatttattcatttgggcatttgaaacaatgtgtttgaggtctgggaatacttttaaaaattcatttgttttcctcttaaatagaaagcttatataatcactaatccaatatataaatacacagagcctaaaggaccattttctcccaggccaagttgactcttgagccaagtttagctttttaaccatgcttgatattgttattcctctgatatttctacttaactttcctctgctttcctattaattttcacatgttgctgctttggcttggttggaaatgtcagaacaagatgccagtgtgtctcagtcaggacatggctgtgttcaaactactgtagcctgttacttggcttctatgggaaaaatactgggggtgcagtgtttccagttggaattgagatgtataaagcatctgcctgatttcttcagctaatgaggttttgctgaaaaatgagtgtaatgaaaaaatgctggatgttggcaggacctactgatgaagtctaatgagcataaatgagtgttctgtaaggcccccaaagcagaggcatagaatgtttcaaatacactgcccttgagcaagaccagcctggaggatgcatttatttgttggctcctttttctttccttctctccctcctcccttgcctttctttcaataaaagacctatgtaagccagacacagtagattattttatgcaatatagggcatattaaaaataaaactactggccgggcgcggtggctcatgcctgtaatcccagcactttgggaggccgaggcgggtggatcatgaggtcaggagatcgagaccatcctggctaacacggcaaaaccccgtctctactaaaaatacaaaaaattagccaggcgtggtggcaggcacctgcagtcccagctacttgggaggctgaggcaggagagtggcgtgaacccggcaggcagagcttgcaatgagcctagatcgctccactgcgctccagcctgggcgacagggcaaaactctgtctcaaaaaaataaataaataaaaataaaactacttagactagggctcaatacaattgcaaaaattagaattatgagctttacatgctatatgatttaacagaaaaggcagtcgtttttatatttgcttatcaagaactaaagaatttaaagttcacatggaaccaaaaaagagcccgcatcgccaagtctatcctaagccaaaagaacaaagctggaggcatcacgctacctgacttcaaactatactgcaaggctgcagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatccctaccttacaccttatacaaaaatcaattcaagatggattaaagacttaaatgttagacctaaaaccataaaaaccctagaagaaaacctgggcattaccattcaggacataggcatgggcaaggactgcatgtctaaaacaccaaaagcaatggcaacaaaagccaaaattgacaaatgggatctaattaaactaaagagcttctgcacagcaaaagaaaccaccatcagagtgaacaggcaacctacaaaatgggagaaaattttcacaacctactcatctgacaaagggctaatatccagaatctacaatgaactcaaacaaattgacaagaaaaaaacaaacaaccccatcaaaaagtgggcgaaggacatgaacagacacttctcaaaagaagacatttatgcagccaaaaaacacatgaaaaaatggtcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagtcatatgcacacgtatgtttattgcggcattattcacaatagcaaagacttggaaccaacccagatgtccaacagtgacagactggattaagaaaatgtggcacatatacaccatggaatactatgcagccataaaaaatgatgagttcatgtcctttgtagggacatggatgaaattggaaatcatcattctcagtaaactatcgcaataacaaaaaaccaaacaccgcatattctcactcatagatgggaactgaacaatgagaacacatggacacaggaaggggaacatcacactctggggactgttgtggggtcgggggaggagggggggatggcaatgggagatatacctaatgctagatgatgagttagtgggtgtagcgcaccagcaaggcacatgtatacatatgtaactaacctgcacattgtgcacatgtaccctaaaacttaaagtatataaaaaaaaagaactaaagaattatattctatcaaaaagcagataaggcctgtaatcgtagcactttgggaggccgaggtgggcagatcacctgaggtcaggagttcaagacctgcctggccaacatggtgaaaccttgtctctactaaaaatacaaaaattagccgggcatggtggcacatgcctgtaatcccagctactcgggaggctgaggcatgagaatcacttgaacctgggaggcagaggttgcagtgagctgagatttcgctgctgcactccagcctgggtgacagaagggaaactgtcgcaaaaaaaaaaaagaaaaagcagataagaaaataggtttgtaaacaatgcttggaattgagttttcttaaaacctgatctcaggtgtctgaagaagagactgttggtgagatttggcagactctactccccatgaatgtagcatgttcctgcacccatgtgattgttaattttacatgtcaacttgtctggaccacaggctgcccagctatttggtcaaacactattctgagtgtttctgtgacagtgtttctggatgaaattaaaatttaaatcagtagactgagtaaagcttattttcctccttaatgggaatgggcctcatccaatcagctaaaagtctgaaaagaacaaggctgacccccgctgaggaagaggaggattctgcctgtgagactgccttccagctgggacatgggcttttttcctgtctttggagttgaactgaaacatcagctactcctgggtctgagcctgccagtcttcagactggaatgacactgtctgccttcctgggtttaggccttcggactcagactgaaactaaactgtcagctctcctgggtctccagcttgccagctcacctgcatatcctgagacttgcctgcctccgtaattgtgtgagccaatccatatgataaatctctttcttcttcttccttcctctctctctttcctgtttctctagagatctctgcctgctatagcaagcagcacataatctgtgaaatacgtactgtgacatgtgccatattgatttcagacctggacatacgtgcagtcaggttaaactctatcactgactagatgtgtaacctttgacaaattattaaaccgctcgtcacctcagtttcctcatctttaaaatgggagttcttgtgagaatactcaaaaaagctcttgaataacacgtggcacatagcaagctgtcaagatgtattaattccttaacattccaaaccagactacaaaacaaatgtaagcaagaacataatgagataactctttttttattgtactttaagttctggggtacatgtgcagaatatgcaggtttgttacattggtatgcatgtgccatggtggtttgctgcacctatcaacccgtcatctacattaggtatttctcccaatgctgtccccccgctagcctcccaccctccgacaggccccagtgtgtgatgttcccctctctgtgtccatttgttctcattgttcaactcccgcttatgaatgaaaacatgcagtgtttggttttctgttcttctgttagtttgctgagaatgatggtttccagctttatccatgtccctgcaagggacatgaactcatccttttttgtggctgtatggtattccgtggtgtatatgtgccacattttctttatccagtccatcattgatgggcatttgggttggttgctattgtgaacagtgccacaattagttcaaccattgaggaagtcagtgtggctattcctcaaggatctagagtcagcaacaccatttgacccagcaatcccatgagataactcttatcaacaagctgtcgtgtatttccatatgttgtaaatggatgtctatgcttctttctgtgtcaccctcctagaaaagactcagacacttctcactgccccctccccaaacccaaacctactgatcttttcttataatagtcctccagttacccacataatccagtggtagcaatgcctctgaatgatttagtttgagtgcttagtctacttttataagcagaattaaaacctgatgtttaatggtgccactgtgtaaccataaccatttccagagatttcagtgtaaaaggttgactagccttaattgattatcaaaaggtgtaaagatgacattagtacatatggtacatctacaaaatggaataccaagcagttagagtgaaaatgaggacgtgttctatgtgttaatatatgaaaagagttccatgatatacaattattaactagaaaaaggtgctgagagtaacttttgtgtagaaatgtaagaaaataatatatatttgcatttgctgttgtaggcatgaggaaatgctagagcaaggcataaataatcatagcagtgattggttgttagatggaggggaactgtggggatgaaggccccaaatgggaatgacatgtcaccaaaaactttttcataattgttaaatttttgagccttatgaatgaattatctgttgaaaaaattaaattagaaaaaaagagcaaggaaaagaaacactattagggcacattcacattaagttttctctgtgtgccctttgaaagttgtattacactgttttatttatagcccccagctgcaaatatcctggctttactactttgacctgatttgagtaatttaaaaactagaatctagacagatagacatgcagtgtcttaattaccgtagttttaaatttttagcatgatgagttgcaatattaatatagttagtgcccagcttatagagaagttatgctataaaagttcctcttccaccgtacacttaaaaatggttaagatgttaaatttaggttatgtggggttttctttacaatgaaaaaatcttagaaaaatacaatctgactttatagaaatgaaaattttgaatgagaatatttctaactacagggttttggtcctaaaccatattgttactctgacatgtacactcttttatagtgtatataaatgtgtacattttactgattattttcttttgttaaaagtatccttgtttatatttgcaaacatttgttgggtatgctcaagggaagatttgtgtattgctaataaatgtaaccagcaatactaaaaaaaaaagttcctcctccaaaccgtcaaatgaataacaattgcttttcttttagtgcaaggtggttcctacatcctaagtgagaaaagtaagcatgaggggcccctgtagtttcacagaccactcatacacattctaaaagctaaataacccttccaaaggcatggcatgaggtgatccaagactcgtgccaagtgtctcatacaggcagtgccagctattcctagtagggacaaaagatatttggataccctggtgtttgggggagtttgggaggagactaggttaaaagagcgagtcaggatctggatagataaaggaatggagagagcagtccaaacgtaaagggacagtggacagaaacataagatggacatgagtgaactgttttttagtggagtactctaaaacagatgggagaccaacagggaacagcaggtagtccctgagctgtaaaagtcctcgagaagtttgggctttatttgggaaacattagttttggggtagaggtaatatcctaaatattgcataactatatctgtttactaactcttctctgtctcttttcttcatgcattcaagaaatattttttgaccacctcctttgtgcaaatcattgatacaagaaaatgaacctgaccataaatcgcagacaatgggcaaaggcaagtgtggagcagaaagctgaagaagcctattgcagtgacccagggttgtggttgtgttgctggcattgatagatggctaattttttttggacacttactataggccagtgttaaatgcttatatattatgtattattctcataaccctaggaaatagttatttttattattctcaatttatagatgaggaaactgcagcttattgaggttaagtgacatagtgagtcacacagcaaataatagtataaatatcattgtgtaacagatcaaagtttgcaaatattttacatgccctcttttgtttgatcctctccttttgtggtaggcactgtaaatatttttcccattttacagacaagcaaagaattgagaaacttgcatgggcagtcattcatcaaatagtaaggatgcctactatgttccatgtgtggggaggtggcagtagaccagctagatcaagttccctgccctcagggaggtactttctgaagggaatgaataacaataaatgatataatttctgtatcggacaggtactatgaggcagacaaaataaggtaaagtggtagactggggttggagatgcctgaggagaacaactttggccatggtggagagaggaggcctatgtggcagggatgatggttgagacctgtatgaccagagagcattcattctgcaacctggaggagaaaacacaccagacagctgtaaccagtgcacttgatgggaatatagttggtatgttcaagggacagagaggacccagggtggctaaaacatggtgaagaagagaagggagaataagaaagcagaggcaagcatgccagagctagatcatggagggcctcttgggcctgataagcagttttgttatcattttacaggaagttactggagagttttaggcagggtgttcataagcatgtgcatgtgtgggtggggtggagtagtagtgagatgatctgatttacactttttaattactgttttcaggatggactgctgtgaatgggtgggatggggtttaagactgaggtaagtagaccagttacttaaccaagtaaaagatcatggttactttaagtagagtagtattagcagtggagaaggagagaagtggtgtgtttgagacatattttggaggtagagccaatacgagttcttcgtgaattagcagcacgtcacagaggcatacagtatactataatggataagtagattggattgcgcatgtttgaatctccatgttgccacttaatagctttatgtattagctgtatgatgttggataagttttttaaccactctttgcctcagttttctcatcagtagatgagaataattatagtaacctacctaataggggtgtttaagagtatataatttaatatagccacctgattctcaataagtgttctcagtttttgtcactgttttgttttggttttttagctgtttttggttatggggtttgaaggaaaaaggaatttaggatgacttacacattttttggccagagcaaatgagctcataatatggggtcttatagagataaggaatgctttgggagtcagtagatttaaggatggagatcaggtcagttttgtccacagtaatctaaggcacctatcagatgagcaggatcattgctggaggaagtgacaagataggacttgtaggtagatctttcaatctaaagtctgcctgctttctgctctttgagaggcaggataagtgagtgactatgagcacagaatctgcagtcagactgcctgggtctgaattctagctccgctaggtctgtgtccttggataaattgcttaaactttctgtgcctcatttttaaacctgtaaaatgggataatagtttgataaagcacttaagcagttcctggcatgtggagtatagttatataaagtgttcgctgttgttgctacttttaaatcctgaatattgctatagaaatgcaaagaaaacaacattcaagatactgtgtgaaggaaggactaacaggattctggtgactaattgcatatggaggttatgtaaaaggcatcaaagatgattctgaggttctgagctagagtgacccattaattgagggttaaaggataagaacctgtttgggatggaggtggggttgatgatgaggagttgagttttcaatctattaactttggaaatagccaagagaaaatgtccagaaaacagtttaaaatgtgggaactagaacttaagagaaaggtcaagaccagaaatataaacatggaagcatctgcttataatagcagtggcaacctgtctagggcagccactgtggggacaccagctgcagcaggggaagtgtggccagggctgcacacttcatggagccagagggggccaggaggaggcaggagccccactccctactgagttggtggggcaggggccccatgctctcaggtgcagctgcagctgcccagccgcagctccagacccaggcatcactgcactcttgggggcctgggaagcccccggtccccacaggttcagaagtgcctgctcccattccccactcccagcacctgcagcagtacggaacaaagttgtgactgagcctgggtgctgatgcaacacagctgggtgtgcgcacgctcagggcagtgttgacatgccatccccctgctgcctcagccccctctgggctttgagcgccgatgagcacaggagggaggccggtggggctaagggcagcttgttgtgggcctgcaggtatcccttggcacaaacagcctgggcaccatggacagcatgttgatgatggcaggaggaaaacaggctcctgggcgggtccctggtgaaaccctgccttcaaaccagggatgacctgaagcctgggggccgggctgccacccctgggtggagtctgcagcccagagtgagaaactgtgctttttccgggcccacccatggccgcccatggaccgatcagcatgcgcttcctcccttctgagcccataaaaaccaccagactcagccagacttggacagatgtagggactaccagctgcaggaaagagttacccacttcaggtcttcaggtctccttgactcattgggatgagctgcctgcagaaaggagctcccactgcgggtctcctctcagctgagagctggacactcatcggaatggcctgcctgcaaaaagtagctacccactttgggtctcctgggagctattatgtcactcaataaagctcctctccgccttgctcaccctccagttgtctgtgtacctcactcttctggacatgggacaagaacttgggactcaccaaatggcaggactgaaagagctgtaacacaaacaaggctgaaacacgcaccccccacccaacacctggctcaccctcggcaagtgtgggatccaggctggtagtgcaagctgagcacagcctacaggccaagtgggtggaacgagcccagtaggtgtgggcaatattcaggtaaaaggctccaccagccacagaggtttctggctggcaaagcaacaccccaaggatcccatgacacttagagataatagcttaaagctactagagtggatgagatttgagaaagagagaatgaatagaatgaatatgtgaccatagacttgtgttaggattatgtatctccaaagacagggcaggatagattgtagagggcagaagtacagaggcaagaaaggtaaggacatagttatagtcttatatttgagaaatgaaaggaaaaaaatgggtagtagctaagtgtcttagtttgttcaggttgctataacaaaataccataaactgggtggcatatcaacatcagaaatttatttctcgcagttctaaaagctgggtgatccaagatcaaggtgctggtagattgagtgtctggtgtgggccttctctctggttcataaatggtgccttctccctgtgtcctcacatgatggaaagggtgcagggcctcttttataaggataccaatcctgctcatgagggttccgccctcatgacctaattacctcccaaagcacccctccccattccccagccccttatcccctgccaataccatcaccttgggggctaaaatttcaacctgaatttcaggaggaacatgcacattcagaccatagcattaaagaaggtgttaagtcacctgaggatgtctttaaaaagatgttcagaatcatttggggaagaactagccatataaaaaaataggatgacagataatccaaatgtcttagaatggtggaagccaatgggatctagggcaacataggcattatagcaaatctagacaaggaagaggggagccgctgtccaaggattggtgtgaagatagcaataagcaaatgtgcaactacagcaaaaattaacatcctttattgagtgtttttgtgtgaaatactgtgcttagcactttgttctctccctaagtcttcagtagttctctgagatagggacaattattatattctctgcagaaatgaaaaattggaaaccacttaaatatccatcaacataaacattttaaaaataaagtatggtatatccacagtatatcatgtccttcagtcactttttttaaatgaggtagatctgccaaagaaagataccagtaaaatacttttacgtgataataaacacacatgtgaaaacttatctgttatccatctctcctagtagactgaactcctcaaggagggacattgtgtcatattcgtattctaacatggagtcttgtggattagtgtccacttgatcagatgaatgagcaacaaatgcctgtaaaatggagattactggtaccacacagggcttgagtatgtgtatatacgtgtgtgtgtgtgtttgtctgtaacctataagcagaaattattacaatattgttaggaaaaatgccattcagaaaagaaggtattagttactattaggaaattaacagagagacttaatgggttttggacaacaatggtggtggtttgctggatgcagtggctcacacctgtaatctcaacactttgggaggccagtgtgggcagatcgcttgagcccaggagttcaagaccagtcttggcaacatggtgaaacctgtctttacaaaaaatataaaaattagccaggtgtggtggtgtgcacctgtagtcccagctacttgggaggctgaggtgggaggatcacctgagcccaggatgtctaggctgcagtgagccgtgatcactccaccactccactacactccagcctgggcaatagagtgaaaacctgtctgaaacaaacaaacaaacaaacaaatcaatggtggtggtttgaagaaaatggtaaaaacagaacagatagtttcaactttggcagtgaaaggaagagagttttacgagtggggctgcccgtgctgaattctttctctcaatggtgaatggggcaaaaggtcccacttgggctggagttgtaagtccaagctcgttgtggtagatggtttgtgaaccagactatttgaaatgcttagtttttacaacaaaagagctcttcagccatctgatagtcccctaactagatgctcagtatgattcaacatgtatagaggccattttagatctgagtactctgtcatacaagtggaaacaatatcctaaacaggcctatgattcaaaaagaagattccagtttgccaattacaatctataaactgccttatttattgttattgaaatatcatctgtattctgtatgttttcatttgctttttatttaagaatcccacaactgtcctgaagattgtacataatggcctattctaaggttactcatccttttaaagcagtaaatactagatctcatccaagagaaatagggcttaattttttcatttgttagaaatcttgatgaggctttgaaaacaagttttttctcacccttttggaaaacatttaattgtgaggtctttatcaagtaaaaacagaatttataacattttaaatgggtatttgtttttgttggattgttaaatcacattttctcttacacattcatttaaatcacatgaaagtctgcgtgaaatggcactttgacgatgattctgggaaccatccctttgattgtatggtatttactgctgatatatgtatgctggtgtttcttgccttccatcatacataaatttcagtgttatattgaataccatagagaggaactgattgatgataaatcaaatattttacagcatattattgggactgttggatccattactataaaagagttatgtttgatcagtattttcagagctccctaatactgtaatttattggtgcttcttaatgttctctgttaattatatacaggtttcaaaattgggttcaatttaacaatgtataatacatgttatagcgaatctttatcacacaaaaaatgagtagcaaatatccaacactgtctttgattagaactattaagtccaacagcttgcatttaatgaatataatgtaattacatagtcaactgggtagttcatgctctattataagaattatatattagaataaagttattttgatgtataaggtgccaaaggaaaactggttaacaagaaagggaataaccttatatgtggttaagatgtcaaatgaacaattttaactatcattttttttttacagagaacacataaattgggtttttatttttagttcctcctcttccctttagagttaaatgatggaaaatgactctcggtccccaaactgctcttatgcatcattcaaaatagccctgacaggctagcccctgtggtagtgatgaggtttatggctttccattcctttgtgttccattactctgtctatatcatcaaattgattagtaggcagtggcgagcaaggaaagaaaggtggccgctgagagccagctggtgtccatcattttaatgaactgcttagagatggttaatattgtccttgtttctcattgtagctgatgatgaccagatcttttaaaatgttttccccctcccttattctgcattacagggcccactggaaaatgacttggtagttcatgtggcacttatagcagaaagccaaaggtatgaaatccaagtgggtggtgtgtttttttgtggggaggggaggggaggggaaatgattgctttatgtttacaatattgattatggtagaagagattaacttcagaaactcctttacaggctttcaaggatatcattaatatcactttaaatgaccagcatattcttttcgtgtttaaaaataattttgttttagttgaggtgaatattaaagactgaccagtgccagtgttgcctgggttgtagtttcgagaaattcatgcaaacacatggggattaccaaaatcagtgctttccctccctgtcagcccctaatgtttccatgtgatgcttcatggaggatccatatgggcctctgaaatctagtgcagatggcaaattgctaatactaacaaattaataatgccctccaagttaacatgttcccttttatcctcctccttcactgcttcctaaactgtaaatgcattgtcttaaaacgtctctttttatccctatgatctttagacttcaagtttttctgaacacatatggtattcaaactcaaactcctcaacaagtagaacccattcagatatggcctcagcaggagcttgtgaaagtaagtgattctgccttttactttccttactttgtagaggtactagagcttgatggttggacttagtttacagacaagtcacacagttaaaatctgattctgatataggaccagtaatccaaaagcttctaattaaattgagaagtccactttaatggacattgttactaaaaaaaaaactttgcactgtgtatatgtgtgtgtgcatgtgtgtgtacgttatgtttataggtcttgttgattcctacttctttctaaactctattactaacctaggctgagcagttaaataacaagttagtcttaattttaataggaataaaattattcttatattttgatttgatttttttcctcttatcaaaatgtattcttacattttgatttggttttttcatccttttatctttgattttttcgcctttgattatcaaaaaatatttaggtgtgagaaggtttgtttaaaaaaaacgtactcatacctaaatatttttgatattcactactttcctttttttctcttgccttactgtttggtgtctgaagtaatttcaacctctttggtttgctgggtctcaaagcaattataaagtaaaagtaacatctgtatttatcattgatgtagttcaatacctatttgggatggaattaaaaggtgacatttgaggccttttgcacgcactgctctgcagatggatccattattgcctatgcttgtgaatgttcttgctcgttagagacacgacattgttgactcctacccactacttatttatacactgccatttttatttagtaattgttaaaaacaacataagaacaaactgctcagtgtttagtagaagtctttgtaacagtgtatctcaagtggacatgattaagtttattaggttaaatataaatggttgtagtcaaagtcttgttgctataacagaaaaatgaaggcttagagaagagaggtacatgttacatgggaaaatgcaggactccagtatcaggcctggatcttgacattaggcaacacaaaccagaacctgggtgtcaggtcaccaagagcaccagctcttggagagtccttataccttctccaataaatttaaccaccactaccctgccaagagataaagctgaaaatacaaggatccctagagtaggtaacaatttaaactcacgcccagatgtacataatggtacaaggcaaggagcggaggcaacgtggagggagagagaaggatgccaaaatctaaggctcttatgctgtgctcttagtattcagctgcaggctgtcggctgctaatacacttttatgctctcctgctgaaagctctagagaacgccaacaaagcttattctttgataaacatactcttaaaacaaattaacccaaatctgttttttctagtctaattaatattagcaacttattttaatagtaggtgagtttatatcctaccagacaacatgcagtcaagatttaaaaggctaacatggtgagcaaatgacttgaatgtggtattcattcattcagcaacaaacacatgctatatgcagagcactgtgtaggacactcatatgaaatgactttgtccctgttctcagtgacctctgggtttattggtttgacaggaaaaaaacagtgaattacagttcactttgataactgttataatagatgttcatacaaagtgcttgtgaatcagaggcagtagaaggcattctgttacagagcaagtaaagacttacaacagttcctggcttattttacatcttgttttaaaaatggtgttaacaaatgacttgcaattttggtgtagtgtggctgaaaagacagacttgtgagcaagagccaaccttcctgtgcatgtgttgagatggaagattgttttttggttgtagctgtagcctctgtgttcctaagtagctgctctttggatatatactaagatatattgcctagtattctgctccttataagtctgccttttaaaagtaaaggtgttccctcaaatcttagctgatgcacatattcttatgccagcggttgctccctttcttctgagaagccactccctccttcagcccactgaagaggatgtgagggcagacagctgagagcagggcttttacacagcatgtggttaatattcatgatgtgatgactgtagtgtgatttgcttcatggggatctgaatacagaattctgctctatgtatttccgggtagtttctgctctatgtatttccgggtagtttggtcactactgtgtctttcggtgcactaaatggtatgaatgtgtacaacatgggggcagtgttatatgcaccctggaatgtggggagcactaaataaattgtcacagacctgccataccatggttcagaaagttgagaatccttttactgtaataaagagtagtatttaaaggacgcccacctagatcaacacattttaccatacatttatttctgaaaatttgaaactattaatatatgagggaaagggggctgcatctagtgttatgtgctatggtttcagtgcagctatgcaaaataatgcttacaaagcactgtttctggccagttgactttgtctaaaaccactgctattccagaatcaatattcacagcatgtgtggctcaggagaacattcagttgctccctcattcatctatcaagtatttcctgagcaccagctacatactaggcacagtgccaacttgggctgctgttctacaggaatgtacaattcgaaaggagaaagagatacaaacccaactctcacatagatgtgtgcactatgtcagtgaacagagagctctggcaacaccactaattttgtatacaatgaagttgttatttgaaatcggtccaaatcacaatcagtagattgtgtagagatagttggtttgattttccatttaggaaaatataggttagatgtatttctgtcattaaatgtaaaaataaattgcagacagatcaaaaattgaaaacttttaaaattatttaaatataaaagcactagaataaaaaaataagagaatatgttttagctgttgggaagggaagtccatttttagaatgataccagtgccaaaaagccattgaggaaatgattgacaaatactgtataactaaatatagcaaacagcctggcatatcaaaggtgcttgtgaaattttctagtagaaaaatgtttatattgaaataccacatgttgaaatgagattccacctactgtgcagtcattctcacatttcataacaacactgaagaggagcaaactgggcaaagtatttgatttaaggggcaatactcttaatataccaagatttcttgaaataaaaaagaatgccaaattccccatagaaaagggaacaaatgaaaaaagtttgagttcattgtagattctggatattaaccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccgtgctgttttggttactgtagccttgtagtatagtttgaagtcaggtagtgtgatgcctccagctttgttcttttggcttaggattgacttggcgatgcgggctctttcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacagaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcatatgtaccctaaaacttagagtataataaaaaaaaaaaaaacattaaaaataaaaaataaaaaaataataaaaaaaaaaaaggaaaaagttacagaacatacaaagagtcattaaatatattagaaaatgctgaaccacaaaatattttaatgtagtagtttaaaaataaaatgaaatattattttgacccaagaaggtggcaaggcctgtacacagttaataccaatgtaaattggtacattatttctagagggtgaccaacctcacattacatttcaaagagaatgtattctctttgatccagcaagtccaggaaattatcctgcagatataataacacactgtccaaagatgtttattgaattatttttaaaataacaaaaaattgggagctatctttatcaggagataggagtttaaaaaggtaaaggggcttcttgattagattaagtgctcagctctgacattgattaactcctaattcattccaagactatctgtttttaaccttatagacattctagaagtttctgctccactgtggcacccttccctattttgtaatacttctgcagactttccccctcagtttttatttatttatttatgtatttatttatttatttatttatttttgaaatgtagtttctctcttgtcgcccagactggagtgcaatggcaccatcgtggttcactgcaacctctgcttcctgggttcaagcaattcttctgcctcagcctcccaagtagctaggattacagccatgtgtcaccacgcccggctaatttttgtattattagtagagaccgggtttcaccatgtcggccaggctggtcttgaactcctgatctcaggtgatccacccacctcagcctcccaaagttttgggattacaggcgtgagccactgcgcccagctttccccttcagttttaatatttcttcaatcatttcaacattgaaatgtacagaaaatgcatagactcattttaacatcttttttttttttttgagacggagtctcgctctgttgcccaggctggagtgcagtggctcgatcatggctcactgcaagttctgcctcctgggttcatgccattttcctttctcagcctccctagtagctgggactacaggcacccgccaccacgcctggctaattttttgtatttttggtagagacggggtttcaccatgttagccagggtggtctcgatctcctgacctcgtgatctgcccgcctcggcttcccaaagtgctgggattacaggcgtgagccaccatgcccagcccattttaacatcttgaaactggaataccacaatattaagtttaaaaaatgggacacagaatatatatgaacccatttatgtaaatatacacacatattgacctgtgtataatatgagtatatatttattgatgtacttttaagagtctttaaccctatcttggtgccccttagggatcatacaatgaactatatatacccctttcagcgtataccagagaaatagttgttgcaaaagggattgtgaaaataaacaggaacattcactttgagtacgtggtttgaatatttcataaaatgtatataatcagaaaaaatcaatgaagccattttcattttggtgggaaatacttaaaggtggaaatttagtaggagattatggccctcgtttttaaaatgttaaacaactggatttttttaatgatacaggaagcattagcctctgtgttcttttacgatcagagccatgcaagttgtacatttatagcagtataggaacaatatcaaatttaagaatgttgctaagtagatctgcagaagttttgctctcaaatctctcagtaatccaaaatctaagttgacatctttggttagcttgtcttcctacaagtttttggattagggttccctagcttctttctctctggaaagatcaaaaattaacaggacaatactcaggggtgagaaagtgacatggattcttacctgactctaatttacaaacttgtgtcttacaggcttatttgcagctgggtatcaatgaaaagttaggactctctggaaggccagacaggcccattggctgcctcgggacatcaaaggtactcatgaaatgtcctcaaaaagtagtttttggattctaataccgcatactgaaatggtgcttgacctgctatgcatcctttttcattttcattatgtactcagactacttatctgaagtattattttctgctagtaaacattacttatttagcatcatatcatggaagtcttataaatatgaaggagcacctcactgctaaatatattttttctaagctttgtaaaatatctaattataacaatatttactcacagacttttccatcatattagaggtagactgctttaagtttattggtatactgattccatcaagaaacttaaaaatttttaaatattatctggatgtcgcaagctattaatttatgtgcttattcagaattagacatcagtttttatttttattgagacttacagcactgcacctttgcctttggtatgttctttagttatttgttttaaaactttttcccttacagatttatcgcattctaggaaagactgtggtttgttacccgattattttcgacctaagtgatttctacatgtctcaggatgttttcctgctgatagatgacataaaggtagcttcggaacacctttcttaaaaatggaatgagtttgtttccactgattttatcatatgttactatattgagtactcccaggtatctgtgacactgggttaacacagtgtaaagcatgacagtaaaaccacctgcatagctttggagagtgtaaattacttgcagcattggcataatagatgacctcgtcttatatacagttgtatgactgccccttgtgcctttatacaaatgaaaagatacaattcagaaaaacagggggacctattttgaaaaatatgttcatatgacagtttatgtctttttgaacaaaaggtaaattagcaaaataattttatttatgaaaaatatccagtaaaacctcaactaactcataactccatgagttaaaatcttcactcccttttctactgacagagcagagaaggttagaatcatgatttagagcatgaaatctggagccagactgcattcgttaaaatcttggctctgccacttgccagctgtgtgttcttgggcaagttacttaactcctctgtgccttgttttcccatctgtaaaactgaataataattaaggggtgttctgaagattaaaagaattaatatatgtaaagtactaagaatagtgcctggcatatggtgaagtattatgtaagtttttgatgtgatgatgatgattttatgtaagtctttcagatgactgattgattgacagatagatagatagatagataatttaatcaaataaagagctccctctacattgctaatggtctgtataaattcagtccagtctcctccacctgctgtaaaataaatccctagtaatatgaagtgagttaatcttctggacggctggcatgattgttccccctgaggccattcttgaactgtattttgtaggcttttttaaaaaaggaggccaagtgcattggctcatacctgtaatcccagcactttgggaggctgaggcaggtggatcacttgagcccaggagttctagaccagtcttggcagtctctaaataaataaacaaataaatagattaacatttaaaaaaaagagggggaaaacacattaaaacaaatgtagcgtgattacttttaagaataaagtttgaaatcgttgaactcaaagtggtgttcagcataacttgcgtgtacccagagaacctgctagagtacttctacccctaagtagtctaagttattcagggttggattgtgaactgtcttgctacataagaattttgttggctctttggcactcatggttgagcatcctgttcatcttagatactgtgccattacatcctacctcattctgtttgacagaatgcgctgcagttcattaaacaatattggaaaatgcatggacgtccacttttccttgttctcatccgggaagacaatataaggtaggttgataaaagaagtaaggtacgtgtgtctcactgacatgaacacagtgagcccttgggaagaaaggcctccttggatgtttttgtatccttcttagtatgtggtggaatactttgtatatataaggggcacttagtattagattattaatttaccattctgttgttaatctgtacattttgtttatttatattttttagaggtagccggttcaaccccatattagatatgctggcagcccttaaaaaaggaataattggaggagtcaaagttcatgtggatcgtctacaggtagccttctgattttcagtatgcatctattttcaggacagttaatctacaatacagctatgtttcttaatgtatggtctatttaaggtttttgacttaaggttttattctccacctatcttcctattcctattgtcacttttccagtttatctgatcccaccaagtcagatgcttgaacacttgcagcaatttcctgtgcagaattttagacttcagtagctcatctctaaaagctaggtccatagtggtgtagtgacctgctttataaccttgggcttttaggggcaagttggctgactgttggtccagtactcttttctgtgctctatactaacatccaacctgggaataaacctttttccattcagaacttcacagcattatcttcacagctcctaaattacagaaacattctttggttcactgttggtcataacagcctctctgtccacagttctctcctactaaacactctttgtgcttcagccaatacaataattactgtgtcttgaattttgtggggttctgtccctctgctcacaccattttctctgcctggactatccttccttctttcaaggtcactgggctttgaggtcttaccagactttaagggcagctctacaaaatcatgcagaccacaaatatacttctattcttcaccatgctttcgtgacctttaacttaaactactaagactgcggtctattatataggcttatatactttatttctgtaaaataataatgattattccatggggtctttcacatagtaggtgctcagtattaaataagaaagaggaaagtttataaagaaagacctacgtagtagtataaatggcatgtttatatactcattccctggtgattgtattttgcatacttgatttttacctaagcatttatcttttttcctttattttctgttgctttgtctttttgtaatgcctcctggggcaatttctttgatttttatcttgcagttcttctattgagttttgcatgttggctatcatgttttaaattttcatttttcatagtattctgtcctatggatgtttcatggctgtcatattttatcttttctgaggatatcaactagaggttttcttttttttcttcaattttcctttcctctgtattatctctttcggggttttttccctcagtctttcatgttggaggcatttgtcagatgtccggtattctttagctatttattcatttttaaaagtaaaggagtaaaaagttcataggaagctgtgtgcttgggtacaaagattctttttttcttttcttactatttcagcttttatttttgattcagggggatacatatacctgggtatatgcatgatgctgagatttggggtgtgagcggtcccatcatctaggttctaagcacagttcccaatagtttttcaatccttgccctccttcctgctctagtggtcttttttttttttttttttaatacatacacagtaataggattgctgggttgaatggtagttctgttttaagttctctgagaaatctccaaactgttttccacagtggctaaactaattgacattcccaccaaacagtgtataacattcccttttctctacagcttcaccagcatctattgttttttgacttttaatactagccattctgactggtgtgggatggtatctcgttgtgggttgttttttttgttgttgttgttgtttatttcttttgtttgtttgagagacagggtctcgctctgtcctccaggctggagtgcagtagagtacacagctcactgctccctcgaccacctaagctcaagggatcctcccacctcagcctcccaagtagctgggactacaggtacatgccgccatgcccaactaattttttagttttttgtagagacagcatcttgctatgttgcccaggctggtctcaaactcctgggctcaagtgatcctcctgtctcggcctcccgaagtgctaggattacaggcataagccactgcaaccaacctcattgtggctttgattcgcatttctttgatgcttagtgatattgagcttttttttttttttaatgtttcttcctgtgtgtaggagaaagattcttgatgaattcacttataaggtgatctgatggcaaaagctcctttttgttgtagaaagcctcagatgccaatatttggaattcttttctctaaggcttttcagtctgcccagaaagtacatctctaacctcatgaccaaaggacataaactttgtttccatgtcctgaaagcagggtggaggaagggaaccagggatcccactgtgaagtatgcagtctccagccaaatccactgtttaatccttgtatctcctgctctccactgtgccttatactcttgagtgcagtgtctttaaccagagaaaaagccttttgtctctcaaaaatcagggagctggaagcagatagtaactccctaagtgtttagggaatggaaaggaacttttggacccagtcttcctatgtggagcgtctgtgaatcccagcagtgtctggatcttagggtcctgaggctctttcctgttctctttgtcctaatggatttataccttagtgggtttataccttaaacatttttttccactatcatttttgggattttaggaaaaacaggagttaaagatatgtcttggtcatattaaccagaaatctacttttgattttatgcttaagtgtccctcccattccaggatgtacctaggcatttttctattccttttaagaaatatgtgggcctatatggaaaaaaaagacctagataattttgaagagaaatataagatttgaataaataatgggctataccatattcttggatgaaaagactattacaaaaatgtgagtacctcctaaattagtctactagtttattataatcatggtaatttcagtggagtagagcttttggcaatttcatatggttaaggacaaaaatcagagttcagggcccaccagggaagagggatttcaataaatacttcagacttccagatgaccctcttgaaaagctatacctttgactaaaagggaatcagaaatagttcactcctcacaaagagtagtagataacattatccagaacctcaaagtatttctacaaatatgtgcagtgtctgtctttcattcaaaattatcaggcatgccacgagtgatcaaacaacagagagccacctacattggttcagatattagagttatcagacatagacgtcagaataactacgatcaatatgcttaactggccatcagagaaatgcacatcaaaaccacaaagagataccatctcacaccagttaaaatggcgatcattaaaaagtcaggaaacaacaggtgctggagaggatgtggagaaataggaacacttttacactgttggtgggactgtaaactagttcaaccattgtggatgtcggtgtggcgattcctcaaggatctagaactggaaataccatttgacccagccatcccattactgggtatatacccaaaggattataaatcatgctactataaagacacatgcacacatatgtttattgcgacactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacggaaaaccgaacaccacatgttctcactcataggtgcgaattgaacaatgagaacacttggacacaggatggggaacatcacacaccagggcctgttgtgtggtggggggaggggggagggatagcattaggagatatacctaatgctaaatgacgagttaatgggtgcagcacaccaacatggcacatgtatacatatgtaacaaacctgcatgttgtgcacatgtaccccaaaaacttaaaatataataaaaaaataaataaagaaaagaaaaaaattagataacaagttggagaattttattagaaactttgatagtacatttaaaaagaatcaaatagaaattctaaatgaaaaattcagtcaccaaaattgagaagtcagtgaaacaatgtagtacttattcactataattgatggcagaggataggtaaactcagaaaaacaccccagtatacacacaggaacttaaaataatatgtaatcaaggaaacaataaattaatggtggatgtatagattatttaatatatactttgggaaaaattaaggcagttagagtatcacctcacatcgtacaccaaaatacatttcaggtggattaaatgacttaattttaaaagatgtttattttaagaagaaatcaaaatactttcaagcttttactttgggcatatcataagctatcagttttagcctctgatgttgacaaattcttagttttgtgatgactttgagttgaaaataattttactttaaagtttaatattctgccatgttgtggagagttttcatttcatttgaagagtcatagacaaattacaaagacagtgcaaagtgtggtgattttctctcaagtcaaattgaaggtttctccttttctttttgttttattttaatgtcaagcacagcatagagttttaaagtcagaatgatatcctttttaatcctgtgtcatctgaaattgggaaactttttgcttatatatccttatacacaaagctcaagttggtcaagaccttaagatatttcatctaatcttctcattttacaaacagaactagagctctttgtaggacagtaactgtctgtagtcctaagactagttactgcagaagggaatagaattcatggtttcccattcctagttcactactttttatactcaagcacctgaactttcatcactttcttttcagcagcagagtttaatgtctacttcactacctatctcattttcccatttttagttgtgtttcagaaattataggagaaagaggtcagtagttttgtcatgattcaaagagttttacttttttttttttttaattgagactgagtctcactctgttgcccaggctggagtgcagtggcgcgatcttggctcactgcaacctccacctcccaggttcaagcgattctcctgcctcagcctaccgaggcagctgggactacaggcatgtgccaccatgccagggtaattttttgtatttttagtagagatggggtttcaccgtgttagccagcatggtctcgatctcctgacctcatgatccacccgcctcagcctccgcaagtgcggggattacaggcgtgagccaccgcgcctggccaagttttacattttttaaaaaatgtaaatggaagttcaccatttgtgtttttactttttccttcttttatttaaattaaaaatatttatcaaaagcaaaatgtaagtacataactgttctagacttacagtcatcagtaacccaaaatgtcaacaatatttttgaagatcttctgaatttaaatatgtactttgccatctctaaaaattgtggtaaaacatgcataacataaaatttgccatgttaatcatttttaagtgtccagtttaatggtgttaactacattcactttgttgtgcaaacaatctctagaactgttttcatcttgcaaaactcaaactctatgctcataaacaacagttcctcattccccccacactccagcctccattttttttttactaatataataaatgaaaatggcatctatatgctcctcttgggttttatttcagatcctttcaaatttccttatcccctgatccacagtttcattcattactaggatcccagccttctctcccagccccattacccaggacatctctccttgcagttcgttgctagccatgctttccatgccccaaatatacttggtttccaaatctctaaatgtaattggagatttttcccctcatgctatgatggtattttagagttgcctttttctttttttgtttctatgtcatactttaattttacagcttaggtgactgtttcctctttagtgaagcctcggggactggaattaatttctcctttcattgtccttctatgacattttgcttgaatgtttgctatggctcttctttcattttatgtttagctagtttcttctgcctgcctcgctctgtggtttgtaatctttttcagctcaaggttcactcatctctgcatccccagagtactctcctcactactgttatctgtgggaaatatttaaatattggctcattgattcaacaaatatttattgtgctccgactgtaggcactagggatgtagtgttgaatatgatacacaaggtttttgaccatatgggacttaaattctaaagggagagcccaacagaaaacaaaggtaggttgggagagtgatgggaaggaatgcaatcttaggtaggatggtctgttggaaaggacccggtgggatataattgagtgttttaaatattatattgcgtttgacacatacagtattatttaattaccatcagaaatagaatactaatgcctagcaaatttgttgttaagtatgctttttccaatactaatataggagcttctacaaccaactgaattttttttttaatcaaaagccctatagattattaatggaatttagcatttgtctattaactcagaataaacatttattttatgggctgaattagaatataagggtgagtaggctaataaaatggaaattattaaatagaatttttttctgtttcagcattagctatcagctttaagaattaagtaattcttgactctctctttctctcataccctgtgttacaatttattattaaatcctattgtctctatcctcagattgtatccagaatctaaccacttcccatcaccttcagtgctattatcatggtccaagctaccattgtccctcacctaggtttccagtcatctcctaaattccaactaataaaacagtctgttcatgctctacctggtcataagcagattaggtcatatatcataagcctccaatgacttcctctctcacacaaagtggaaaccagagttcttcaaatggtctatgtgctctccatgatctggacctgcatctctgatttcatctcctaccagctgccccatctactctgtttcaaccacactttcctcctcgctgctctcaaagacactaagcatgctcctgcctcaggacctttgcacttgccactcccagccctgtacactcttccttcagatccatatcattgactatagtcctttcttcagtttctgattgcatgttactttattagagaaatcctttctgatcagctatatgaaatggctaacaaccctcatcctactcccctgccctggtactccccatcccctacctttcttatttctactttgcacttatcaccatctgacataataaatacatatatgtagtattaatatatattataataattattgtatacacagagagggtcatatgtgttttagtcaatgatggaccacgtatacaatggaggtctcataagattttaatactgtatttttactgtaccttttctatctttagatacacaaatatcatcgtattacagttgcctacagtattcagtacatgtttgtagcctaagagcaataggctgtgccatatagcttagtgcttagtaggctatgccacctacgtttgtgtaagtacactctatgggtgttcacacaacaacgagattgcctaatgatgcatttctcagaatgtatcttggtcattaagcaatgcatgacagtgtgtgtgtgtgtgtgtgtgtgtgtgtgtgtgtgtgtgtgtagcttttttattgtctatcccctacacatacctataagaacagtttcaagaaggcaagaatgttatgtattttgttcatgctgtatcctcaatacctaacatagtacctagtaggccttcaataaatatttgtctaacaaatcatttaactaaagagcaagatgtatacatgctagcctacatattaggaaatatcattcaatgaacctgcctaggcacagaccctgctcttagggaacttactgttcaagagtgacctgactatagccaggctagtaaaaatgtgtagatcaactgcatattcggcctttctcactcaaactcaaggaagctttattatgattgctattaatacgtccatcctaccatctgtaaatgggcatttgttgatctactttgtttatgagtttccgctagaggagaaggcactactattctgggtagttagccaacaaaagcaacattccctgtgtcctgtttcttcacatttgagatgaacagtgagaaaatagagaaaataatatatgttataaatattttataaatatgtaataaatattgccttatttttaattaataatttatggcctgctttttatgagtacatttctcaattttctctgacaattcatcagataattagaagtgacacataatgctaaaaaccattgtaggtttatcattcatttatactgttcatactgttcaccatgaaccactgacaaacacaaacagtgtttaaggtcatttagtttgttcaacctataatcagaaacttatggaaaataaaatggccaaatatgggtagccatatgccagaatgcagagaagcattagcctggataaccaataccttcatgttcctgaaaaaaatggagacttgtcggtatcctatcattggatggcccagaaatacattacagtagcagaatccacagtgcaatttcacatcttttcccaaagcaattttagtattttatgtttttcctaatttggatattttattttatttatttatttatttattttttgagacggagtctcactctattgccaggccagagtacagtggtgcaatcttggctcactgcagcctccaccttctaggttcaagtgattcttctgcctcagcctcccgagtagctgggactacaggcacatgccaccacgcccagctaatttttgtatttttagtagagatggggtttcaccaggacagccaagatagtcttgatctcttgacctcatgatccacccgccttgacaccccaaagtgctgggattacgggcatgagccactgcaccctgtcagaaatgttattttttttaacattttaatggttactgaattattttaattccagattaaaagtaaatgcctgcaattctaagaacagagagtccatctcatgttgacctatttataatgactcataaacttgtaacgatgtgtatattctattttagggttttttttgtgtgtgtagaaacctgtgtgattttagaatgttcatttaagaattgcttcagaattgtatatatttttaagcaattttttgaagtattacttaattacagaaaggtatgcacacaggccattagagtatggcttgatgtatctaagagtttctaatctttttcgatcacgtttcagacactaatatctggagctgtggtagaacaacttgatttcctacgaatcagtgacacagaagagtaagtccctttgggttatttcatttttgggttttttgaaattacattagaaaagcagaaaatatgaaaccttttcttttaatttttaggcttccagaatttaagagttttgaggaactagaacctcccaaacattcaaaagtcaaacggcaaagcagcacccctagtgctcctgaactgggacagcagccggatgtcaacattagtgaatggaaggacaaacccacccacgaaattcttcaaaaactgaatgtgagacagatgcacttcccacatggccctaagtgaggttgctggagcagaagctcccagaatcagaccatatgtctttttgtcctgtcagtgaaggtagcaattaatctggaggtggatgacttgtctactcccagggcaatcatgagaagttgttctcttggtctaacatctgcatggatatctttaaaaatgcttaagaagtgcaggtgaatatgtttgtcttggatatacaagtatggtatgagccattaaagaagtcaatgatagttgcctttgggttctccagatttccctttcagtgccctctttctccctttctgcccccatcttgtcccctgccccagtgtttaggtctaatgcttgctttaggtcagtcctgtcactgagtaaagcaatcctttcactgtgcttatagcacagtgccctaatatgtaataaacactctaaacaagtcccctcctatcatccatctcttcacaacagtttgctagcaacatggtctcccatttaccaataagaagaatcaagaagggagtggttaaatgacctggccaagtctctcagagagtggcaaaatcaatgttaatgcttgtagataaaatattttctgttcattacttatcttgttttctggcaaatttaattattaaattctaccaccccaggaagccagcttgtcacttgtctaccctctatctctaagatatctaagataaatatgaatcgttgtataatgtcatcttatgcttgatattatatcaatgacattttatcttccctcagttacatagtaaagtgtttcttctctgcatcatgtggttttgtgattagttaccctctgtggtaactgctgtacccatttcattccagttcctcaccgtgatttatattttcaggattgcagttgtctggctagccaagccatcctgctgggtatactgctcaaaagagaaggccccaacttcatcacaaaggaaggtaagcatgcatgtctaggagaacattttaagaggacctctctagccttgaacatatatcaaatatgcataagctatccactaaaatgttacaagttatttcccctttcattaaaccttctttttcacttttgaatggaaaatgttcattcataccccctagagtggaggagactgatgtatgaacccctaactggctttcatgcagtgatgcttgattgtttctctgattgtctgaaaagtattggagcttggattgtgcctgtgactgttaacgtctgatgaattccatagttgtttattgacagtttctgtttccagttttatcttctctaatttttcaagaataacattgaattgttatgtctataaaaattagctctctcatggtctgcagcagccatttgaaatggaacatggcatttaatagaattgtgctctgaagatggttaataaaaataaatcatttgtaatcatgtctatgtccactctgcattaaggatgaaaaccagttatcccccagattcacacttgcatgtggagtcaccactgtaaggaatctttaagttctccaccatggtccgcttctgacattttataatacagaataatacagaatacagttcaagtacttaatgtctagctattcaaaaatgtttggcttatttgaaaatactctgttaagaggtgtgtgttgatatggttagaactgaaaaacagcagtggaattaataatacgtatagttctggtaattaactgagcatagttatttattcaaatgagatctacttagtttttgccttattatagctaagagataaccttcttcagtattatagatgtgaattgaatagttttcaatttcttagcttgttaaaggcagaggaacttttagcaaatttcaaacagaatcttgcatgtttctaattagtcttaaaactataagtataagcagaatctcagttatatttaggacattcattgaaatttgcactttatctaaaacagtaggatttttaaaaatcaaacatttcattagaaacctagaattcagaatggctgtttttttaatttaaaagttttagtgcttttaaataaaagaaaatttatataaaatagtttataatgaaaatgctaagggaatgatgttgtaaaccatttttataaatttgagaataatattcattaaatgttttaaatctataaaaccttatgtgaaactttgaaaatcatatgcatctacagaatctgaatataattttatccaatttgttaaaaggctgtaaaaagtttagagtaaaatgttaaagatcttgttttttatcattgttttctttttggcgctctttcctgtcacattgtgattttacgggcaaaatcagtggccaaataatgaaacccactggtgtcttttgagcagtagcatatgttggaatgatcatagccccatgtacataacaaggcctcagtaaagttttattgaacaaataaatgaaaactcatatatattagagtctacagtatttgttcaattgctaattattttactatattctcttttcttcttttctgcagtaaattagaatagcatttgtatttgttaaaagtttagattgcatattaattaggaaaacagttgaatttcgagaaataaaatacctatattacatactcagactaaatagtatcaagtgctggggatagtcacactctatatatttgagttacatatttaaatatgttagttcagaacattaatggatcgatgtatcaactctagtgaagcacagtgaaaatgagtacttttaagaggaataaatgttgtgcatttaattaaaagctttgttcaacaaagactctattatccaatgtctaggtaccgtttctgatcacattgagagagtctatagaagagctggcagccaaaaactttggtttgtattagtgtccttgttgttatgttttatttttgtgttgttatattcgatagcctaaagaaaatggaccaatattaaagatagttattcatcctaatttttacttttaacctccaaggttacagcactttctaagaatgtgcctatgtagcatgtctgtccccccactgcctccaccaaaattctgagaacaaagacactgtagggattgaacctgaagagtattcgctggaatggtatgctaaggtttctttcctgctgtacacctcctctgccccaacaaggtgctttaagttctgttttttaatttaggaaacctgttctgctattatagaaggccatgaaaagagaccagtgatttatctaatcataagcaaaaatagtagaaggctattgtcttgtcacttaagttgaatgaatcccagtgattgtagttgcttcacgaaaaataaccaatttgttctacagaggtagtctgttcccagagattgaaaaaaaaaaagatgtaggaaagtttaaataaataaaattgtttaaattcacaatggagggccaattcacatggccctctgcattttgatgtaattctaacagttttactagcagaatctaacaaattttgaaagtcagagcgtatgtatagatatatatacacatgcacacatttttttaatgatacgttatccacttaaaaaaaaaagtctcaagaatgtcataagaaactcccttaacctcaatgagcctcaggtttctaatccctaaaataaggggattaaacaaaacaatcccttagaatatttcaattctatttttataataaatatgccgttcctcctcagaagaaataatgtaataatcctatagttaaatctttcaaattttcactgtaaattttcagtacagtaagacatcaagccaataagtgatagttctggtaaactttcttagccagtaagtttcaagtgtggtctgtagtcttatttttgattaagcacatctgttcttgctttatgtattacactttatgcatttcagataaatcattaactagcaaacatttagaatgctgactgttatgtttggaagaactcctggaagttttatttactctattttcccttttatggctttccactgacacacccaggttggcggtgcgctacggggctgcatttacccagaaattttcttcctctatagccccacacattactacttttctggtacatgggaaacaggtaacatgcacagaatttgaaaacccaagctgcttgaaatgtgtgggcttatttgcactctgaaggttaaatatgtcttttggtcttatagtgtgtgggtgaaagcttctctagaagtaggaagtgtttgtttcactaactttattagttattgacttaattttcttttagtcatctatgttgaaattaaggaatataaatgctttttataagtcagcttctgtggatatcctgaaatacatgaagattgcagccagtttcaaacctacatttttatttctctatctaaaagttccacgagaatttttacttttgagggaaaaaaattgtcttatgtattgcatgtgctgtactttaaaaaaaaaaaatctgttctccctaggttctaagactttttcagtaatataaaaatagcagtgtgaattccttcccccaacattatggctttatcagtaaaaagaaatactggtatttcattgtagcactttctaaaattcagtactaagtgaatcctctaatccagagatttggttatctaggcaccaaaagaaacatgatttaaagtggttatagaaataggtcacatgtactagtgacagatttagtaatgaacttgttaatgcaaaatcagaataccctcttaatccctcctatacaccctccctccctaatcaaaataataattaggttttctttttttgctttttatatcaatagtgtcatcaataatatttttgtcacagcttggtggcagggatgaggtggagggatccctccctaattctgaatggtcctgcagtctgggaaatttcagctgttaggttcaatgtcctgggcagtgtttcctccaaatgatgatgtgaggattccactgtgtatattttaaagactacccaatcagggccccatgcattcctcatcttttagatttgtgaacatctggcctgctctcttctttgcccccaggtcggttgtacgccgtgcagcaagtcttttaagtaaagtagtggacagcctggccccatccattactaatgttttagtgcagggcaaacaggtaagtatttgcttttcagacacttatttggtcccggttgcaaagatttctggctaggacccttaattttaagtctggcaaacctcaatgtcataggcctcttacaatcagatttataagggctcaggcactttctatcaaagtctccttccccaagcaaaatctagtcagaaagttattaaatgggccttcccctttcctgctgcaccttaaagctataatcttcaactcctgtgttgagatcaatgcagatgctaatgtagaaaatggaccaataactactgaagtactccagacaggtttcggataggcagaacagaggtaggtgaacagcaaagggcgcatcttcccttctgctccacatgagatctccccacttagaaagcatggtgttcatgcccagccagggtctttgcgtgccagtgctgctccccagatcccctgccccaggccatctctaaccccagctcctccccattcaccagggccaactctgtcacctcctcctcacggagccatctccagttagcagtggtctctctctctggattctcacaataggtctgtgacaattcccacaatctgtcctgggtcccagttcatttgaatgtgtgtctctcacctcatggtaggctgtgaacccccaggggtcagagtctgggtcttgtccagtacacgtcccaatgtgcccagcatggggccttgtttggaaaaagcacttggtgaatgttggttgaattgagccttgcatgtggggtgtggctactcattttctgttttgttttctataagctctaatttacctggctgaatcatcctttgattagaatgaaaacctgtccacttactctctgtctcttctctgggaatatatgtgctttattgtgttttcctgagagttaatctggggatataataatctttagtaatatgaagtattttaactctcttcaatggaatcaacccattggtcatatttcagggctcttaattcattaagattaaaattattcatccttacatttagcttttgaaatgttagaataataagctatttattgtttcctgtaatatttaataattaaaaataattgtactaataaaagataaaagattcctgctgggcatggtggctcacacctgtaatccaaacactttgggggccaaggcgggaggatcacttgaggccaggaattcgagaccagcctgagcacatagcaagaccctatctctgcaaaaaaaagaaaaaaaaaatagttgggcctggtggcacatgcctttggtttcagtgccttgggaagctgaggtaggaggattgcttgagcccaagagtttgaggctgtagtgagctgtgatcatacactccagcctgggcaacacagcaataccctgtcgtttaaagaaattaaaaagaaaaaatacaaaaactcctaagaaaaagttaaatcacttcatatatgttattttctccaaattattgagaggtagaatttttatccctgtttgttggctaaaacagaccaaaatacaggaagtaacttatctagtgccttttctcaccagaattctcacctccagccagagtcttgtgtttttaccctgaaccaagccacctctgaaagaaagttaaacaggctttgagaagatatttttccttggattttagatccttgtagcatttctgaaaagagagttaactctgcatatgaacattcagaagcttttggagaccttcaaggtcatcagcacctgacactgggagaaagggtgggttagggttggttctgtccaatctacacaatatctaaagggggcttgcagcctgtggtcctgagatcctgctcctacatcctggaagcctcagagcctgccctaaggttgtgcctggaccattgctcatcacactagcgtgtctcccagggtaacagtcacttacagagctgggcaagactcggaggccagtagctcagcttcattaccagaggcatggagtccattctctgaccgcatcttacctctttacaaaaaagaaatgagaatggagcattcagaatttttactcgtgcgttattcaaatgccaccctaagcactgaagtaatattgtttctaccaagcacattcggatcacctcaagctctgtggaatgaaatcatggcttagtcatcattgcttctagaggcaatgatgtgccttctgtttgttttcttctttacacactgacattttaataaaagtattcacacgcagactaactggttcatgccacttgtgatataataaaccagcagttcacagttttcactccattacaaaattgaggcaatagactccatgttctgctctctcccctcatctctgtggcctttgatatgctattcttttttcctgccttttataattgtacactgtacatgaaaaagagatggaaaggggtattcagggagaagggcggcctgcagagtcccctgggagaagaatgccaagtatagaggagagagagagaccagcttattccccttgccagcttcagcagcattctgcccagagtttttttggccatttcactctatgctgtctcctgtcccaggctgtgggcagcctgttccttcccctccacaggtgagagatctgtcaccacatattttaaccctcaccaggcaccttgcattatgcccagaaaaatgagggctacacaggaactgggtggcctcacacctgcctttgaaaggttatagtgttgctgaggcaaaaggatctgcctgagaaactataaaagaatcaaaaagtttatctctcaaataccaaattgtgtagactgcagtaaagtgaaactcttcaacctattctggtttctctggggagtttctagtactaaagtcattcagaataattttaacttaatttatattccttccctgcttttatccactcacctccactcccctaactggaaccctcacctgcccttatattttagactagactgtgaaccatcatgaattccagtgggagtcatgctttgaaagccattttaataaataccaggaacagttattctacctaattccctagcttatatagagtaatttcagcctgccagtcattctgagccttgatttttttttaatttttatcttttagtagctaggagaattttacaataaaattctgccacttgtaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcatgctgaaaatacgaatcgggtgagtgaagtcctttgcatttgcataaagagaattgttcaagttgtcctctaacagacccggcctctccaagtgaagcaatgttcctggtgtctggtgagtattcagcaaagagcacctgtcctctaagccatgcaggcaatatctgggggtatgaaaaataaatgccactagcctgaaagaatccttaacgtttatttcacacccgagttagacatagtgaagtaactcctttgtctggtaaaatcaaaccccagaaatttcaacagctgtgtcgtgtaaaacgctaagcacagtacttgcaaaaattcctagaaataaaatggataggccttaagagaagaatgattttcagtaaaactgtcaggaggacacatccagataaaaatttggtccttttaagaatattctatacccattttctactgaaatctattaattgatttttaatattgttgttcttggagaagaaatcaaaataaggctctgatgatcttgaatatttgtaatcaaggattttatgaggcagcatggtgtaggaaaaattaaccaggctctggaattcagcagaactgagttcaagttccaactgccattgttgtctcagtaaccttgggtaaatgactgaacctctctagcctcactttaataccagtttgtttgttttatatgaaaatgaaatgagatatgttttaaaagtctatgacaagctaaggaagtataaatgtttcttttttaaatacattttttattgtacaagtatcgtgagtatgtcctattgtaaaagagcccaatgatatctgagcttatagtgtaatctaacaagtggccaactttgagggtgtttctcaagtgtttgaaaagaatatacattctctgttgggtgcaaacatacatgtatgtgtatgagtgtgaaataagtatatgtagcttgctaactgtaaaactggaattttaacatctttactatctctatttggtcattgctgataaaactcttaatttctcattataattgtggttgtatcaatttctccttgcatttttatttgtatcagttttgctttatgtagttgttttttgttttttgagatggagtctcattcctatcacacaggctagagtgcagtggtgcgatctcagctcactgcaactgccgcctcccaggttcaagcaatctttccacctcagactcccaagtggctgggattacaagcgtgcgccaccacacccagctaatttttgtatttttagtagagacacggtttcaccatgttggccaagctggtcttgaactctttacctttagtgatctgcctgcctcagcctcccaaagtactgggattacaggtgtgagccacctcacctggctgctttatgtagtttaaaactttgattttgtccatgtctcttcataacttttaccaatatatcttcatgtcattgattacttttcaactttttttttaaacttcaaacatttacaaaaatacggagactagtataatacagacttatgtgcccatactatcagccagcctcaacaatattatcatctggtccgtcttacttcacccatacccccatctactacccacctgctcccacagtaccctgtcagttttgaaaggcaaatccatatcttctaatctgtaaatacttaaatttgtatctcaaaaacataagaactttttcaaagcataaacacagtactgttaccatgcataaaaaacaattgaattatgtttgtcaaatattattgccatacctttctccatctgtcattattagcttgctatattgtcttccatcctttttgcattcaatgttcttttataattttgtatgtattatgtatgtttttatattcagcactatgctgtatttattaatatactctgagagcatcttataagaagcatgtaacataaaatttaccatcttaaccatttttaaatatacagtacagtagtattaactatatacataatgttgtcttttaatagaaatatatatttcataattgttttctttcttttacattttgacctatttctatattttatactttatatttaccatgctttcttataacttttttccttttctgtttattgttgggttgagctccttttcattccactagttttacacataaatgtgatgtacttttttaaacattattacccattttttccttcaaaatcacatgtgaaaaatgcattgcctatttggcaatatctgcatacatcgtaattcatcagttctcatccaaggagttcacagtattcacacaagtaccataaagatatattttgcagcagtcttcctttcagcattatccgaaatagtgaaacattgcgaacaacctagatgttcattagtaggaaatagtttgaataaattggtttttagccatataaaaaatgctgtgctacctacagtgaacaagataaagtcctatataccgacatttatgaatgtcctagataaatgtaaaaaaagatgcagtgtattgttccactttttataaaagaacaataataataccatacatatatctgtgtaatgtatgtgtgcaaaagtatctgaaaaatatatatcaaattggtgtcagttactttctctaggagatttctactttctaagttacatttttcagtattattttaaaaattactttagcttattatttttaagtgatttgcctgatttcaactacagtatatttcagtcaaatttccttatctttgtctcttctttcttttgattgaaagtaaattacctgcatagaatttgaccttcactcttatcccttaaaatagtttctttcaaagattcagagctattttgaatcagttataagaactttgagttatatcctgatttgttcagtctgtttgccctgatattttcaactccaacctcttgactccacatgaggatagagaaatggttctttcatgtgagctaactccaaatgaaaagaaatgtgattctccatctctgtacatggtataaaagtactctattgtcacagactcaggcattgatctgagacagactgagaagtataggttataagtcttccaaagcacattctttgaaataagtgtaataagtgttcagggagccttttcaagtgacagccatccttgcagaggtttcaacaaagccttagagtgaaggtaaacagtttcccaagattttacactgctgtgtttttcagtctatagtagtttttcctttactgcttattcagcattttaagctaatttaggtcctctacaaatctcatgtaattccctttcttgaattcaactctaacctgatgcttctttctattcatgggaatggatatttattctaaaaatagcattctttctgtttttatatctgttactctgtatgtttggtgctttccatgagaaatgacataccatttttccttatactgtgttacccaaagtaaaaatgtcaggtggcaacatgtgacttagtatttaacagtcaactgactcataaagaaatttgctatgaaaccttaattattcaccgtcctgaaactcattctggaattgtggcattatattctcattgcgagtattaatagtgtccctgcctgacttatgatgtacatttcactcttatgtgggtctcacgagatcagttctaaccactgggactatttcagttggggagcaatctggtattttttttttttttattaaggagttatttatttaagaaatttccttctgctaaggataggaactaaatcttgtattacttcccatctgtcttacagtctctttcatcagagatactcaataaatattggattgtttaacatacggtatataagcagagtcaggtggtttgctttgagctagtaatgtggaatttaggaaaagcaaaaagagagcatgtctctgtactcttagagaagtaaatggctcttaattttgataaacatacttggttttgtgccacatgatattggaattaagtataaaagaagatttaattaaatcatgtccttcaggaaatgaccaagttaaacagggccttgtttttatgaaagtccattcatatatacagaagatatcaggatgtagcacttttctccacggagttattaatggaatggtgtaattaatcatatcagagtacaggacaggttgccttacaatcgtacatctcttagcagtgtttccagtaacgatctaagaggagacaagtttaaataacgtgatcattgcactcaaaagatcactctagtaaaccatccttctcttcctccatcactatagccacaaatattattcattgaatatctgttatatgctaagcaatgaataatagaagaagaataaaaattcttcacatatattatctgttttaatccctacaacaactttgaagtaggcactagaaccaccattttacaacaaagaaattgagatttggagagtatacatgggctgtctttgtcagtaagtggaagaactgggatttacacccaggtctgcctgactccagtgttcttattcttcagtcttgagtactttctgcatgtttttgcttctgtatactattgccattatctcacagaaacaggctttagtgtttatttctaaaactttatggcctttatgatctctcatacatgatttcaatttatgatccatattgtattcaagttcatgtagtaactatgatgtgccagatgccagattttttttttttttcgtcttttgtctgccaggcctccaatctaggatcagtactgttgagcattttacagtgtaaggaacttgagtaggtacaagttaacagaccgaataaatgagattttgcacctttattcatcacaaggcagagaaaatgggatgattctaagttggccgcttgtatactacagtagatatattgtgttggtgcaaaagtaatcgtggtttttgccattgaaagtagtggctgaaaccacaattgctttgcactaacctaatattaagacgctatgaaaagttcagagaagtctagagcagacttttcacttccttgtaatattctaggatacctctggcaaatacagagcctcattatgttaaccacacaaaaaaagctttctgaaatgtaaacctgcctgcctgttgctgcatcaacattggtttaggaggcaaagcataagaataatttgaaattatattttgtcatactttcaaggtcagtatttgcagaggaaataatattttcctgaagactaacccgtctttgtaggtccagggtagatgtcattgttcgaagttaacagccagtccaaaatgtgtgagccagtgaatatgcactgaacccttggtactgtttactggaaccagcaaagatagagacactgggataaggacaaatggtagacagttgccgtgtaactcctctacggaaaatcttccacctcccctaaggcaaaaccagccctgccactgaattcagctctctggataacaccaatttgagagttacaagtggaaagccttgaattttattcccatttctgccagtaacttaagtgactatctcaggcaaatgagttcccctttcttatgttcagaggaagagatctaatgtttgctgagggcccattttctaggtgcttgccctttgggttatcccagaaaatcctcaacaaaaactctgtaagtttacacacaagctgcttgaaattctgcaaaattagataactttcccaaggtcacaggccaagaaccaggatttggaactagtgtgagtgacgcagagttcatgctccccaacccctcttccacccctgttaccctggtcagtaacagcggggctatgcctgctttggtgtcctcgttggatgtggtgattctgggtaaaaaatgtgaagatgttttgcaagggcagagcttcaacattatcactgtggtatttgataatttgaggtcttctccccatgacatttggagaacagctccatctgaggagtgctttttacacaccacaaatctcaaggtgccgtaggaggaacctccctcttctcccaacacacacacacacgtacacacacacacacacacactctctctctctctctctctctctctctctgtctccatctcactcattcttgtcttctggtcctaggtttgcaaaggccgtgtgctctcacaagagaagttcaccttggaggagggggccctttcagccatggttgagtcccctgtaggcccagtggaatgatcccaaagcatctcatatggaaactccatctcagaatcccattgggatgatctcttgccatctaacatgatgtcacctctccgtcacctggtagacactcacgacacctgtggcaaacaccctaaaatcccttcagacctacgcccacagcactcttccaccacagtaataaaggcttgggaatgctgtttctgccctagggatatcagacaacttcagataactgtcatcctgtctgtggggcttgtgatagtgcccctctgaagagtaaaaagatacttttgtgtcttctatgtttttattagacttcatcctcaataaattatactaaggcctcaacccctttaagtgaatgggccccttgcatatttgtttattagcagcagcaaatacatactcagtatgtttctttacaaattttaccttgaattagtccctggaaggtttttagtttgcttaaaattggtgagcaaattattcatttataaagtctttgaatgtcaaatttcctataaattgttgaacatgtaactgtttctgagttagtcctttgtgtattgtagtggttgtagcacaattttaaaagaaagggaggggatttatagaatgtattctttttttactgccttatggtacaataagcacatcagactcattcttacttggctttttgctattgtttctctcttttaaatgttaattatgattaaagagattgattgattggtcatgttttgataccatattcttcttggatgccagcattcactagactgaatggccataagaaataagaacatttgccttaatcatggtacatcttaaccagaattcccttgcattgagtatacttttatctcaggtttaactactctctcttagtgtttttttaaattttatttatttgcattacccactacttcaattgcttttaagccaatagcaccatgtttcttttctcttttttccaaggttaatcttgccaatgcaatttcttcaactttactgctatcaggcactccagtgaacaaaattaacctgctcacaggaatggtattctggtctgataatgatttgatttgctgtctcattattgatttgtgcttcagctttcctgttgaaatagatcaagttcctgacaggcccattactgtaaagacctccaatcaactactttctgctgcaggtctgtcagtcaagctttacttacagataaccccagaggatatgtgttatcaagtatttttcatctctgcttttcatactgccagggcatcctctgtaagcaattatgatccagacgtaccttgtcctctgatgcccaaaaccgtatctgtggatcacacatccgaagcttagagagagccattgttgtcatagatagcagactataacattgcttatgcactaaaggaaagagaaaataattacagcaccaagttcattagcacggttctgatactcattctgaggtctttgcttttgacatctgatatgaggtaaggaggtgagatgatgaagctccccaacctctattctattgtgattggatcagtgatagagggaatccacatccttcagtcaccaaacagatagctcagtttgcctcatcaaattgtattcctctccatattaatatgaatcaagcaaaaaaagtcccttcttgcagctttccatcgtctgtcatttggtgtatcagctctggcttccataacaaaacgccatacatggaatggcttaaacacagaaatttattttctcacaatctgcaggctggaaaggccaaggtcagggtccctgccaatttggtttctggtgagggctctcctcctggcttgcagatggctgccttctgtgtcctgtgtcctctgatggagagagagagctctctggtatgtcttcttataaggttactaatcccagcataagggccccaacctcatgacctcatctaaacctgattacctcccaaagaccccatctccagataccatcacactggagttagggcttcaacatttgaatttggagggggagaaagaattcagtccatagaatatggcttagttaaatgcacaaaatcatctaattttttttttttttatactttaagttttaggttacatgtgcacaatgtgcaggtttgttacatatgtatagatctgccatgttggtgtgctgcacccattaactcgtcatttagcattaggtatatctcctaatgctatccctcccccctcccccgaccccacaacagtccccggagtgtgatattccccttcctgtgtccatgtgttctcattgtttagttcccacctatgagtgagaacatgcggtgtttccttttttgtcctcgcaatagtttgctgagaatgatggtttccagtttcatccatgtccctacaaaggacctgaactcatcattttttatggctgcatagtattccatggtgtatatgtgccacattttcttaatccagtctatcattgttggacatttgggttggttccaagtctttgctattgtgaatagtgccacaataaacatatgtatgcatgtgtctttatagcagcatgatttataatcctttgggtatatacccagtaatgggacggctgggtcaaatggtatttctagttctagatccctgaggaatcgccacactgacttccacaatggttgaactagttcagagtcccaccaacagtgtaaaagtgttcctctttctccacatcctctccagcacctgttgtttcctgactttttaatgatcgccattctaactggtgtgagatggtatctcattgtggttttgatttgcatttctctgatggccagtgatcatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattctgtaggttgcctgttcactctgatggtggtttcttttgctgtgcagaagctctttagtttaattagatcccatttgtcaattttggcttttgttgccattgcttttggtgttttagacatgcagtccttgcccatgcctgtgtcctgaatggtattgcctaggttttcttctagggtttttatggttttaggtctaacatgtaagtctttaatccatcttgaattgatttttgtataaggtgtaaggaaggcatcaagtttcagctttctacatatggctagccagttttcccagcaccatttattaaatagggaatcctttccccattgcttgtttttgtcaggtttgtcaaagatcagatggttgtagatatgtggcattatttctgagggctctgttctgttccattggtctatatctctgttttggtaccagtaccatgctgttttggttactgtggccttgtagtatagtttgaagcaggtagtgtgatgcctccagctttgttcttttggcttaggattgacttggcgatgcgggctcttttttggttctatatgtactttaaagtagttttttccaattctgtgaaaaaagtgattggtagcttgatggggatgacattgaatctataaattaccttgggcactatggccattttcacgatattgattcttcctactcatgagcatggaatgttcttccatttgtttgtgtcctcttttatttcattgagcagtggtttgtagttctccttgaagaggtccttcacatcccttgtaagttgaattcctaggtattttattctctttgaagcaattgtgaatgggagttcactcattatttggctctctgtttgtctgttattggtgtctaagaatgcttgtgattttgcacattgattttgtatcctcagactttgctgaagttgcttatcagcttaaggagattttgggctaagacaatggggttttctagatatacagtcatgtcatctgcaaacagggacaatttgacttcctcttttcctaattgaataccctttatttccttctcctgcctaattgccctggccagaacttccaacactatgttgaatattagtggtgagagaggggatccctgtcttgtgcccattttcaaagggaatgcttccagtttttgcccattcagtatgatattggctgtgggtttgcatagatagctcttattattttgagatacgtctcatcaatacctaatttattgagagtttttagcatgaagtgttgttgaattttgtcaaaggcgttttctgcatctattcagataatcatgtggtttttgtctttggttctgtttatatgctggattacatttattgattttcatatgttgaaccagccttacatctcagggatgaagcccacttgatcatggttgataggctttttgatgtgttgctggattcagtttgccagtattttattgagggtttgtgcatcaatgttcatcaaggatattggtctaaaattctcttttttggttgtgtctctgccaggctttggtatcaggattatgctggcctcataaaatgagttagggaggattccctctttttctattgattggaatagtttcagaaggaatggtaccagctcctccttgtacctctggtagaatttggctgtgaatccatctggtcctggactatttttggttggtaagctattaattattgccacaatttcagagcctgttattagtctattcagagattcaggttcttctggtttagtcttgggagggtgtatgtgtcgaggaatttatccatttcttctagattttctagtttatttgcgtagaggtgtttatagtattctctgatggtagtttgtatttctgtgggatcggtggtgatatcccctttgtccttttttattgcgtctatttgattcttctctcttttcttctttattagtcttgctagcggtctatcagttttgttgatcttttcaaaaaaccagctcctggattcattaatttttttgaagggttttttgtgtctctatttccttcagttctgcactgattttagtcatttcttgccttctgctagcttttgaatgtgtttgctcttgcttttctagttcttttaattgtgattttaggatgtcaattttgggtctttcctgcttcctcttgtgggcatttaatgctataaatttccctgtgcaccctgctttgaatgtgtcccagagattctggtatgttgtgtctttgttctcattggttttaaagaacatctgtgtttctgccttcattttgttatttacccagtagtcattcaggagcaggttgttcagtttccatgtagttgagcgggtttgagtgagtttcttaatcctgagttctaatttgattacactgtggtctgagaaacagtttgttacaatttctgttcttttacatttgctgaggagtgctttacttccaactatgtagtcagttttggaataggtgtggtgtggtgttgaaaaaaatgtatattctgttgatttggggtggagagttctgtagatgtctattaggtccacttggtgcagagctgagttcaattcctgggtatccttgttaactttctgtctcgttgatctgtcaaatgttgacagtggggtgttaaagtctcccatttttactgtgtgggagtctaagtctctttgtaggtcactaaggacttgctttatgaaactgggtgcttctatgttgggtgcatatatatttaggatagttagctcttcttgttgaattgatccctttaccattatgtaatggcgttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgatgggtcttgaccctttatccaatttgccagtctgtgtcttttagttggagcatttagcccatttacatttaaagttaatattgttatttgtgtatttggttccgtcattatgatgttagctggttattttgctcgttagttgatgcagtttcttccttgccttgatggtctttacattttggcatgtttttgcagtgtctggtaccagttgttcctttccatgtttagtgcttccttcaggagctcttttagggcaggcctggtggtgacaaaatctctcagcttgtctgtaaagtattttatttctccttcacttatgaagcttagtttggctggatattaaattctgggttgaaaattctttcctttaagaatgttgaatattggcccccactctcttttggcttgtattctgccaagagatccgctgttagtctgatggccttccctttgtgggttacccgacctttctctctggctgcccttaacattttttctttcatttcaactttggtgaatctgacaattatgtgtcttggagttgctcttctcgaggagtatctttgtggcgttctctgtatttcctggatctgaatattggtctgcgttgctagattggggaagtattgtcctggatcatatccctcagagtgttttccaacttggttccattctccccgtcactttcaggtacaccaatcagacgtagatttgctcttttcacatagtcccatatttcttggaggctttgttcgtttctttttattctcttttctctaaacttctcttctcgcttcatttcattcatttcgtcttccatcactgataccctttcttccagttgatcgcatcggctcctgaggcttctgcattcttcacatagttctcgagccttggctttcagctccatcaggtcctttaaggacttctctgcgttggttattctagttatccattcgtctaatcttttttcacagtttttaacttctttgccattggtttgaatttcctcctgtagctcggagtagtttgatcgtctgaagccttcttctctcacctcatcaaagtcattctctgtccagctttgttccgttgctggtgaggagctgcattcctttggaggaggagaggtgctctgctttttagagtttccagtttttctgctccatttttttccccatctttgtggttttatctacttttggtctttgatgatggtgatgtacagaagggtttttggtgtggatgtcctttctgtttgttagttttccttctaacagacaggaccctcagctgcaggtctgttggagtttgctagaggtccactccagaccctctttgcctgggtatcagcagcagtggctgtagaacagcggatcttggtgaaccgcaaatgctgctgcctgatcgttcctctggaagttttgtctcagaggagtacccggccatgtaaggtgtcagtctgcccctactggggggtgcctcccagttaggctgctcgggggtcaaggacctacttgaggaggcagtctgcctgttctcacatctccagctgtgtgctgggagaaccactactctcttcaaagctgtcagacgggacatttaagtctgcagaggttactgccgtctttttgtttgtctgtgccttgcccccagaggtggagcctacagaggcaggcaggcctccttgagctgtggtgggctccacccatttggagcttcctggctgctttgtttacctaatcaagccttggcaatggcaggcacccctctcccaccctcgctgccgccttgcagtttgatctcagactgctgtgctagcaatcagcgagactccgtggccataggaccctccgagccaggtgtgggatataatctcctggtgtgccgttttttaagcccattggaaaagcgcagtattagggtgggagtgacccgattttccaggtgctgtctgtcacccctttctttgactaggaaagggaactccctgaccccttgtgcttctcaagtgaggcaatgcctcgccctgcttcggctcgtgcacggtgcacttcacccactgtcctgcacccactgtttggcactccctagggagatgaacccagtacctcagatggaaatgcagaaatcacccatcttctgcatcgctcacgctgggaactgtagaccggagctgttcctattcggccatcttggctccacctccaatcatttgtttaacagcaaacttagcagatccttgtcttatcttgaaatcttaaaatgattatttaaaaaaaattattttttccaaggatcagttctattctgtatggctttttttttttttccagaaaatttcagctggtcaggtgcagtggcttatacttgtaatcccagcactttgaggggccaaggtggatgaatcacttgagcccaggagtttgagaccagttgggcaacatggcaaaaccccttctctacaaaaaaattaaaaattagctgggtgtagcggtgcctgcctgtagtcccagttactcgggaggctgaggtgggaggattgcttgaggtggacattgcagtaagccaagatcacaacagctgcactccaccctgggtgacaagtaagaccgtgtctcaaaaaaaataaaataaaatttcaggtgttctggtttaccactgctgtcagatttccatgtactttatttcatattgtactccttaattggggtatatcggaaagaaacatgccaatacacacactgtatccttactagcctccaaacaagagtgtttttaagccgggcgcggtggctcacccctgtaatcccagcactctgggaggccaaggtaggcggatcacgaggtcaggaaatcaagcccatcctggctaacacagtgaaaccccgtctctactaaaaaatacaaaaaattagctgggcgtagtagcgggcgcctgtagtcccagctactcgggaagctgaggcaggagaatggcgtgagcccgggaggcagagcttgcagtgagccgagatcatgccactacactccagcgctccagcctgggcgactgagcaagactccgtctcaaaaaaaaaaaaaagagtgtttttaaaaggataagcttattcccagaactgtctgaagaatactaacattcccttttgtgcttttccagcagtcccaaagaattcattgtccttaagtcaaacctggatatatatgaaggttgatttggtcagtcgtgtgtatctaccttctcatttgcttgttggcgagtagagcatctctggctcttacacagactgaatgtataagactctgggccatccataaccttcattattttgaccttccacattttctttcttctgccctttgttccttccttccttccttccttccatccatccatccatcttttcctttccctattttgtatttaaatgcttttgtactggccaggcacagtggcttacgcctgtaatcccagcactttgggaggccgaggtgggcggatcacgaggttaggagttcaagaccagcctgtccaacatggcgaaacttcatctgtactaaaaatacaaaaattagctgggtgtggtggcgcacgcctgtaatcccagctactcaggagacttaggcaggagaatcactttaacctgggagccggaggttgcggtgagccaagatcacgccattgcactccagcctgggtgacagggcgagactcctcctcaaaaagaaaaaaaaagaaagcttttgtgctaaaattatcaaatcagattttatggccttgtcattgggaatgagggataattagcctgattttcctatgtccttctttattagtagtcctacaaatggataaaatgtctttgatattcttaactgtgttactccttggtaatttactttctgtagatttctgactgctattaatagttttatagtttatgtctaaggctgttttgctgtttttatttgaagaattccaaggtataaaaagattagtttgaccaacaattttaatgaataaatgtggttttttttctttttcttttttttttttttgagacagagtctcactctgttgcccaggctggagtgcagtggtgtgatctcggctcactgcaagctccgcctcctgggttcacaccattctcctgcctcagcctcctgagtagctgggactacaggcgcctgccaccacacctggctgattttttgtatttttagtggagacagggtttcaccgtgttagccaggatggtctcaatctcctgacctcatgatccgctgcctcagcctcccacagtgctgggattaccggcatgagccaccgtacccagccaataaatgtattttaataatatgacagattgtatttatttgtgcttgaatgagtgaaaaacctgcttcctttcatgatttttgagaacagtgttgtcaataatttgcccacaaaactgctgagattttgtaaatggaagtctaagggaaaacattaaggtctccagctatctttgtgcgtgatactagggattttaaaagataaatgtgataaactatgtttagttttaataactcaagttagtggcagagtttaaaaagtaagccttttaaaaataaaaatgttatttattttagaagatacctcctgaagttaattgactgtgacacttgcttaagtaactccaagacttgaattaaaaatttgcattaccttcctctaaactgagtttaagaaatcacataacaataatttactaacatttttatgactctttaacatttcagagcctttttatagacattatttgttcctcaaaataatttcataaagtaagttcgatgagcaatagtagtattcccatttgaaaaataatctgccagtggggcacagttggtaagtgacagaattggtatttaagtctgtctttgcttttcattatgaagaattttaagtatataatgacttatttggtacattcccatgtactcattatttagtgggtataagcagtgcttagctatttgtatttgctatatttgctttatcttttattttgctatagtatactatgaagcaaatcccagacatttaacttttacctgtgagtattttagtgagtatatagctctaaaaaaggacattatctcaataatcccaataccattatcatacccaccaaaattagcagtaatttttttaaatatcaccagatactcagttcttatttaaatttctctgggttatccccgaaatgactttttacagttggtctgtttttgaatcatgacataaaacaagactcatggtattagtggttatgtctcttaaatcacttcatctacaacaggaaatcccactttccttttcattccattgacttattgaggagaccaacaggcaggtcttccgatgtttaattcagtattccttctgttattctaagctgcctcaaatgtaagttttaaatctaagtaaagaaatgaataaaataaataaataaaataagtagaagacaattctatgcctggtctataaaataaaaatataacttttcgttttaaagaagaggcccactgagtagtttattgtaactaaaatgttgctgtaatagctaatttcataagcagctttaacgtcaaagcatccaaaagaactatgttcttgttacttttatgcttgtgtaacgtttttgctaaatacagtcaataagaatgaggacgatgtaaagaaagcctagtctttgccagtaacataggtgtagtccagtttttctttttgactgacaggagaaatataaatggtaaatcttaattctgttacatgttctgttgttgtatataacaggaagctttcaggcatttgttgtttgtaaatacttcatctttattgctcttaccaatgagcagctattaaatattcattccatagtatcaacaataatagtattgatttctaaaaattagtatgtttcatccttgtgtaactctcatgcccttataatccatctcagtgttaccctagactaaactcccaacttccagaaatggcaacaacaaacaataggggagaaggtaggaagagctgagagttgtctgagctcagggcagtggaggttagaactgtcatagagcttgatacatgttaccctgtggcttatggcctggcccatcaggcctggttgacacccggtaaggcttagcattttttcttacggttctctacattgagagacattagtcatcccatgaggatgcatcactgttgttttgcaaaccagcattggcagaaagaaggacttcaatcttttgaatacatctaccctaacattttcatctctgtacctgcaatatccttgtaggctgcctttcaaggaagtgtatgaagagaaagagaaggcgtgggggagaaaggcagcatgggtgaataaagatgcattctttccagatgctcagttgcactgcctctctttgtgcagtgttcactgaaggatttaaggatgaagcataggaatctgctgtgtgaactaattccctggcttttcctaatggtgtgtaaatttctcattccctaaggcacagtattatttccagagttttctttggttttcataactagtttttctgagttctgtcctcagaatatagtaaatggaagaaatgagatgaatctacaaaaatgctttttaaaacctcctcaaaaaattatttacacataaaataattaaatattttggctcttctgcaacctattggttaaagtacatctttaatgtacaactataactaagttataactaattgtgtccttatatttcaaagacaggtacttgtctgtcttctctcaccccaaaggaatgactacaaagtaaaggaaattggtttaaaacaaaaagcttgagatttcagagaaaggaacatttacataatagcatatctcagcctatttcttgaaatgcattgtttctctgtagctctctttcctttttttttttttttttggcatgtatctagtgttaagaaaatacagtgtagcagctgtttatgtacagaataataccacagtggatgggtaaaatctcacttgctaagaacctaagtacttacctattttaatgttgtacaacctcaccacctgtgcaagggcaggcctcatttttaagagtctgatcatgtcacataatcttgatggaagtaattgtatcaacggttcaggaaactcaaacggcctcttcttcattctcctttgaatgggtcagtgctattaagggcattgctgagagaagcagaaggtgattttatttcaagagttattgattcatgcttcccctgttttgtttcaggtggatcatccatgccatggagtatgaacttcagatccgtggcggagacaagccagccttggacttgtatcagctgtcacctagtgaagttaaacagcttctgctggatattctgcagcctcaacagaatggaaggtaataagggccccttgttacctacatgatactctggatttacaataacatcataatttttagcttgatatatctatgaaattgataagatattaataagtaaaattcaacagagtgtcagaggccaccccactagatggaaagtgtaaacagaaagaccaatcaaaatgtctgtcttcaattattattttgcattgatttgaattttatgctttttttccagtatagtttataagcatttcttcatttttattattctgtgcaaaatgtaacacctcataccactttctgaagtcagtttcctttctgaacctttgtggcactcaccatctcctcccagcattttggcagataggattgggtttggtaacattatttaaatatgttgcctgtgactttgtctccctaaatagacttcaatgctaaaccctttcctagacttgtgctaagcttacactaagaacaaaacaaatacttgtggattgtgttgacttgaagaacttttttattacagaaatagctttaatgtaagtatttaggaaagtatttattgagtacatttgtgcctggcatttaccaaagtggtatagttatatgcctagaaaaatctgcctaggccttttacaaaagctgtcttccacaaaaggaaatttgaataaatggaaaggcatcctcgttcttaaataggaacattcatgttataaagatgtcagttgtaaatataattcaattccaataacattcaactagctgtttttatgaggttaagacaagttaatacaaaacttcatatggaaaaacaaacataagaataatcagaaaaacataaaagaaggacttgccctgctagacattaaaacatactataaagcctctgtaattaaaacagtgtgatattggtgcacaacagacaaatagaagagttgaacagtatagaaagtccagaaatagacccccaagtatatgtggaaatttaatgtgtgacaaaggccaaggatggactttttaaatagtgatgagacaactggatagccatttgcaaaaagatataatcacacctgtagtttataccacacataagaatacactccaaatagattagaaatctaaatgtaaaaatgaaataatagaaaacaagaagacatggttaaattcctttttactcttagtatgggaaagaccttctaataatgactcaacccaaggacaacaaaagaaaaagttaataagactatatgaaaattaaaaacaacactttgtatggcaaaaagtagacaaccaatgtcagaagataactgagaaactggaacaaaacatatgccacaaagagcttataaccaagaattcttaaaaattgaaggacagacaaccaaaatcccaaaggaaaatgggaagaaacattcttacatacccatgagtctatgctaatataaatagacaaatgggagtgaagagacctttcttataatagaattccaattataagtgtagataggatgacaaaaatagacaaatacaatagttaccattgttgccggcaaaaaccatcattgcatggaagtatgatgaaaaatggagagtttcatcattccaatgtgtttccactcaagatgcttaaattgtaaaggaaaaaatagtgattttacagtggagaaacccagctgactctaccttaaccaaaagattaaggtgaacatcgccagtaataagacacatcaaaatcatatatcccctgatatgatgcattgaaaagggcatgatgggccgggcatggtggctcaagcttgtgatcctagcactttgggaggctggagcaggagcgtcctttgagtccacgagtttgagactagcctgggcaacattctgagaccccatctctataaaaataataaataagaaaagtgcacaacatcacttctagatactcttgccaaaaatgcataatctcagtctattcatcaggaaacatcagaccaacccaaattgaggtacatcttacaaaataactgacatttctaaagtgtgaaggttatgaaagataaaggacaaccaagaaactgctagaggagcctcaggagacacggaaactaaacaccaattctggattggattctggatcaaaacaagaatattagtggtaaaattgacaaaatttgaattagatccatagattaattaatagtattgtatcattgtttactccctggttttatactatagttatgtaagataacaagagtagaggaaggccaggcacgatggctcacacctgtgatcccaacaatttgggaggctgaagcaggcagattgcttgagcccaggagtttgagaccaggctgggcaacatggcaagaccccatctctacaaaaaacacaaaaattagctggatgtggcggcacatgcctgtagttccagctactcaggaggccgacatgggaggatcacctgaacccagtaagctgaggctgcagagtcgagattgcaccactgcactccagcctcagtgatagagtcagatcctgtctcaaaaaaaaaaaaaaatggaaaagggaagttaagtaaagagtatacaggaactttatggtttatattcatgacttttctgtaagtctgaaatttttcaaaatgaaaagacaaaaaataaaggatctttcaaaataattttctacctccattatgagtattctcatgtttctactttttctgttgtcctacgaagtatctcctttttaaagtattaatcataacttcatataactccaaaaacatattttttaattgccaaacaaagggaatgaggggaaaataaaatgcaggcagtggggtatccagttatctaaagtaaaacatcaccaaggaacccttagacgtttgagctttgtcactttggtgaaacactaaagccagcaatgcaagcccgtgcctattaaaagaaattttatgtatccaaaaatagatgcccctcttacctatgtagtgataaattttcattggtcctctttctccagcgcaaacgtgtctttttctgtttactgtatcctgcatagctattgtcatacctagaaatagtgttggtcatgacatatttcccttgtaattgagtatacatttcactctgctgtcttttaaaatactaagtgtaaaaaacgtgtatctgggctgtgtgccgtggttcatgcctataatcccagcactttgggaggccaaggcaggaggattacttgaggccaggagctcaagaccagcctggacaacatagccagaccccatctcaacaaaaaatttaaaaattaaccagacatggtagtgcatgtctgtaatcttagccactggaaaggctgaggtgggaggatcgcttgagcccaggagttagaggttgcagtgagctatgatcgagccattgcactccagcctgggtgacacagcaagaccctgtcaaataaataaataaataaataaataaataaataaatgtatctgtcctttcttcaacttttgcaagaatatttttagcagtttgtgaatgatgtattgtatctttaaaatttaatacttaagtgcttaatgcatgaaaataaaagatctaaaattttggtgtatcactacattctgttattataatgtaagattttatatcttttttcagcaagagaactttagctatgtctaaatagcaaacttctataaggtttaaaataaggtaattttattctatataaaatgcttttttgaacatcatttattcattcactttttaagtgtttactaagcacctttctgggagaggtgtataggactgatcaaattatatgatttccatgccttcatggagcttacattttattatatgtgaaaacaacatcaagttattatgaaattcacagctgctgcgtttttaaagggagctgctctgtatacttgaaaatcatttgagcatgtagtaagcaattcatagcttacttacaggataacattttgtctgttaaattttttagaatcttggagacttcctcctgtcctgccagccctgttttcattatgaaatatttactagcctctgtaacacacggagatatgcatcattgatgggctttggcttttatttcttaccctatcagaacaattagttcatattgaaagccctgctgtctaccagaacaagcttgttcttcaactctgagacatttgccttttgttacagatgttggctgaacaggcgtcagatcgatgggtctttgaatagaactcccaccgggttctatgaccgagtgtggcagattctggagcgcacgcccaatgggatcattgttgctgggaagcatttgcctcaggtaaagccccaccatgttcacataaagaaaggagacttcgcaaagggtagtgaatcctttcctcttgcactgcaaataacttttctccttttcagcgttctaagagtattttcaaagaaggaatgaaatactagaaaataagacatctaatcaattggattgaaaatttttttccccaatctgagttacttttatttttcaaatttagtgtccctgtaggcagaaaaggctcactttaccaaatggctatattgctggaagtcatatttaataaaaaaaattgttggtattgtcatattttagatattttgaggatattccctttttaaaaaccacatagccaaacctcttgttgagcaagctgtccttcctttgtttacttaccagcttagagtttcctatattggctttactttaagtgtgggtaccccttcactacccccaagtggtggtgggtcagtgctggggggcctcacaaacagtaaagcatgcattggaaagacagaaccagagcagacctaagaaacaatggggcctagtagtgctgtggatgaggaaatcaccacttaggaattgtgttgaatgtggaaaatgcagtaactttttaggtcattggacagacaatcacttacttcactccaggtgtaccttacctgtggtccaagtgagttagtgccctctccttctgatggtttcccatgtgatatacactggcctgcttctttgatgtgattatttaatcctggcatctaagtcattctacttatacacaaaagagaaggattagccttttggaaatagagtactgtaattgtttttagtgttgaaatctcaaccaaataaattttgatgtagttctttatacaaataaagtattctcaaaggcacagacccacactcattttgcttgtatctacctaagagtgtctctgtaaggacccataggaaattggtagtattcttttcttagtctttggtaaaaggaactgtgtgagtgggaggatggtgtgggctcttccctggaacccttttaaacctttcaaagtctgaatgctgtgaatatattacttattaaaaaaaatgcataaaaacttttaaaaagtatttatactgttcacagactgcaagtagtttcatttgactgtcagtgcagggcccagccctctcctgggtgccctatgattactgttgaagagcagcaccatctcttgagagcagagagcagcgcctcgttgctggagttcaaaccctctggcaaggcctcctgtctgcctacctgggcagtgcacgctcacaaccacttgttagcttctttctcagcccccactaatacttaccagattttcatttaattgtctggcagtctgggccacttaacatgtagtatccttgctttgctaatatcctctctttgctaaaaataacaataagacaataaatacatgttaagtatttttatgcaccaagcacttttctaagtgctcatttaatccgttagacaattttttgaggcagatgctttgttattagtattccagtttgacagaagaggacacaaacacagataaatgatttcctcaaggtcacacatctagtaagtagctgccccaggatgtgacccctggcagtgtagctgctgagccttttctcttaacttctctgctacactacttaccctaagtcctttcagaagagtaggaaataaggcaagcttggtatctcttctgtagttgcacagtagctaggttgacttttttaatgagatatattaagaaaaaattaatgtgaaaccaagaaagggtcttcctttccttctgtaaccccgttaagcccattgctagagatctagccaattataactgtgtttagcaatggggctttattttccccaaattaggtactatctgtaaacattaataatatgttggattatattgactatgaaatacaatagttagttgtattgaatatctattgaatatagactaaggcattattataccaggctgaacaactttgctgtcacttgattgaaagaggacattgggtcccattttgagtggtaagtagatagacatggttctgaacctgattgagttcactgtaaactatcactgaggtgaaaacaagtatgtctcatcatttctgcctctctggtaatgatctagtcaccccatctgccttccaccatacaagcctaatgttcagagccttcccttccatcctctgaggaatattccccatgcccagatttggattttaattttagtttattttctgctttcatttggattgtgaagaaatgaatggaaaactacacagtattcttgttttaaatgaaagataaagggcagagtagaggaaattcttttagcgtcgcttttttcctgtttccttcccagttctgcacataatattgtttttgcttgtttgtatgcatttttatgctgccagctcagaaaggagctgccacagaaatgatgtaaattcattagcaggtgacttctgtgcgggagcctgacagcaagcataacttctcgtgtaaattctgaaagcaatatgtacactatttgttgtctcagtgtttggctattccttttgtgtattaaagtggccttctaacatagtcctttttctcaaaaaattaatatagtgaaggtaactactaaaaatgggaggtttaatttatcacaatagtcagctggttggctttagtagtttgacatatataaaatccagttgtgtagctgaaaatgttctccaaggttttataaaaactgaaaactattaatgattagaaaatgaaattcttctattaaatgagaaccagagcataacggttcagcatgttaatgtggagttatttttttcagcaaccaaccctgtcagatatgaccatgtatgagatgaatttctctctccttgttgaagacacgttgggaaatattgaccagccacagtacagacagatcgttgtagaggtgagtagtaagaaatgaagattgctgaataaatgccttctctctgctccgtgaaaactagtataagggaaactgcctatgagacccagaatcctattctttccagtaccccgatctctcctgtgagacccagaaccctattctttccggaaccttgatctctcccagccgagtcctcaagaagatggccacccctgacccaaggcaaggcacacgagcaattcagacacctcaggctcctccaggaagggagaaccgacccctgcttttcagccacacaatcaccccttagcatcaagtgtatcagccacatcataaaagtacaggaagtgacctttttctattcactttcttttctattcacagaaataagcacaactattgtagaaagtttcagcagtttagaaaattatagaaaagaatataagtttcccccacactcactagcaagagatcattgctgttaatattttgagggacatctttctagacatctctatgtgcagagaagacatgtcattgcatggtgtatcactgccctgtataaagttacatgtaaaattaacagaacacatgtgtccttttgtcatgttaaacatcaccccaaatacatagagaagccaccaattgatgagtttaatatttagcttatccgcactttgtctctttccctgggcatgtatccatccgacttttgtgtttctcaagggtagataatatgtcttattgctacggaagctctgtgtgactgccaacctggacatggcacctcctaaaatctagcatgtctggagctgcagtcagagctgagtagatttagcctcctctttgatgtcccaggatgtggaatagtatcagccaatcattttcacagcatgaggcagactgggtcgtgaaaagacggggttattaggcaggtgaatgccttccatgtctagtacccagcatctgggacatatagtagacatagagatccttcttgttgaccacagtgaagtcattccctttgcagaagacactttcctttagacctacagcaaaacttcatattctcatggctaaaggcctgccctaaggtttcccacattgtgacccctggattttactgtgtttcctttggttctttcaggttctgtttttgaagcatcgagataaaatacagtcaataagaatccaaaattgggaactatgaggcgtgtttcctgttcagtgtacaaattaggagccataaacatcatcagagagcctttaccaattattgcatatgcagatattatttttgcttataggaatttagcatctaaaatgaacattaccacttaggataggtgtatgtgatggccaagcaatagggtgattcattaaactaagatagtttatacagaccaaataggacttttgtcacaggggtcagagttaaacatatttttttaaaacatggccatcccttgagaaactactgtggcatcacagacttatactcatttgggtcctgggctccaggtcgtttgatcctgaacctgggtccagagtctccattgaacctgcctggcttctctggctttggtccctgacccgtctctccacagacagtgttttggtgtcttgccaacaaggattgacacccaaaggcctagaaagagttcagacactttgggtgaatagggtatcatgtattatgtacatgatgggttaggaaagtcatttttctaagttaacggttttatttaactgatgaaaaaacatttctagggatacacacaatgaaaaaaaaggtgcactttccaaacagaatttatgcaaataacttgcaaaattaggaagattccttccataggtgatccttgagcccctcatcatatagaatatcctttggatcacccatccatctgatcaaagggtgaaaacatgtcactattatggttcatatagttggctttcaatgtctgtctcttctagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaagtaagtacacagctttttttttttttttttttttgagaattttttcattgtctcaattctttaaaatatccctaatctcttttcatttactttataaaacagattcacaggtgcaaaataggatacttgaggggcagtctgcctttttcgaggaattaatgttacttttcagttaattactagtcagttcagctgtgaagttctgacaaaaaagagatctagaaagagataaatttcctttatatggttagcataaaaatgttttatcagagaggaggcatagactccagaaggctataaaattaaattctggggacaatagaatgcagtgacaggctacgttggtgctgcgtactgcctaatataggcccttccaggttctctgtttaatattttatgttcaactgtaaagaggttctctaagtaaataaaaattatcaacaaaggagagaatactaaaaatatctgtctttgttttatatacacctcaggaaaatgaaagaaaagctcaggaatctcatattttccataaggaaatctttatgtgaatttatttttccccctaagctgacacagattttacctgtcaactctttacaaacagaagatcgaatgccttgcctactgttttcctttgtaggatgacatgacttccttttacaacactcctcccctgggaaaaagaggaacatgcagctatttgacaaaggcggtgatgaatctgctgctggaaggagaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactagtaatgcatactggaaatcaaaagatactgaaagaatggtgaacttctcttagtggtattgtcatgctaaaagatgttaatatacatcataaaagcaaagtcagccagctgatattttggttctcaaaaactgcattattaataatattttagtatacagagctattctacagtttttacattgtaaacatgactgtggttttgtatttgctaaatataggggttggactaaaatataataaatctgtaccttatcaaacattttctttgagctcctgctaaaaataggacatgtctatgattgttcaaaaatatgttaaatttaggctcagcacagtagctcacacctgaaatcttagcacttcgggaggctgaggcaggtggatcacttgaggttaggagttcaagaccagcccagccaacatggtgaaaaccctgtctctactaaaaatacaaaaattagccaggcatgatggtgcatgcctttaaacccagctactgaggaggctgaggcatgagaattgcttgaaccaggagacggaggttgcagtgagctgaaatcctgccactgcacaccagcctgggtgacagagcgagactccatctc

SEQ ID NO: 36239 - DNA, 5656 bp, Homo sapiens
gggcgctgagaggcgagcgtgagcccagcgacaggagagtgaggtgggggccctggggagggatagagggactggggctccgtggcttgaaagccgggcaactgggaggcgttggggtttttcttgtttgttttttgtttttgtttttgcctttttttttttttaggagggcggggggagtacaagtctgggttcaaaccttgctcagctactctatgagctgtccttgaacctctctgagcctctcagctttctcctctgtaaagtgggcattctgagcacaaacttcatggggctcttttggggattaaataaggaaatgtgctggaagcagacagcccagcgcctgaaacagaatgggtgctccttaatgggggctccgaaacacggtatcctacccctgtgggaagtccgggagccgccgtggggacaggctgtgtgcaggagctcaccatttccagggtcttggaggggtagttagccattcactttgcccccagctcaccacgcgcagcgccatgaccagcaagggtcccgaggaggagcacccatcggtgacgctcttccgccagtacctgcgtatccgcactgtccagcccaagcctgactatggtgagaagacggtggttccagagcctgtgacggggcctaagggacggggactgtgctctaaaccagcctccaacccctgtcacccagctgagccccactctgctgtcccaaatggctccccaacccctccagccattccccaagtaaatagactgaggcagcccctccaggttagggaggaaccctttccccagagactctgctgctgaccaaggttactcctggcagctggttaaagaaaaacttcacctcactctccagggcaggagtggtgggggaagcctgaggcagccacagggaaaggagaggccctccagaagcccactggggctggacaaaggccacagcccttagggagtcaagcttggtggctagggcctgggaggtggctcctgcctgttatcccagcacttcaggaggttgaggctggcagattgcttgggcccaggagttcaagactagcttgagcaacatggcaagactctgtctctacagaaaaaatacaaaaattagtcaggaatggtggcacacctgtagtcccagctactccagaggttgaggtgggaggatcgcttgagcctgggaggttgaggctgcagtgagccgagatcgcaccacttcactcctgccttggtgacagagtgagaccctgtctcaaaaaaaaaaaaaaaaaaaggaaaagaaaaaaaaaaaacttagtggctgggaattgtgtacatgggtccaaattcctcctctgtgattaatcagctgagagatggtgggtgaatctcttcatgtctctgtgccatagtttcccatatttaaggaagataacaccttcctccaaccctgtgtccagacatccccctggacttccagaaagggtcactgagtagccaaaaatatcttctttcttggggatggaaatgcaagcatctctgagggatatggagtgtgtcggggaggcagcagcccatttctgggtatgctccactctccgggctgcctgggctggtgggaagctgtgggtaggcagaagcagccccaagacactctgtgcctccaggagctgctgtggctttctttgaggagacagcccgccagctgggcctgggctgtcagaaagtagaggtgagcctggggccctaagcggggaagggaggtgggcctgggcacttcctcaccctgctcagaccacctaccctcctgaccatctccaggtggcacctggctatgtggtgaccgtgttgacctggccaggcaccaaccctacactctcctccatcttgctcaactcccacacggatgtggtgcctgtcttcaaggtgtgtaaggggctggggaggtgggcagtgcaggccttggggacagacatgatgcagaccccaggattcaacctcaagttgctcatggtcctggccccagtcctgacactaactctcaacatccttatgacattacaccactcaagcagccttcatccagcagcaagttctgggccagagtggggtggggactggggggtgggaagcaggagacagcaatgggggatggcaatcagctgccttcttcagcccccgtctttcctctcccaccactccacctgtcactccaaccctatggtgggctcctagggcagggccactgttgaccagagtggattaatggctaaatttggggtttgggcccctcttcccatccctgcccccaggaacattggagtcacgacccctttgaggccttcaaggattctgagggctacatctatgccaggggtgcccaggacatgaagtgcgtcagcatccagtgagtgtcctccattcctactcctccacaatgtccccactggtccagtggattgaagcaggacctgagggggtgattggagaaactcaaggccaaggaacaccgtgacctcttggacaggaactactgccatgaccattgcatggatagggagattcagaccagagaggggcagggactttctggagtccctatcagggtgtggcagggtaaagtccaggacacaggactccagcctgctggccctgcctgtggggccagcctgcgcatctggtggctcccccagcacctggcttatgccccctcaggtacctggaagctgtgaggaggctgaaggtggagggccaccggttccccagaaccatccacatgacctttgtgcctggtaggagtggctcagatacctttgggaaaggggagggtggggcggggcagcctcctcatctcacgtccctgctgcttttacagatgaggaggttgggggtcaccaaggcatggagctgttcgtgcagcggcctgagttccacgccctgagggcaggctttgccctggatgagggtgagcaggttggcaagccaatgagcagccaggcagggagtaggaggctgctagtggggactgagctgctccaccctctgaaccccctttccctcctcaggcatagccaatcccactgatgccttcactgtcttttatagtgagcggagtccctggtgtaagtatgagcttggagggagggctcactctacaggcgggaggctaggccagaaagggcacggtcctatgcagggttgcacagcaaagttgaggcctgagaaggccttgaacccagggcctctacctcccagctctttcctatctgagcttctctgagggcaagccctgaatgggcagaaaccagctgtatgctacgggccctgagtggggacaggaccctgccagaggagcctggaatgagggggagacctgggcccaccccaggctgattgtgtctccagcccctcaggctgaagacactgccttccccctacacctccccaggggtgcgggttaccagcactgggaggccaggccatgcctcacgcttcatggaggacacagcagcagagaagctggtacgtggcaccccaggagggagtctgggagttcaggaggctctatcctgaggccactgtcccatttaacctcatattctcatagcacaaggttgtaaactccatcctggcattccgggagaaggaatggcagaggtgaggcagcctgggaggcagtggggtggctctgggaggcggtaccacagaggatagagtctgagccacctcttttatctgttgctgccgctaccctgcccccacaccacaggctgcagtcaaacccccacctgaaagaggggtccgtgacctccgtgaacctgactaagctagagggtggcgtggcctataacgtgatacctgccaccatgagcgccagctttgacttccgtgtggcaccggatgtggacttcaaggtgccacctccacctgggtttggaggagggatcctgggtcctcagtcttgtcctagaggcctctggaaagcctgaaggatcagctcgtctcccttctcttaggcttttgaggagcagctgcagagctggtgccaggcagctggcgagggggtcaccctagagtttgctcaggtatggacttgggacatgtgatgggagagtgtgggagccgggggagacccaagtgtgcaacagtggagtgtgtgcttggtgtgtctgcatatgtctgggcatttctttatctgtgacagacacattttattccaacaagcattcattgtagaggccactgtgggtgctggggaatgctgtggggagtaaaattaggcacagttcatgcccttgtatggtgaaacggggagatataaatcaaacatttatgtgatattacttttttctgagagaatctcactccgtcacccaggctgcagtgcagtggcacaatctcggctcacctccgcctcccgggttcaagcaattcttgtgcctcagcctccagagtagttgggattacaggcacctgccaccacgcccagctaatttttgcatttttagtagagacagtgtttcaccatgttggccaggcttgtctcgaactcctggcctcaagtgatccacccaccttggcctcgcaaaatgctgggattacaggcatgagccactgcgcccagccgtactttcatataacccatgtggtacaggaaagggtggccccttgcactctgaaaacctgtaactggagtatccaactagtctgagaggtctgggggagccatcttgaggaaggggcacttgggctaggatctgaaggatggacaggaggtaagtagacggagggtgggaaggtcccagacctaggacatttgaggggctgaaagaggacctgtggctggactggctacccagatgtctgggtaggtgaaggagtgggggtggggaggtgttatgtactaggcacagcccactctatgggaaatagggcaagatgcccaggcccatgtcctgatcctgccattcttcctgtccctcagaagtggatgcacccccaagtgacacctactgatgactcaaacccttggtgggcagcttttagccgggtctgcaaggatatgtgagcacgctggccagctctcctcacagcccagccccctactcctctccttcctgctgccccctcccttctccctccttctcccacctctttcccaccttcctttgccccttcaattcttcgctttctccctccccattcatcaggctctttctcctacaggaacctcactctggagcctgagatcatgcctgctgccactgacaaccgctatatccgcgcggtgagccacttgcatatagtgcctgggcagtggactgggcctgagtgctggcttttccctaacggctcttcctcacccctgcaggtgggggtcccagctctaggcttctcacccatgaaccgcacacctgtgctgctgcacgaccacgatgaacggctgcatgaggctgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacagggctgtctctgaagtactaacacaaggaca

SEQ ID NO: 36240 - DNA, 160435 bp, Homo sapiens
gtctgcccgccgccgccactgctgctgccaccgccgtcgccgccgccgccgccgccgccgctgctgctgccggtgctaaggagttcgctggagccctttcctcagacccggcccggtcttcgcgcccggactcctggcgccagcgctaggcgcactcaccgctctgacgggtgcagacgcgggagttgtcccagactgtggagtggcgggcacggccccagccccccttcccttccctgaccccttcttgccatcgccccagacatggggaacgcggcgaccgccaagaaaggcagcgaggtggagagcggtgagttgaaggccgggtctgggtatccgctgggcgggccggcgcggggcaccgagcgccctccgggtcgcagcttctgaggccgcgggcacgggccaggcctagcagcggccgccgggagtcgttctggggggccgggagaccagctgcctttctcctccattccgaccccccagctccgcgttgagagctgaacgcgaagggccggatgtggggatcctgggaagagcgttccctgggattccctttctcactctagcgaggaggacttgcacacgttctggaacacttccccaaatatggtccgaggaaagaagtccctagtgccatcccacccctgctttcccccctcgccgactctttgggagctacaggtagtgctgtgggtaaggttggctcttctccctccatcacttgggtccgacccaaccttatcacaaggcgggggctgctagtctggctctacgcaagtgaggctaatcctgagtggacaaccctgccttagagatccttcatctcttcagattaggaatggaaaacataatgagacccaacagcaactttatccattagagaaaaaagccaggcaggtttgccttttctctagacattcaaggatctgctaccaatgcctgtaaaacttaaaggtcattcggagttgaagtgcttccagaacacggttaatttcttctgagagcggaaggtgcgggtactccacactttacatcaaacagtaaaaaatcatgaaaatggaatttctgtatggcgataaggtgtgtgtgtgtctgtgtgtttgtgtgtgcatgtatacacatgcatatatatgtgtgtatatatgtgtcagaatggttgtgaaataaaagttggtttgcctttgtaaagttcatatatttttataattcagaatgtccaaataacagatggtatttgttatatcaccaggagtgaatgacatgttagcacttaaagtgggcctggtgattttagtttgtgtaaatattacttgtaatgttttcatggttgtaacataagaattaggctaattttataactttgcatgaagaaaatagcttttttctgtattaataaagtagaattcatttagaaggatttagtcattcattttgtttaacataaatatatcagattatgtggtttatgtttcatcagtaaggttttggtattcattttcaggagcttcagaaaagtttgatgagctattatataagccaagaacacacagcatgttatacggagatttaaagaagccaatgtagaggtagaatgtatgttattttattattattttttgagatggagtttcgttcttgtcgcccaggctggagtgcaatggtgcaatcttggctcactgcaacctctgcctcccaggttcaagggattctcctgcctcagcctcctgagtagctgggattacaggtgcccaccaccacacccggctaatttttgtatttttagtagagacagagtttcaccatgttggtcaggctggtctcgaactcctgacctcaggtaatccacccacctcggcctcccaaagtgctgggattacaggcgtgagctaccgtgcgtgacctatgttgtctttttaaaattgcacaaatatagtaactaactgtgcaggaagtataaagaatgcaaaaagtataaagaattatttttacctgatatgttgtcattttttgtgttaatttaaagctctattaacttaaaacatgctaattgtgttacaaaagagtgtgcttggagaatgattatattagtagttttcattagcaagtgctgacctgtataatgtttatattttggataatgataatagactcttctgtgacctgtatattttttattaagttaccaaaacaattctcccttagtattaatttgcaactcatagctgtgaaataaccttggaatatttactgaaaacagaatggaaactttaaatgtttatctgaacatatttaaattatttctatggataaattcttttctatgttttaagtgttaatgacaatctagttcttaagtatgttagtcagctttttgtgtaactttatttatggaaactgaaggtcattatagtagtttaaaaagctgttgtgaagtgaccaaaaaaaatagcatgttatgtgtcatagggaaaattatttgaaatgtcacgtgttgattaatgtttgtaatttcatttggagcagtgttatcaggtatatgttgctgttctgtagtgaacaaagaaattgtattttaaacttaatgaaagaactcatcattacgtacctaaatgttctgtgtattttttaaagaattattcttgaaaatttgtttttcaaaacttttagaaatatatgatgttagagatcagcctgtacaatcattccctttcaaagatcctgacctccgaagaagctggagttgagatcatactgttagtaataacagagtaaggaatagagtctgatgcctggactccattcagcatcaataaataatcagttaatatgtttattttcaaaatattcaccaaatgttttagtttcaattaaagactataagtaaaagctgaaaaatgttactgtctaatgggaaagaaaatatgtatatataagagttacctgaaaggcaaaaatacaagtgctaacattatggaaagtggaattagaactctgaaaattgctgtatgaaaatgtttgatttgaaaagttgattaaaaatatcaagtcagttaagatttcaggttcagttagcaccaagcttcagaaaggcaggtgattccagagcttatttctaaaaatattccagaagaatgaagttaggcataaagataatttagaagggtcttggttaactttaactatctggtgcctgtattgtactctactgaaccttttccctctattagaattaacattttctggggtaagacctaaaagctaggtgagattccatcttcatctccacaggttttggagataacattaacttaggtacctgttgttctgctgtagtgaattaggaaattgtattgatgtatctcaaaacttaatgaaagaataactggtactattacatacctaactgctctgtgtgtgtttttaaaattactcttgaagatatattccttttaaaatttgggcgtagttatttaaacgtcagctaatacagagaaacataaacttttagaaatatgataaaattctcagagaagttttaaactcttgtcagttaagtttgttttacttatccagtctcttccttttacaccagccccagtcaccaacacaccaaaaaaacacgctacttcttttaacctgggaggggtttttatttatttcattttaaaaaaatactatacctccaggttgcctatggggctttgtgttatacattcattgcaaaaatgttgaggcccatgggtgaaaagtgttggtagaggtttgaatgtagattctttcatgactgcaagtcgtaaagttaccatgtgacctagtgttcgcatatgatctttgaatgttttccagagtatctctctgtcctgtggatttgaaagtcagtaggaattaatcaaagaaagccaccagtagactaggttcaacaaaaatgcaagtttcttaacaactaacattttttgaggactaatacgtgccaggttctctaatgctttccgtgtataaacttttacttactcttttaaactgtaaagcacttgagttattccttcatttatggatgaggaaatgaaggctcagagagcctaagtgacttgcttaaggttgcatagctagtaagtcaagaagcaacatttaagttgaggcaactgtaacctcagaacctgaaattctaaccactttgctgaacagcctctgtatccaatagaatagccgatgctaagacacacagaatagcttagacaattatagcacatttcagttttcaaacatgactttatttggtatattaaaatcttaagtgaaaaagattatttttttcttgtaccattctctggatttttatcatcattatcttttcagattcaatatagtagaatttcaaattaaaccacataaaactaattttatgtacttaaagccttaattactacagtacttatatttattttttcccatttgtaaatgtatacttttcccttcttgcccaatagttgataaaaaaaattattatttgaacttgtattaccattttaaaagtattggcaaattctcatttcaccatgattagagtagcgctgtccagtcaaacattctgtgataatggaagtgatctccacctatgctgtccactgtagtagctactagccacatgtctgttgagcactggaaatgtgactagtaccactgagaaactgaatctttaacttacatgtggctaattagtgtttggtatattggacaacacaggtttagaacatagttgtttttgcatttaatagaaatgccaacccatctttctgtcatcttggttatttgtggatccttacaagtgagtgtagatgaacggaatgctggatttattttttctcatttaagaattaacttatttcctcagaataagcatttataaacttagtgagcaaattattatagttcaataatttgtgtttaatttattaactacaaagttaaattatttttggggctgtactagaaataaaattttgtgatttttagtaatctcagtgaatatcttctattgaaaaatttctgtagatttaaatgcaatatagtgatttcttataccttacttaggtctttacacctttcaattatcaaaggaaaatcagtagcagatatttgttccaattctgtagaatgcagaggtactggggaagtctttcttgggtgtaagacaaaaaaatcaaagcaatcagttatgcaattttgatgataaatacatatgatctcatcgagttccatgattctgtgattctgtttgtgcagattgtgtactgtatcaaattatctcatgttcaggaaccatttttcttattctcctcctcttattctcctcagtgtccttcacttaggctgtagacagattgttgctttttcattgccagcagcaggataattagaggcatgaaagccagcttagaaaagtaagccatggctgagtgacagaagcagcacgtgagaaggtcctagataagccaggatagctattaagatcctgtcagataattaatagttgaccataattcattttgacattccattaaattaatttttaaaaattagtacaacttatgaagttctatatctaggtgataaatgtttgtatacgtgggtgatcaaatttcctcagattaataaatcctaaattcttagtgaataacattgtgttaaatagaaaagtgtgaaatttatgaaaggtaaatatgcttaggtcactatcattttgggtatttaatcttacttttaaatgtattccttcaagaatgtcctgtatagttctttgttcattgcttcattcattcctttattcagtacacataattgagctcctaaaatgtgacagactctacacaagactatgggaataaagattgaataggacagagtacctgctcagggtgcccatattccagaagggggaagatagacatgtcagcaaacacatgaaacctgccacaaatcctttcattaaagttcagctggggaaccaagggaaagaatggtcatttccactgggatggggaggaagaggttcaaaaaggacttcaaagaggagttgaaccatgacttgagcattgaaaatgataaatgttcatcagatggattataggaggaagggtgttctgagtagaccgagcattgataagtgaagatgcagaggagtgaaaccatgtaacatattcaggataaggaagtaagttgcccattatgattaaatgatggaatgtggggttggtgataggaagaggggacattgtataatgatagatgaaactgaagaaatggacagagggccacataatggagagagtttgaattttatcttttagacactagggagccatcgtgcacttggaaataagagagaaacatgatacaatttgggtttaaaagaggttactttggtggtgatgtgaagataaatcattatggagcaagtggaatagaggcaagatcaattataagactcctatgataatttgggtgagggattttgagggtctgaaccaaggtggtagaggttgggatggagaaaaggatctgaaatgggagaaatttgaaaaattgagcagaatgtattgtactgattgcatgtgggaaatgaggaaaaggaggattggggatgacacgttaagtttaagcttcaatgccatggtagatgggttgtaacgccagtaatagagtcaggaaatgaatacagagggcaggagtacattgggggttggggtggggacttactgaactcgggatacccgtggcatttctgataaatgatagctgattggttattgtatgtgtggattgtcttttatctcccagccatgggggaaaatgcccttggatggtcaagggaccttttctacattttatcctcattttactcttttcaaagacaactgtttagaaactatggaaactataacatctggcataacttacataagttaagaattctatatactaaaagtttagcctttttgttttgaaaagaggaaagccaaagtactgatgagaacaatgtaacttttaaggaaacaaagtaatttaaaatcataaaatattacttttataatttaagtgtgcatcctctaagctattcggttttgtagttatacaggatagtggaaagaacatgtaaaatatagcaccaacatctattatgtactgagtaaatgtcagttttattcccctggagtcctttaacatagatgtttaaaagttcagatgtaatttagtagtaaaatcataaacttgagagtaagaaaaatctaaattgtcttttttctaatacattctaatatctcactttggacaaatgttttaaaatctccaagtgacggtataaaatcaagagggatggattggataatgacactgtgatctcttcttccagctttataatccaatgcttctattatatttattaaaagaaaaaatacacaggaagcagcaagatgagggaataaatcataaaaagtgctcacaaaatgtgtgggcagagaagtggcaaatgatcctcaattgagcaaataaatatatggtaatgtatttagggaaaacttttgatctacatttaaggaatgatagtaaaggacaggagtgcccttgtcaggcagggagggctgggctgtgcatccctctgcttgcgctgcagggaaatgtctcagtgacttttcctgaggaggttcctggcctcagtcgtctccaggaagccctctcaggatcggtggccacctctcacttctggagccctgcagaccccacagtgcagtcctggtggcctggctgtaacacccaactcagcccagaccatatacaccaccagcatctcctcaatgaccattaatatccaggatggacctgactttcaagaccaacagtgagacgccagtgcttgtggatttccacgcacagtggtgtggaccctgcaagatcctggggctgaggttagagaagatggtggtcaagcagcataggaaagtgctgatggccaaggtgtatattgatgaccacacagacctcgccattgagtatgaggtgttggtggtgcccactgtgctggccatgaagaatggggatgtggtggacaagtttgtgggcatcaaagatgaggatcagctggaggccttcctgaagaagctgattggctgacaagcaaggacaagtcctggttcccttgcccccatgggaccccagtagaacttggcccttcctgctgcctccctcctgtctggcccctggggcccaggctccagccatgagtgcttctgagctggcggactgcccaggggccatcagaagatggtgctgctgctgatccggggactgccttcttccctcccacatgcctttcgtcccctccctctagggcctgtggcagttctctcaagatgcatagagagagcccaggccagcccacagcactcctggtcaggcagccacaccttggtcctcatctctggtcccttccgatctgaagcctcgtgcctggctcttctgccacctgcatttctctttcttgctgctgttttgtaaaaagaaaaagaaaaaagaagcccaaactagtgagaataatttataactctctcggtttttgtaggtctgtaataaagaacttagtcatcccacctcctactgtgaagagcagaccctgggtcccacactcaaatcccctgtagttgcccatcctcacccctcagggagccccctcccagctagcctcccgggcagggggcacagaaaatgagtggtgggctggggagccctggagagccttgactctgtaaggctcgaggcacctcctttgccccttaactggcctgttggtcctctgagcagggggcttaactgtgaacaaatcagacaataaagcaagggtctgcacctaaaaagacaaatttatgaatcactgtactgatctttgaagatattttcatgttctactacaagtaaaggagccatcaaaatgttcgccatcagggcagagtcttggaaataaaacatgaaacattctattcttatgtgaaaccattaatgtgctatgtgtagttgtggtgttttgtgtatagcagaaccagagaaagtttagatcagggcagctaacaggagtaagagcatgggaagtctattctgtgtgaataaactgtatatatacatatttcatttaatctagaaaaattaaagttacatgattaaagtgtataaaatcaagtggcatagacagaaaatctgggattgctcacctaaacttgaaacactagaactcatggactattcttccaaacttataaaagctagctgtagaacaagtaaaatgaattatcgtaaaaccttgatatagactgggcttagacaataaatgtatttaactgattagtcatttatgtttaaaggtgaaacatgtgtttacaaattcaggtagtatttttagcaatttcaaaagctagataatgcttttttactctttaaaataattttttatttttatttatttattttgaaacagagttttactgtgttgcccaggctggactcaaactcctgggctcaggcagtcctgcgtagctgggactgcaggtgtgtaccatcgaggcttgtttttttactcttgataggttttataatctctctagcccccagcactttccaaaagaatcatcagtatttataagataagtcttcttcttgctaatactaaggtttactactattatgcaaataaattgtttccccgatatggtggtatagcttaaattgcttttagtggatttctttattttaattggctataattaatttattcatttagttcatttttattccctagccagtgaaatagggagtaaagagttgtcttcatgtagcttatagtctggtaaaagatttagacaagtaaaagcacaattatgagaatgttgtaggaagtggattataggacgtgtttttttgtaatgtgaattagattcagtaatgctatgtatctatgcagaaaattttccgaatcaaattcgggattcttataagttaaattgatacactagcataattggtattagttctgccttcgaaaatccaatgtagatgccatattttttatctggcctgatgtaacaaggtataaagtcccaggctctatggccatagtttaatgttatattcactgttgtcttctattcatatgttaacttttcagggacatctgaaacttgttttgttgtaagataactgtggaatctaaacctttaggtctctgacaagcctgttttctcgatctggactttgtccttagaaaattaaagagactattcttgtgatcatattagtttagagtcctgtttagtaaaatgaatattccatttctatactgtattcttcttaagtagatgaccatatagcatcagcaggccattgttatatgtgagccacaaacttgagagaacatgttggtatagatattacttcttttacaggggctagctctactggtaacttagctctttcaatcttagctcagctccctctgagtaggagccatgacaggttaaactgtggaagaatatgagcctcactttaggctgtagtctttaggtcatgaataagccatagttcaattcatagaatgacaggcaaaacattcacttatttgtctttcattcattcttaatcagtacttattgagcgcctactttaaaccaggcactatgctagtctgtagatgcaaataaaaataagacttggttcctgtccttaaattgggagacagatacagatatttatagtaaggcatacaatgatacataggtgcctgagattaatactagggtgaaaatgtagcataggagtttatagaggagtagtatagaatttctgagatcatcttgggaaatagactgaaactgactgaaatggaaacttcctttgagtccattttggaaatatttacatctataattgtagcacttgtactacattgctttttcaactcttatacccactacagtgtgatctggcaaagcagtgtctatgttgtttagtgttttaatctctggaatgtggcacagttcttggctcatgtcatggtggaagctaaaatcatggatagttaaatggatcaaaaattcaaacctcctgtagaagcgtacatcctcctccctttcctccattggcaggaactttgtcagtaatgtattgactatttggggataatagttgattaatgtgataagagggtacctctttcccccctttttatggtatatagtaacttctttgacatttacatatcaaaattatatcacagttggtatggggagattggtctcaggcaggtaggaagaagacactggactaggaaaaactagagtattatgctcccaaccttttgaaaaatttgttattcaaggcatgtatcattcaactgtgccactgtgtttctcatccttgttgctgtcatttaccagtctcttgcttacttcttattcatcaaatattttggcatctggcccacaatgtttctctatactctaagctctgcattcatcctggatggtttcaaattctatgttaatgactcatctatcatcactgcacctctgttctttgaccatgttatctcctattccccttttgttcattcagatgtctagtcttgccaaagaccttgtaatattcattaactgctcaagaatcaccaatgtgtgtgattctttgatcacaatttcctctcctttttgcttgctttttaaatattcccattatgatcattcttcatcagaacctctcatccatttatccatcagtcctctcactttcattttttcttcttaaccattctagattacttggtcccaaaattcctttgcacatctgcctctttatcaaatctctctaacaaaaatgtaactcatgataaactcagctatgtgctttctcagtgctttcagtcaagagctaagcactgctagagaaagctgcacagaagaacactagaaatttactatcatcaacctcaaatgagctgtcaacatgactttacagttttaccacatttctctgatcaactctgtctctcattcttcacaagttctatttcatttctctctctttatacctctgacttctccattatctctctcattctaagtcatgatattatgtcatattttacaaggaaaataaaagctatcagacaggaacccctttaacttcttcctattaaatgttcacacctactgtattttaacttgaccatcttattctgttataatagaggagttgtctgttatatttatctattgttccatcatgcaggactcctaaatttagcagcttaaagagtgacaacatttattttacttatgaaagtaagtaatttgggcagagctcagctatgcactctatatgacatcagctatcttagctctgctaataaatcactgctatggtttatggggactagaaacacatgaagccttgctcatttacatgtttccctgttgatgctggctgtacaggtaatttgaaccttacctgggactgtcagctgaagcacctacacatgacctctacatgtggcttgggccccatatcatgtggctaagttccaagaaggagggagagagccaggtataagctgtatcaccttttatgacctagcctccaaagtcaagcagtgtcacttcagctgcattctgtttgttaagtgagtcacttaaatgagtctgtatcaagggaagttgaattagattctgcactttgatggaaggagttagaaaaatttggggacatgtagaaatcacattgtacatctttctctgcaagcccaatcactccactattactttggatcccaacccctcctgctttcccaggagtctttgtattcttatcttttatatgtataataatatgtcttctcatttatttaaaaaacgtgtaccccttttcccttcactttcagttttctctttgaccctactttctctttccctttctcatcgctcacctactaaagtgaactggcctgtgatttacagtatgtgtgatcaaatcagttgactttggtgcccaggcaggtaattttaatgtgtcttgggtaaaacctgagacgagaagaaagaagaaagagaaaaatgttctttttctgctcttgctgtattatagttacttacaatcaggttacagagaacttaatcagcttttagaatataacatgtttgaatgttgtggtctgcatattaatatttaagtattaacttgaagttatatgaagtatgtaacaacataaaaaatgtcaaactgggttacatgcacaacctggtttaatatataagaacctaatttctaaatacctttagaatctttgacctaacaatttcttggttctttatgattagatttaactttcttgtttttttggtttttgttgttgttgttgttttgagacagggtcttgctgtgttgcccaggctggagtgcagtggtgtgatcatgagtccctgcaactgctgcctcctgatctcaggtgatccctcccgccttagcctcctgagtagctgggactacaggtgtgtgccgccctgcctggctaattttcgtatttttggtagagatggggttttgccatgttgcccggcctggtcttgaactcctgggttcaagcgatccacccacctcagccttccaaagtgctgggattacaggcgtaagccaccacaaccttcttgttctattactcacacaagtttagcatgagaaataaacacgttaatgacttcttatctttaatctttattgtactcaggggcatcagtgacccaaaaatcttcaaatgttttttcgcagtgatatctgtaacaataacagtgggagccatagtggaggtagagtgggcagaaggaaacttttttggtttttgttatgattggtttttgtcgtaatctactttataatattctgtgtagtagaattgagaaactatgttacagtagtactattttcaagtaaaaatttaattgaagtataccatacatttcaaaagtattcaaatcctaatttataggctaatgaatttgataaagtgaacacccatgtgaattttcacccataccaagaaatagaatattactgaaaccccagaaacttccctcctgcctgtacccaatcattgctagatttaaaatgtggaatactgcatcatgttttcctttgtgactgccttctttcacttatgtatttgtgacacttatccatgtttttgtcatagcagtgatttattaattttcacagatatatatcattgtataagtatagcaaaacatattttttctatggttgatgtaaatttgggttgtttccagtttggagctcttataaataatgctttgaacacacttgtacatgatttttggtaaatatatgtatgttttggtgaatatgtatttgatgaatatgtgttatgtatacactcatacatacatgcatatatacatgcatatgtgtctttgtgtgtgcgtgagagagaatgatgttgaattaattgctggatttctgggtcacagatcatgtggttctggtaaataccaccaaataaattttcagattggttgaacctgtttctaaccagcagtgcttagggttttagtcgctccacatccttcccaaacttgatgtttttcatatttctaattatacctattctggtaaacatttcctggttataatttgtacatcccttatgactgatagtgttgatcactttttcatgttggtattggtcatttggatatcctctttttataaaatgtttttttttttttcaggtatttccccatccctttttttgtggtattctgttgtatttttcaaaaaaattgatttgtagagttatttaacatgggtacaggattttccccccagacgtatgtactacaaatgtcttcttccgtttcatagcttgccttttcactttcttaacgatgtctccttcatactgtttaataattttcaaacgtacaaataatttacaaatcatttcctttatgatttgtgttttgtttggccttcctcggtcttctttaagaagttctcactaccctagggtcatagatattttcctatgttaggtttagaagctttcttttgcctttcatatttagaactacagtctgtctggaatcaagtgtgtgcatctctctctctctctctctctctgtgtatgcgcttctgtgtgtgtgtggtgaggtaggagtcatttgttaatatcagtatttatttgacacatcaccatttaaaaggaaaaagaaattgtcccttccccaaagcactgtaatgacatctttgttatcaaaggctgaatatatctggtttccttcttttctgttccattggttttgtctattttagtgtcagtacaaaactgcatgaattcatataactttataatagaagtcatcataatcagtagtataaatcctaaaacttcatattttacaaaaattttgaatattctttatttttaaatcagcttgtcaattttcacatacataattatatacacgaaccttataggaatcttgagattgcattgaatatatagtagtttgagaagaattttcatctttatgatattgaatttttaagtccatttatttagatctactttaacttcttttagtaatctttgtaatattctgtaacttcttttagtagtgctttgtaatatgctgtttaaattttaaatataattttaaaaattacatttattcttagtttcacatgcttttttgttactataaagggtatcagtgtcaaagttttatcttctaatttttcattgtgagtatataagcatagggttagaaattttatgctgacctatctagtgatcttgctaattttattaactgtaagttatttatagatacatttagattttacatatacacaaatcacttttttgcttaattttgacagtgtaagttttttccttttagtccttatacattttttttgccttattgcactgattaggacttgcaatacagtagtacatagaaatcatgataacagccacacttgtcatattcctggtgtcactggaaagctttcaatattttggaaccaggcagaaaatttttaagatatcctgttatctgtttaaggaaggtttcttctattcctggtttgctaattatttttcctttgagaatgggtatttaattttatcaaatgttatttctgcgtctgtgagttttgaatcttaaattaatattgcatacctggaataaacccattctggttgcaatatattgtccatttcatatccttttttaatgtaatagtgaatttggtttgctaaaatgtctcagtgtgttttctttttatcattattccattgttttttctttgactaatggctacattggttagttttcaaatatttgggggtttttagcttagtttcactgtgttcagagaacatgtttggaatgatttcagttctttgaagtttgttgatacttgccttatgggtcacctttatagccatatacagtagtcatttgtaaatgttccaatgacttttgaagagactgtctattctgctttcgttgcctacatgtactctctctcacacacacatacacatacacacactaagacaattaattcacactgaattcaaggtattctgtatcatgttatatttctttagagaggacttattttacttctggtgtgattcaatattatttttactaattgcagtcatgtggtatgtaacaacatttcagtcaaaaacatactgaatatacaatcatggttccaaaaattatactacttcatttttaatgtactttttatatgtttagatacacaaataccattgtattacaactgcctacagaattcagttagtaacatgcagtataggattgtagcctaggagcaataggctatccatatagcttagatatgtagtaagctatacgatctaggtttatgtaagtgcactctatgatgttcgtacagtgacgagattgcctaatgacacatttctcagaatgtatccctggcattaagtgacacatgactgtatttaacactccatcatgcattattattattgttcagggccctcaatatttatatttatcccatatttgctgttttttttttttttgcgcttattccttcatgcattctctggtctaagttacttgtgccataaataagtcttgtgtaaaggtgtcctagtgatgaattatgtcagtttttatttatctggatttgtgtattttttaccttcactttttcaggatatattttataagtatggaattttaggttgagaattactttctttgaacactttgaagatgtttcatcatgttttgttttccattgttttgttgagaaatcagctgttagtctcagtgttgctttatgaaggtagtatatctttttttttctttggttgctttgagattttctctttgcctttggttttcagcagtttcacaatatgcctaggtgattttattccccctactttctgtttgcaactttttagaatcatggctcaaaatgtttcatttatttaagacagttttcaataagcatatcttaatatgttgcctctatcccgtcttttctttcctattcttctgagataccaattacatgtatatgtaaaatttctgatatataatttcaattattatatttttaatctctagattttccagttgatttttgagtttctacttgtaaatttttctactcatttatatttttgtacaaattaatcatagctatattaaagttcatgtctgaatttacaatttttattaccagtgtgtttttctatggtatgtttgttctcttatttttggttatttggtcttatcttttggcatgcctaggaatctttaattgaatgtattttgtatcatgttatatttcttaagagaggacttattttggctgatggttagagttgggtcagattgtgttgatccatcaacaattaagatgacttgttggctgttctcagtctttgtgaggcttggtctatttcctattcttactcctatcgatggagcctttcagtggttttgactgaaggcctggtggtgtttatcagggccctacctcatgctagccctgaacttcaatttttctttcctcactgtgagattactgaaatatttgcttagttttctaatctcctaaaaaggtgcttctcactatctgttctttagtgtcatgccttaggtatcttaaacatctgaatgcttcaagaagaaaaagtagtacagaatgttgggatttttatttctggtttcttggccctaaagtctctgaattccatttttttcccttgtcagccaagtgtaatgttgaatatttgagccttagctttttgcatgtcctttctaccaattgaggaaatgccctgagggcaaaagctgtaaagaatcttgatctctaatcatttcccatcttttcaggaccttggtgttcctcaaaacctgctgactcctttgctaatactttcaaacaactcttaccccatttctaccaatatttatgttattttaacaagagttttttttatatatcactttattgaagcagaaatcccttgatagtattttttctttttgtaaatctgtgcaatgaatcatagtataaagtgtgcacatttttaagcttatagattgaagagggtttacaaatgaattcctcatataatcgtgactagatcaatatatgcaaattaacagcattctagaaggttcccttgtccctccagagtcaataagcatgcttccctcagatgtaaccactattcttatttctgtcaccatatattagtttcgcctgtttttgagctttacttaagtagaataacaattatactgttttatatctgggattttaatttcaacattgtttgcaaaatttagtcctgttgctgaaggtagggttctttactttttgttaatgtatagtgttccatggtgtgaatacacaatttattttttctttctacatttgatggtaattgggttgttttccagtttgggactattatgactagaacttctgtgaacattgttgaccatttttgtgcattttcatacacacctatactcatttctgttaggtatatacctataaatggaatactgtcataaagtatatgtatctgtagatacattagtagatagtatctacattagtagatactatcaaactgttttcgaaagaggttataccaatttgcactcacagtagcagtgtaggagagtttccattgccccacatcttcaccatccttggtattgacaggtattgttttgttttagccattttggtgtgtgtattaataagggttctccagagaaacagaaccaataggaggggtgtgtgtggggagaaagattatttctataataaatctcctcttacatacatatatacttattatggaaattgactcatgattatggaggctgataagtcatataatcaagttggggaaccaggaaacctggtgctgtaacttagtctaagtccaaagacctgaggaaaggggagagaaaatggtttaagtcctgggctgagtctgaagaccaaagaaccaggagcactgacgtccaatagcaggagaaggtagatattccagtcttaaaagaaaagaaaaaacaaaaacaaaaacaaaacgtgcgaatttgccctttctccacctttttgttatattcaggccctcaatacattggataatgctcatccacattattaaggtcggtcttctttattcagcctgctgattcaaatgctaatctcttacagaaacattctcacaaacacgcccagaaataatgtttaccagctatctgggcatcccttagtctagtcaagttgacacataaaattaaccaccatagtgggtgtatatcaggatataattatgcttttaatttttgtttccctgatgattaatcatgttgaacacgtttttatatgcttattgggttattcagatatccttttttagatgtaatgcctattaccttaaattaaatcttttgcctatttttctactgggaaaagaaaataggagttattattttgcagaaatgttatacgtacgcatagtttatgaatataaataaaaatattttctccaagtctatgggttgcattttattctcttagttatatattttgatgaacacagcttttaatctcaatatactgagagtactaactttttacatagcccattttgtttcccttttaacaaatctttgcctactccaagttcatgaagatagtttcttttgttcttctaaaagacctattatctttgtcacatttaggtctgcttgcatgtctcagagcagtagaaagcaatattatcagttgtgaggaagaattatgggaaaagtgttggaagtttggtaaagaggagaaggtataaaagtcatctagaagagtgggagattggatggactaggggagtacaatatgattgccagataacagtaaatatactcttgaggtttctggttatgaacttcaaatcataaaaagttaagagtagtttgtttttctccagtcttacccagctgcacaagtgcaggcacagtgtaggtatagagatttcaccagggttctggttttgccaagcaagtatagacaaaacgagagagaggcaagtggctgaaaatgtatgctggaagtgattataatgctcggctttggaatttgtgcattttaaggaggaaaaaagataatatttggggtatcaaggatcctgaaaaggattagagatcctggtaaggtttaaagattgttgaagttgagatcttaaaagagagtgagctaaaaagatagaacatggttagagagaaagggtagaatgaaatgggctaagggtatgatctttggagtcaatggctaagacagggtagggtgggaatgtacatattaaatgaatttagatattgtattagaaaggttagaggatatacatattcgatgaatgtgtatatcttcaattaactacaaataatccaattttatttgtagtgttaagtatagtaagaaatataagtacaatacctgtttaaaaattttacaaaatattttagcaaagtactttttaaaactttaatttttaacttaatgtaattttcaggtaaaaggataatatattcagtgcattttaatggcatgagtttttaattaatgttgtatagtcgaagacatagtagtatgttagtttatatattttctagaataacatatttcagtttaaatatgtatttatttttgaatttaaaatattcatgtttgaatggttaaatgagaatgtacccttatttctgtggaaatatagcttttattaacagcaaatataaatatatctaattgagaaagtaattgaattgttccccccccttttttaattaaatgaatatcctttgagaatttaggagctagctacttaggggaccagaagctacttacctgggcacttaatattattaacctggtatatggatcacattgacatccagaaagtaaaaaatattctcaaagaagcaataatagacataacagaggatttgtatcataattcacgcagttactttcagatttttctcttttgcaaaatagaaatagtttctagttgtgaggtttagaaatcctatgtaatgtattactcttggtaccgagaagatgctcaataaatagtagctattgtttttaagggaaatccttaagcatggtctatatagattaggctcattttaacaagttatttgaattgtcagtctgtggacaactagaaacaacaaattcatccactgggagtaattttatattagattgtagggaactttatatttgtccattttcacactgctgtaaagatacgagactgggtaattaataaaggaaagaggttttattgactcacagttccacatggccagagaggcctcaggaaacttacattcatggtagaagggaaagcagacatcttcttcacaaggtgacaggagagagtgtgagcacatgaaggaagaactgtcaaacacttataaaactgtcagatctcgtgagaactcagtcactgttatgagaacagcatggggaaaacctctcccatgatccaatcacttcccactgggtccctccctcaacacgtggggattatggcaatacaattcaagacaagatttgagtggggacacagccagaccatatcaaatatatttatattcatatcctcaggatcatcaagaataaaaagatataaaagtgaatggggacattttagaaagttattcaccaaaactttaataattataaaaagtggcttttatctcagaataaccctatgtagtaagaatactgaggcttagagaagataagatcacacatttaatggcagaattttgaatgatgcaaactccatcagtctgattctaggccctctgctcataagcaccatattataccatttccctaacacagtgaggaaaattttcttttaaaaattatgtacttaaaactcatcaaatctgaaggaccttagaagatctatctacctacctatcaagtttgtagagtattacatagctttttctatgtgtcaggcactgttatcaatcctataacaactcatttaatctttacaactctttgaggtgggaaccatgattgttcttattttatacaagaggtaactgaggcatagattaagtaacttgtccaaagccacacagttaaaaagtaggcaagctaggacttgaacccaaacagtgactctagagtgttgttaaccgtgccatattgactgcctttctaaaaatttgtgaagtttttacttcatttagttttctccttattataatcttttcaatgataagaaactcattacgctgtaaggctatgtgccagtcagagttacaccagagaaacagaaccagtaggatatatcggaagagatatattgcaagaaattgacttattgattgtggtggctggctaggtaagtctaaaatctatagggcaatctgcaatgaagggcaagctggacctctcaatcacaggctgaagctgtactttacaggctgagtttcttcttctgggaagcttcagttctgctcttaagggctttcaactgattgagtcagatccacccaaattatctatggtaatctcctttacttgaagtaaactgactgtggactttagtcacatctacaaaataccttcacagcaacacctagatcagtgttgaataactaacgactataccctagccaagttgacacataaaaatgtcctgtaggcatattttttccttaagccctgacaggtttgggggttggtggttcattttcccaagccagaaatggaacttcctactttctttttaacttacatttattactcattcttatcacctcctcatctcccattaccacagccaaaaaagatttcaggtgtttttcaatagaaggcatatataacctttaaagcaaaattataaatacaagagccttgaaatcaaaggcaagaagatggttgaaccaataaaccgatgttgaagctagttactgtatttgagcataaaatttagcactacatggtgaggatacagtataaagccactttcctagtgccaaattgtaacaggaatttaatctatctaaatacagggagcagtgatttacataataaatgagataattattatttaataaagatttagagaattctctagattcctgtgttcaagaaggagggcctcaaagctgcctgcagttatatttttatgataattatttattactatctcatgacttaaaaattttcttaacaagtaaaataactaccttttaaaaaatactgtaagaccctttgctatgacctcagataatttaaagtgatgtctcacagacctttatttagactgaaaggcttataaaaattttgtgtgtgcctgtaatcccagcactttgggaggccgaggtgggcagatcacgaggtcaggagttcaagaccagcctggccaatgtggtgaaaccccatctctactaaaaaaaaaaaaaaatacaaaactacaaaaattagctgggcgtggtgttgggcacctgtagtcccagctgcttgggaggctaaggtaggagaatcgcttgaatctgggaggcggaggttgtagtcaaccgagattgcgccactgcactccagcctaggcgacagagcgagactccatctcaaaaaaaataaaaaatgaaaacaaaaatgcaaaaagagaatcttgtgtgtggctcacgttactctaaattagacagttggggtttttagaaatcttaaggacttgtcccatagcagtcttatgtgaggcccaaggtagagaaagccctctccaaagggaatgtggatgtggctttttgtctcttggaatatattagaatttgataatatgagaaacccacagagttttaaaagaaattgtattaatgttgattgaaagggtcagagataattaataaggaaaaaagtgtacgggccctcacctactgtggaaaggaagcaggctgaaaagctactcacctcttcacataggccatttcatgtgaaagaatgattgagagagggcagccaagaagccagagagtacagctaagagacaaggagaactactctcaggactaatcaaggaatgagtgacatgtgcccaactggactttagaattgctattgatgagggagtgtttatacctcttgttttccctctttttgaatgggagtatccattgcaatttctattcctatctcaccatcgtgtattgggcagataacttgtctctttagttcacaagtctttagattaagagaaactaagtatgaggagttgcactcaggaaactggatctgagaggcctcatctatacctgcatttgatttagattacatcctggaccttaggataaggcttcttggggtcttggaaggagtaaagtatattttgaaaatggaggagtattctgtgacaaagtgaagatggctacaaattcttaaccacccttttcatctagaagcatagcatatttcttcattccactgaatctgggctgggtttctcattgctttaaccagtataatatggtggatgtgatgctagatccgttacagggttgaggctctgtcctcttttaagcgaactgctatgcaagaagtctgactattctgagaccaacatgctgttcaaagcccaactagccacttagagagaaagagacagagagatggggtgtgggggtggggggtagagaaagaaagagagagattggtagcactagataaggtgaattatttcatgggccttttagtcagcccagccttcagctgaagacagatgagagagtgactcagcaaacagtgtgaagtgagccagcagacctatgacctcatttgggctgttccagcttctcgcagctgttgagccacccagcttagaccccagacattgtggtatagagatgaacagttcctactgtgtgttgcccaaattcttgacccagaaaattgtgagcaaaatatggtgattgtttgaaaactaagtttgttacataacacagataactgaaacacaagtagaaaaattctatcacctgcccaacctcacagagccagtaagaactagtgttctccccttcccttttatttttagttgacacataataattgtacatatttataggatacagagtaatattttgatacatatgtaatgtgtaatgatcaaatcagggtaattagtatttccttaccataaacatttatcatttctttgtgttaggaacatttaaatcctctcttgtacttgaaaatgtacagtaaattattgtaaattatagtcaccatacagtgctatggagcactagaccttacttttcctatctagctgtgattttttatcagttaacctctctctaatctgtagtaacccacaattatctaattctcttcccaacttttaataaccacaattctcctatctacttgtatgagctccacttttaaaagctccctcatatgggtgagaacatatggtatttttctttctgtacctgactgatttcacttaacataacatcctctaggctcatccatgttgccacaaataacaggatttcattctttgttatgtctaaatagtaggtcattgtttatatacatatatatacactttctttttctgttaatctgttgatagatgtttaggttgattccatatcttgattattgtgaatagtgctgcaataaacatggggtgcagatgtctcttcaatatactgatttccttccgtttgcattaatagccagcattgggattgctggattatatcttctatttttagttttttgaggaagcttccatactgttccataatggctgtactaatttacattctcactaaaagtatatgagagttccctttctctgcatccaaaaagactattgtctttttaacaatagtcattcaaaccgaggtgagatggctttcatttgcatctccctcatgattagtgatgttgagcattttttcatatacctgtggccatttgtatgtagaaccaatgcttttaatcacatgtcaaactgcctatgtcccagtcctttccagagagccctctggaaccctttttctattgtaaacaaatttatttaaacctacaggttttccatggaatagaagtttattcctcagtaccttgcatctactagttgggcagttatggtgagcatatctttttgacttaattctagagtaattatataattggagataaagctgggaaccattctttacttaaaaagtctcaagtgggactctccttggagtgttctctaaaaacaaaacaaaaaaaatcgttttcttaaaggcatttagttagcagagcacagctgactgaaaatttcttaaatacaattcaggatagtttgtataaataaccaaaaggtaaataaccaatgtagtcctcatgagacattaaaattttttttcaactgaatctctcactgcactgttaattggaagtcttctttcttgaccattctctagaacagaatacaactgcggtcactcctctcttctggatgtttttttctggaccatccaattcatttccacccccttgttatggagagaaactttcctctttcatggaaaagtcattctgacatcgaggcaccacgacttttgacctagagtaagcatatcaaactatttttctcaactcaataatttacagaaaaatattaagaaggtgaaaattttccattcatcattacctacatgtaagaaaaaaagaaaagaagaaaaatctaccagaatcctagcatttacagataaccactgttagcatttatttatttatttatttatttatttatttatttatttatttatttactgagacagggtctccttctgtcacccaggctggagtgcagtggtacgatcacagctcactgcaacctccacctcccggattcaagtgattctcctgcctcagcctcttgagtagctgggattacaggtgcacgccaccacagcccagctaatttttgttctttttaggagagatgggattttgacgtattggtcaggctgatctcgaactcctgacctcaggagatccacctgcctgggcctcccaaagtgctgggattataggtgtaagccactacacccagcttgttagcattttttgaatactgttggctttctatatccacagattcaaacaatcaaggattcaaccagccatgaatcaaaaatgttgaatcaacaaaacaataataaaaaataaagtagaaataataataactatttacattacagtataataggtattataagtaatctagagattatttaaagtatacaggaagatgtgcataggctatatacaaatactatgccatttgacataagggacttgagcattcatgtattttgatatccagaggcgccctggaaccaatctcccatggataccaaggggtgattgtatatcctgtttaaaagtatatgggtgagtttcctcctagtcaacatagtgttggaagtcctggccagaacaatcaggcaagagaaagataaaaggcattcaaataggaagaggggaagtcacattatccctgtttgcagatgacatgattctatatctagaaaactccatagtctgcccagaagctccctgatctgatacacaacttcaacgaagtttcaggatacaaataaatatacaaaagtcagtagcattgctatacactaacagcacccaagctgagagccgaatcaggaatataatctcattcccaattcccacaaaaaaggttaaaatagctaggaatacagctaaccaaggtcaaagagctctacaatgaaaattacagaacactgctgaaagaaatcagagatgacacagacaagtggaagagcactccatgctcttagataggaagaatcaatatggttaaaatggccatactgcctaaagcaatttacagattcaatgctatttctatcaaactaccaattacattcttcacagaactagaaaatactattctaccattcatatgaaaccaaaaaagagcccaaatagccaaggcaatcctaagcaaaaagaacaaagctggaagaatcacattgcctgacttcaaactgtactataaggctacagtaaccaaaacagcatagtactggtataaaaacagacacatggaccaatggaacagaatagagagcccagaaatgaagccacacacccaggaggagggagaggttcagaagagaaagataaaaaggaaaacaaatgaacaaacaaaaaaaccaaacctgttgagtagtatgcttagtacctgggtgacaaaataatctgtacaccacacccccaagtcacaagtttacctatataacaaacctacagatatgcccccgaacctaaaataaaagttaaaatatattttaaaacatatataaaatggatatatgtgtcagttttaaccaactgatgtttgacaaggctgattaaacaagcaatggagaaaggactccctgttcaataaatggttctgggataattggctagctgtatgcagaagactgaaactggaccccttccttataccatatgcaaaaatcaacccaaaatgaattaaagacctaaatggagaacctaaaactgtaaagcccatggaagataacctaggaaataccattttggacataagaacgggcaaaaatttcataacgaaaatggcacaagcaatttcaacaatagcaaaagttgacagatgggacctgtttaaagagcttttgcatagcaaaagaaactatcaacagaataaacaaacaacctacaaaaatattttcaaactatgcatctgactaatgtatagttagtctgggtctaatatccagaatctacagggaacttaaacaaatgtacaaacaaaaagcaaacagccctattaaaatgtgcacaatggacatgagcagacacttttcaaaagaagacatacatgcggccaacaaacatgaaaaaaatgctcaatatgactaatcattagagaaatgcaaatcaaaaccacaagataccatctcacaccagtcagaatggctattattaaagagtaaaaaaataacatgctgacaagcttgcagagaaaagggagcacttacacagctggtggagtgtaaattagttcaaccattgtggaaagcagtgtggaaattcctcaaagatctaaaaacagacctaccattggacccagcaatcccaccaggtatatatcctgaggaatagaaatcattctaccataaagacacattcacttgtttattcattgcagcactattcacaatagcacagacatggagtcaacctaaatgtccatcaatggtagactggataaagaaaatgtacatatacaccatggaatactatgcagtcatgaaaaagagtgagatcctgtcctttgcgggaacatgggtggaactggaggccattaactctagtaaactaacaaaggagcagaaaaccaactatcacatgttctcacttataagtgggagctaaataatgaaaacacatggacagaaagatgggaacaatagacactaggatatacttgagggtggaaggcgggaggagggacaggttcagaagaaaaagaagaaaagaaaaagaaaaactattgggtatacctgggtgatgaaaaaatctgtatgccaaacccctgagtcacaagtttccctatataaccaacttgcacatgtacccctgaacctaaaataaaaattaaaatactaaaaaaaagtgagttttaacaaattgagattataataataatatagtgcttattgtataccagacaccattataagtgctttaatctgtttatttaatccacccgaagaccctccaataaggagtgtacttttattaacctcatttgcagatgagaaactgatgcccatagttgttaagtaatgtgcccaagatcacataactgggattcacattcagatagtcttgatttaagaacctgccctagtaaccattattctaacctgctatccatattatatattctgacaaaatttgcttttttcatttttgaatttttctttgcatttggataatcttctgtaaggaatttgtcgtacagtcagtatgttaaatgtattaaaaaataagtgtatggaactaattttttatttccccaattcaagggtaaccattctctctactttgacaggattgattacatttgcctcttttataaatgtaatcacacaacatgtactcaataagtactcttttgtccctggtttctttttgcctgacaatttgtttgtgggattcattcctcttgttaggtatagttggaaattgttcattttctttgctgtataatgttccattgtgtgaatatgtcacagtttaaatgttctactattgatgggatgtgatgtttcctttttgggcctactgtaaataatgctactataaacattccagtacacacattttggcgaacatatgtatgcatttctattgagtatatatatctaggagtaggcattcagctttagtagatactgtcaaatatttttctaaaatggttgtatgaatttgcactactagcattgcatgagggttctcattatttcacattctcatcaacttttggtttttcctttcacttttgctttagccattctgatgaatgttagagtagcatttttatgactatatagtgttctattatatgcatatgtactgtcttttatagacgggagtccctattgttgtgcatttagattgtttccaatctttctttgaaaaaatacaaacagtatttacactaataggtttgtagacgtactttaagtcttgtgatagatgttcccatacacgattgaaaaataacaagtgtgtttccctgaaacattatgaaaatgagttacaatttttgcaacttcatccagttactaagcaaaagatagcctctcatatttttactttaaattttttttatttccagagaaagttgagcattatgtttattgctaatttttatattggtaatttgtatatatttaataaatcacctagtctcattttatgctcatatttctattgaagtatatgtgaatatcttagacccttttattaacccttttctgattatatatgttataaactttccttatttgtctttcaattttataaaaaattaactttttatatagtcaagtatatgttttatggcttttgcctttggtatcatgctttaaaaggcctactcatactttcagctttttcattctgctctgttcttccccaaagtgcatgtgtatgtgtatgtgtgcatatatacatgtatgtctattcagattttcccataaaaacatgatacagatagccctccatatccttggattcaaacaaccaagagaattcaaccagccatgtatcaaaaatattaaaacaacaaaacagtaaaagataacaatacaacaatatgaaataatacaaataaaaaacaatacagtataacaactatttacatagcatttacagtgtattaggtattataaataatctagagatgatttaaagtatatgggaagatgtgcataggctatatgtgtgacagtgtatgtatgtttacatatatatatatgtaagtatatatatatacttgagtttttcccataatgttcaatttcctctggaaagaaaatgtaaacttgcttcctctatgctgtatcatcatcttattctcaaattcccttcaaaaccaaactttttaattagtagggtaacacactgcttccattttcttactttgtgtttacgcctcaaatcctctgaggctgatatctattccttcctgccgtggcaaaagtcatcaataatttgttgtgagttttttcccttactctatagtagagtttccctaatctatagtgttttccccaagtgacttattcactaattacttcatgttctgtcagttccaattactttctatctttgtgacaacatatatctcttctgtgctctgagtgtaatttttgctggatatgaaccctgcaaagtcaaattggggaaattatcgtttcctgaatctgcacttcctattttggtgaaaatgatgcacctctttagtcatataagccagaattttgggtgtcatcttagattctttaattttccttgtcttctacctctccttgttgactgagtcttaggaatttgtcccttcatttctaatttcactgattctagcttagttcaggtctttatcaccctttttgaggatatctacaacagtttcttagccattctccctgccttcaatttccctagtcgatcttccaaatctaatctaactccctgcttaaaattatctttatggtgctccattgcatataagataaaatctattcttagcctgacatataagatgatttggcccctttatcttgtttcattttttccctatcacttcttaaagtactttttaaggcacaataagactttgttattactatgattgcaccaacattgctactgacttcaacacccaaaatttttgtatacagaagcgtgccccaaacacaaaatgagtctttctgtactgctagctaatgtttactaagatcttacaaattacttcttttattagtttggaaaaaatatggggttagttcaatgctaaatcaaaattgttcctctcttttctgcttaagataatctatagtaataccttatattagtatggattattaaagatttactgtacataatccttccattatttgattttatagaaacatctcaaaggaattaacccaagggtaaaatactacccatacataatttccaacattttgatcagattctactgggtaagtatatgtatattttaagctataattcctataatctgtgcaacaaacccccgtgacacaagtttacctatattacaaacctgcacatgtacccctgaacttaaaagttaaaaaaaaaagtatatgtccatgccatagaagacaaagaaacaccgtagaaattttctaggttaaaggcagagtaaaagacataacaactaaatgcaagacctgatatatatatatgactgcaaaagcatctctactgaccccagagaatggtgtggcaactattgtttacaatttttatttagtatttatttctaatataagattgggaaaatagcatcaaaatacagctgcttagtagtcaagaagactaattatgtccctggaaataattacaactgtgtacttcaccttcaggccagagtttacttattatattaataagaaaccaatactgcaattgagtcttgtgagcctaactcaaagacacaagattaaatgattagttttacagaatgagaatatagtgatgcagtaatgtatatccattggtgacattgccattagcattggaggcaagtgtccatttcataatagatggtgtcctaagttggactgcttctttttttttttttttttttttgtttgatacggaatctcactctgtctcccaggccggagtgcagtggtgcaatctcagctcactgcaacctccacttcctgggttcaagcaattctgctgcctcagcctcccaagtagctaggattacaggcatgcaccacaacacctggctgatttttgtatttcttttcagtagagatgggatttcaccatgttggccaggctggtctcgaactcctgaccacaagtgatccacctgcctcggcctcccaaagtgctaggattacaggcgtgagccaacatacctggccgtactttttaactatgtcttgcctcatttggttcctggctaaatctggcttttcagtcttctcatccattccatatgtactcaatctaataaattcattttctgcttaaattgactagcatcaatttttaatttacatttttgcaactgacaacccagactagtacaggtcctaaaggggactctaattcacatgtcctcccaagaaaggcaggtagcaaggtatcttatttgtatgtgtctgatagggctcccaagaaaccagtggaaggtactcttaggattgatagttaaagtcttaggcacagtaatcaaggaacctaagaccgagtgacagaggaatgtttttacatgggagaactctgagatacagtgttagaaattccctaaggaggttagtaggaaatattttccaagaataaaactgacagaggattaatatccagaataaagagcattttataagtcaacataaagagactaaaaatgaaatagaaaaacatagcaaaggatataaatggataaattactaaatatgaaatttagatgatcaattaacatatgaaaatattttatttcactagtgatcagtgaaatatgatttaaaatgaggtaccttttttaattcaccagattagcaaagatgaacaagtcacgtagtatcacatatgacaagcatgtcaaatgtaaattgggatagccattcctgagacaatttggttgtatcagttaaaatgaaaatgggcataaactgtgacccaggaattccactgttaagtatcttctgagtagaaacacttatacatgttcaaaaggaagtatgtatcaaaaaaagacatactggtgaggatgcaaaggcatgggagccctcagacattgctggtggaaatataaaatggtacaggtgctttggaaacagtttttcagtttcttaaaatgttaagcatcagattgccatacccagcaatgtgcacttctagaaaaatagccaagagagctaaaaacactcctccacacaataatttgtacttgaatattcatagcatcattattcttagttgctatacagtggcaacaattggtgagtaaagagaatattgtttatccatacaattcaatactattcaacaataaaaaagaacaaggaatcaatacatgctgcaacatgataaaccgcaaaaacatgctaatgaaagaggtgagacacaaaagaccacacattgtgtgatttcatttatatgaaaaggaaaggcaaatctgtagatacagaaagtagactgatgcttgctcagggataggggtgagaatggaaaatgaccacaaatgggactgaggctccttttttgggatgatgagaaaaatgatacagtattaaattatggcaaccatttcacaacttattaaaaatcaccgaattttacatttaaaactggcgaaatttgtggtacataagttatctcaagaaaactgttaaaatgattaatagctagggactttataaacattactgtaacctgggatggtagaccaacacttgtaggaaggatagctggaagaaatcaggcatgtcatgttaggagaaacaaaatggaaacagaaagaaacagacatgaacatgatgtccattattgaattatttgtaatactggaaactagaaataacctaaaagcccatcagtaaagaaacaggtaaaatatagtacatttgaaaaaagtaattttcaaaatatgtagagcatgataccatccaggcaaattagaaaagtaaagctgtatatgttttccacataaacatgtatgtaaaagtataaaaaagacatttgaaggttataagcaatttcagaacagtggttgtttctaagggcagagaaggagaatcaggatgtggatagtaatcaggagggcctttagtgttatttgtagtgttcttttttttttatttttacaaatgtatggtgtaacatgaattttattacatgtatgtaatttatagtgatgaagttagggtatttagagtgtcagtcacccaagtacaatatacttttgcttacttaccctattctgctatcaaacattgaatatattccattttactgtatggttgtaccctttaattcacttctcttcagcctcaccgtccccctccctgctccgtcctagtcagccttcccagtctctgctatctatctttccattctcttccttcatgggatcaaatattttagctcccacatataaatgagaacatgtgatatttgtctttttgtgtctggcttatttcagtttaaataatgacctccagttctagccatattgctgcaaatgacaagatttcatttttttatggccaagtaatattgcattctgcatatatgccacatattctttatccatttataaactggtgaacatttagtttgattccatatctttgctattgcgaatagtgctgcagtaaacacacaagtgcagatattctttgatacactgtcttcttttcctttgggtagatactcagtagtgggattgctggatcatatgatagttctgattttaggttttcgagaaatctccataccattttccatagtggcagtactaatttacattcttacaaaaatgtataagaattcccttttctccacatccttgccaatatctgctactttttttttttttaatgatagccattctgactggagtaaggtgttacctagttaaggttttgatttgaatttctctgatgattagtgatgttgagcatttttcataaacctgttggctgtcttcttttgcaaaatgtctactcatgtcatttacctgctttttaatgggattatgtttttcctattaagttttttgagtttcttgtatatgctggatattagtcccctgttgcatgagtagcatgcaggtattttctcctattgaaaaggttgtctcttcaccctgttgattattttttttttctgtgcagaagctttttagtttaattaagtttcatttgtctattggtgtttttgttgcctgtatttttgaggtcttagttgtaaattctttgcctaggccaggtgcggtggctcacgcctataatctcagcactttgggaggccaaggtgggcagatcacctgaggttgggagttcaagaccagcctgaccaacatggagaaaccctttctctactaaaaatataaaattagctgggcgtggtggtgcatgcctgtaatcctagctacttgagaggctgaggcaggacaatctcttgaacccaggaggtggaggttgtggtgagccgagatcgtgccattgcactccagcctgggcaacaagagagaaaaaactcttgtctcaaaaaaaaaaaaaaaaaaaaaaaaaaaaaaaaattctttgcctagagcaatgtccaggagagtttttcctaggttttcttctagtatttttataatttgtggtcttacatagtctgtaatccattttgagttgatgtttctatgtggggagaaatagggttctagtttcattctgcatgtggctattcagttttcccaggaccatttattgaagagagtgtcttttccccagtggaagctcttgtcaggtttgtcaaagatcaattggctgtaaatatgtggctttatttctaggttctctatttagttccattatgtgtctttttttataccaatactgtgctgtttgggttattatagccttctaatatactttgaaatcaggtaatgtgatgcctccagcttcgttctttttgctcagagttgctttggctatttgggctccttttaggttgcacatgaattttagaattattttttctaattctgtgaagaatgatgttagtattttgatatgattatgttgagtctgtagattgctttgggaagtatggtcatttttaacagtactaattctaattcatgagcatggacttttttcatcttcaatttcttttatttgtgctttatagttttaaatgcagagctctttcaccttcttggataaatttattcctaggtattctttttgtagctattttaaatatgattggctttatttctttctcagctagatcattattggtgtatagaaatgctactgatttctgtatgttgattttgtctcctgcaactctactgaattcatccatcaaatcagggagtttttggtgaagtctttggtttttctaggtataagatcatatcatcagcaaagagggacaatttgacttcctcttctccaatttcgatgccttttatttctttctcttgcctgtttcctctggctaggacttcctgcactgtgtcgaataatagtagttaaagtgggcatcctggtcttgttctatttcttagaggaaaggttttcaacttttccccatttagtatgttgttagctgtgggtttggcatgtatggcctttattattttgagatatgttccttttatgcctagtttgttgagttttgttatgaagggatgttgagttttttttttcagatgtcttttctgcatccattgagataataatgattttttctgttgatgtggtgcatcccatttattgatttgcatatgttgaaccattcttgcattcccggaatgaatcccacttgattgtagcttattatctttttgatgtgctattggatttggtttagtagtattttgttgaggatttttgtgtctgttcagcagggatgttgacctgtagttttctttttttgttctttgtcaggttttggtatcagattggtgctgaccttgtagaatgagttagggagaattccttcctctttgatcttttggaatagcttcaggaagattggtattagttatccttagtacatttggtagaattcggctgtaaatccatccagcctttgtcttttctttattgagatactttttattactgattcaatctctctgcttgttattgaactattcagattttctatttcttcctgatttcatgttagtaagttgtatgtttccaggaatttatccattttctctagcttttccagtttgtcagcatttagttgttcataatagtctctgatgatcttttgtatttttgtgatatcagttgtaatgtctgctttttcatttctgattttatttgcatcttcgcttttcttggttagtatagctagcagtttatcaattttgtttgtcttttcaaagaactaaacttttgttgatcgtttatgttgtttttaaagcctctatttcatttaattctgctctgactttgtttcttttcttcagctaatttggagtttaatttgttcttgcttttctattttcttgaagtatattgttatatgttaatttgtaatctttctacttttttgataatgagcatttattgctgcaaaacttcccatgatgactgtgctcccaaaatggcaccttgctgcagctgttcatgcttaggtggagtgagtgagccagcatgaattccttgtctgatgcaatgccttcacacaatctccaagtcaccaaccatgctagtttcagcattcctgttggtaaaggagttctactgaggtttagttcacagcagtccatggtagagatgtgaactgctaaagttctgtcacttatgctgtccctgtaatatggagcccttctaggctcccacccaatcttgaccaagcgggccacttgcttccttttccttctgtgcctcaaatgttccctgtgtgttctccattgtactctagtgttctttcctagatgttctatttatagtatgattatctattcataattgtggttcttctttctggagagagcaggtgtctcacatctctagtcagccatcttgtaccaaaatcccattatttgtaattttctaaatagataatagataatatattcaaaatgtatacattttaacattacagacagaaatatggacttgaagcaaatattccaaaatatcaataatagtatttctgggtgctgggaataagagtgacaaaagaaaaaatctaagaaacaaatataaaacagccatcattctctttggttacctaatataaagcttaaagtgaagaagaaagcctggaaaatggcattgcagacctgagaacagcagaaagagtgaaataacagctccccaccaaggacactgacctttgaaacacagcatcagtgactacagtaggaaaacctaggactctgcttggaaacagaggggacttaaggatcacttataataatatttacttcttcagttgaggaaggtgggaagtcatttctgttgttacctagcagctcttagagatgagtttatataccaaaagtagttgacatatgtatcaaaagtaggataatctaagaaatactcttgtttttggaatatatatttaatgagtttcagttgcaagaagcagagaccctattcaaactgattgaaacagaaaggaaataattttttaaggtaacttcaaagttcaagtggtgaaacagcatttaggcattgcagtatccaggacctcaaatgatgtcattagatttatatatttttctccctctttctgtgtttgtctctctgcctctgccatgtctttctctgtcttacagtatgaatatgatttttttcattgttcagaagctggagctggaagtgactgaaatacttctgagaaaccttatttccatgaccatgcttgtcatcagaaatacatattcaaatatcatagaagagcatctagtggggagaactttatttttatccaaaactttaagaacaaggagtccaggaaatatattttatagctttccaacctgtccaactattaaagaaggagaatggaagggacattgaatgaaccaatttacaatatccagcatggtccactcttttggctgttcatcacctatttatacccttctactgatgctttcaaagaatggcaattacactattctacagctaacttaatgctactgtccttcatataaatgaaaacactcaacttctacccaaaaagagagatctaaaaatccatcagcccgtatatcaatttctagatgatattcactcatatcatttagccataatatcaccttgactttccacagccctagtactaaattataaagttaatgaccacgccttatgtaaaattcctggggaaaggcaagaaggaaattgatgtgtttatatgtacacacatacataggcacacatatagcatagcaaggtggcatttatgagtagctgctatagtccttgttctgtttgaaagttgctataaatttcccactgcagcatataagtgtagaagggattctttttcagggtagtagtttagaccatcattcttgaatcattgagaccttggtagtgtttcctatattggaatactgaagtcttctctgtttttatactcaatatgcaaattacaagaaagtaccccacctccatctataacacaactttatgtctcagtaataaccaggattaatcactcaaacagaagtaactttccttttcggcctgtatttttcagtgaaatgtgaccagaatgcccagctggcactctaaacttctggttcaagggattaattgttacaggtactccccatacttgaagagtacttctaaattcatatttcttgaagagtacttccaagggtattaaaatgtctcaactgttaaagagtccaaagttacagagacaagaagtagaaaattttcaaatgggtaacttatcatactatagttcattaattttgacatacatacttttgtctcacattttagtgtattcgaaattaggatgcttcctaaaatgatgacatcagtcaggcaattcttgtgatgtgcttgttattgtctatacatgcacaaacatgaaaatgcgtatcagcaggttggaagaaaatataggagatggtagtagagcgcctcaaaaaatactgtatcaatatttttgatataaagaacaataattgtgtaaaaacacacaataatgactgtgcatcaaaaaatagtctggaagagtcagactatgaatatgaaagcattttaggaatttcttaacaagtttaaaatttttttcacttcatatgtttacaagagtgatattaaaaagttatgtctaaataaatcaaaaatagttctctcttaatagggaaaaaatttataactgacaaagtatctcatagtttaattgctgtacatttttcttttttttcttagtggtacatgatataatggtgatttttataattgatagtcatagattcagtgaaatagggtggtgatatctaccactcccacctccaccttctggttcccagatacttgttttttatggttgaagaaacaccaggtaatggtccctgagaagtttcttttgtgtatgagctacaagatttcaagacttttcaaatcttgatcttaggtaatttttgaagtaacaataatcactaatagtttgtctttaatgttcttgtactagctatcacgagttttatgtatctttgttattgttactattttgtgtcaattgccaagagacttaaacatcttttctaacatgttcatattctcttgattaattacattatgaaacaacatgcctattcattatttttatttggaatttttccttttttcatgatttagtgtatttgttacaaaaaataacttgaattcacttttctatataggaacatttttattgattttatgtctcctctttataatctctttcatatttcattatgtttcttctaaatttatcttgtttttttaatacataaatttgaagatgaaaaaggaggtactcctcatatacattcatgtattatacatatatattcatatacatatatatgtacacattcaaatcacaagtctgtcatttttaactttttaattgaaaaatccccaaacttcttgccaatcgtagctaaaactgtacattacccctaaactttcccttattcagatctctaaaatgcctggtgccactccattagcacctgacataatggaaagtgtgaagaaggggaagttggagagaaaagagacagcaatctcaaccaattgctattaaaatatcttacttttgcaagtcttacaaaagcatgtgtccttgtgaacacaatgctagaatctctcccagggtattagaagggttgcctgcacttgagaggtcctgaaatttaatctctgttagcttcacagtaaacctgctgtggccctcagatttcagttctctttgtgagagaagccctctcctctggctggcaatttatgattcccttgcacacactctcttttctggggtctataggacataaatgtattttccctgctattccaagttgagccccctctcaacataattcttttcactctgccactgagcagaggtggttttatctaccatttagtacctttacattttgtacatttggtgagtccccccaaaacagtccctaactcttataaatcctagcagatagggtacatgttaagtctctgagtggtttccttgaagcccctcagttgatttgaggtaagggtgacctcctgccctgaatgtgttgcatacctcataactgctccaaaacaattctctccagcactcttcagcctctccctctgatgtaaattggctaatgttggcagatctggctttaaaatctagtttctgtgggtggttttatttttcatttgggaaggctggtcacctgatagaaaaataaaaataaccatgttaagacaaattggtgttttagctgtctgcttaattgcttttggccttcagttttctctttgaaatcttatactcaattgagcaaatgtttctcagttgagggtttatgtgttctaagtcctgtgataggtaccaggaatgcagagataaacagatccattgtaaacagtcaaatgtaatagaagaatcatatggctaatctgccatatattaagtcatagtgtctaaattgcattaaaccagctcaatataagaacaactgttttcttaaaagttatatgagattttataaaagattttaccttgccattatatagtaattatgattgaacttaccaaattaaatgtaatgtgacgtttactagtatttttccattaaattgttagtgaattaaaaggacgttttggaattatatgggggatctttggaagacttaattttttcatgggttgtataaatagatttatgagagggaaaatggatattagtttctgatatggtagtttatgtgagaattttatagtttgatttgtataaataaaataatgttattgcatatttctggtacattacacttttatttgtataataacctaaacttgtgtttatcttatattgctaaaatttaaggtaatgacaataaaagatttttctggtatgtatgtgaagcctaaatggccccattctgccaccttctggctgactccgtagcttataatattgtgaggtaagtgtcatctaaccgttctgccatggttggcagcagaccatatatttggggcctgggtgatttaaaacagggtcagtttaagcaataatgtagttctagtgcctcaggctcacctttatttcatagttctaaaatgtgttagaatttattggaatagaataccacatagtgatgtatgagattgtttctcccagggtatggagttgtagttaattttgacttttctgcaatactaaagtttcttcagatattacttgataattaaaactgtatcaacatggtaagctatttatcagaatcatcataagaaagttacttggagagtgatatagaaatgaaagttactgaaatcagcaccaattccttatagagaaactaatgggttcagtaatcacttactagagttctaaaataaaaggagaaaccatatgtacaacaacaaagtactaacaaaatcttagtaatttaaacctctagttttgtgacacttctatatattgccatttattaaaaaaaagaatttgggaaggcttaaaacttttggaaatgtaattcatttaaaattggtttgataaactttttggagagggatagagaaaataaagtagaacgctataaaatgttgcaatttgtgaccttttgcagcacacttaacctctttgtcactctggaaaatgggataataatatccaatataaaggtagattgttgtgaggaataaatgctttatttacttcatgtgaaacacttagaatgatatctgacatataataagttagcattgttatagtcaatcttacaacatttagaatatgttacatagtctaatataaatggattccaaaatattctaggcagtaagctttgtattttcttaacatttttacactcaataatattaaattaaaagagagaaattgaagactggaaatgcatagctccctaaagtagtgtagaaatatatgtgatatattggggcctaataaagggcctttatttctgtctgtgactcatcttttagatacctaaagctatctcataaaaaagctatggtatcttgaagaaattaatcaatttaaaaacatttattgagtgtatactgtgtgatcatcagtgtgttagattctggtaagaaatgatatgagaaactcacaaaaagaagtataaacatgcaattactacaatgtggtcagtacagtaacgtgggtgttaatatattttaggaactagaagagaagaaataacattgaactacactttgattaacaagtaggaattagctaggagaaagtcgtcttacataaatggaacttctatgcatgatttttgactactggtttacctgaagtttcttacattttgtattagtataactttacagcctttcatatccagaatgcttttacacacattatctgaagagtgaggttttcaggttattatctgaatggtgaaaattgggtttctatcgtagtaattatgggtgaaggggaaatatgtgttttttaaaactggacatttgtaatgttgctgtctgagcctatagccccctaccttcacctctttatgctgtggagtcaggcaactacactagcagtcaaatgcctgaggttcgcagtttgccctatcagtgctcttgagggttctcatgtgagtgaaaggagtgactatcccatgccctgcaccatttctgtggtggtagtggtggttgagggaagaagtttcatcttcacatttcaggtatttagaaagcccatctggagatttagttatgggactacctggctatagtcttggctagggcgttagtagatcaatgaaattttctcatcaacacgaagggctctaagtgttaaagggagacagtgcccacatcaaccatgactaggagtttcacatgtccatatttcatacattttagtactctggaaatagaatcccactttcctcatccccatcaccttattacatttaagtcttgtgttaattttctattattgctataactaaatagtggcttaaatagtggcttaaaataacacccatttattatctcactgttctgtaggtcagaattctggcaggctcttatctggagtttctggggaagaatttacttccaagctgatccatacttctggcagaatccagtaccttatggttataggactagggtctctgtttcttggttgactgtcatctagggggctcccttagctcttagagccctctctctggtgcttctacataggctgtaatatctcagagccagtaatggtgtgctgatcattctcacacgtgaaatttcatgacatgttgccatggctctcttctgctcctagctggacaaggttctctgctttcaagagcaaatttttttagatcgggcccacctaagtaatccagaggaatctatttagtcactaattagtagccttaattacatccgcagagtccagttaggcatatattgaaacatatccacagtttccaggcagtagatggaattaatagggggagcattctgcttatcagaaatccatcgggagtttagaaagaagaggaagtacagagagcctacgacctttggtatgcatttcaagactcagtcacaattaagaggaggatctacttaatagttaaagaaaatttaaaccatctttcttccctaatacaaccagaagtataaactagttgttaacagatatgcatatgattaaaataaaatttagaaggcagtgatgtgtttcagactcatattcagctatctttttgaaatctccatttgtatgtctagtaagcatctcaaatttaatatgtccaatagaattttttattacaacacccctccagccccttccttcagaaatgggatagttcccttgaccccttcgcgggactcacaaagggattgacttgtttactcagctcgcagctctcatcccctcacgggacggggagcatgcaggtgagtgggtacagggactgggacaagtgcttctgggcatccgcaggagtagaatcctgtgcagtccagtggaagcttcctggggggtgggggggaggggaggggaacctgtgacctccggagtcctagagggcatgtgttacagtgtgctcatttagctttgccatccacagacaacttaagtgtttaacagatcagtggagggtcagggtgacagccttttgcacccgccctcttggtacccgagtacttgtctggcatccaggaagaataaggtcatatgaatgaattgaagggtggtgaatgtggaggattttactgagcagtagaagtggctcttggcaggatggggagctggaaagcggatggagtgggaaggtggtcttctcctggagttcagccgtcccctgtggaactcttctgcgaagtcctgctgtcaagctgttcctctgaagtcaagctgcttctctttgatgtccttctgctgcctctcttctctcctctgccactctgccactctgctggtggggcttggggtttttatgggtacaggatggggaggtggggacagccaacatggttttggaaaaggcaaatttgggcaggaaaacaggaatgcatgttctcactttggactgcaggtccaggcttgagagtgtggccctcgttggggtctgccctcttctacccagtatttccccgcctcctgtctatatcacttcctcacccttccccagcttaataataactggcatcactacttattcacatgctcaagccaaaaaaagtaggaattatcttttattacttttattaattttctgggttcaatgaatcatcaaatctccttgtttttcaaaaatatatatgaaatctgtctgtttttctttcccaccacaacctcagttcaggtatccatcatctcttgcctggacttttgcagtagtccttaactatttttcatgtttccattcttaccttccacctacacagaagattcctgaatccattctcttcctagtagtcatactctttttgccttattcctctatctgggtctttaattcccagcttcatctgcatggcatactcttcttccatctttctgtaagttcctcttttctttgtacttcaggtcttgacagctgtgtatgttacctgaaacacattatagaaaatgtacatttgtacatgagatgaagataaatagggaggaagaccaaagagtagaattatctgctaagttgaacaattacaaaatagtaatctatcaaataaaatcttaaaatagctgtatgtaatttaagcttatcattaataagcatcctaattttcccctgctccttaaaattacctatacgacattgagctaaagcatttctttgttggaaagaaaaaaaattgaaaacaaaaatgcttgtgtattcagctctgcaggagggatattcaactgtatcagtattaaaaatctatctttccagaaaagaagtatgaagttaatttacctgctggtattactaatagtttaattaggtaaacagcatgagttcaaaacaattaatcatctgccataaaagtctaattattcctggcacattactgagctatttttactgtgtgagataaatatgaattttgcgggttttttttctttttcttatatttgatagctatagacaataaatttagttcttattttctgttggactctgacttttgaaatgttattttgctaacacattcaattgactatatttactgttttcctaacttgattactactttattttacttctagtgaatatattttatgttttgaagaaaatataatatttcctatacttaaatcataaaattattttaaggataaatatgtacttagtgggaattttttgtttaaagtaagccaatttgccaaattttacattgtgtaaaaaataaagaggctttgctcaggattcctcagattccagtctattctttgttagaattatttcttttctttttttttcttttttttttttttttttgagacagagtttcactcttgtcacccaggctggagtgcaatggtgtgatctcggctcactgcaaccttcacctcccaggtccaagcaattctcctgcctcagcttcctgagtagctggaattacaggcgcccaccaccacgcccagctaatttttgtctttttagtggagactgggttccaccatgttggttagaattatttctttaatgtatgtaccttagctgcaaaaaagcaaaattaaaaaaaaaagatgttttagcatacaagatttttagacagtataggacacatagaactgacagctttcatgttgaagaacaatattgtcttgatttcactggaattgttcatttgggtctatagcattctgtccaaattgcagaaattgattgttatggcatacccacgattttcatgctcatatgttataacagaatagtttttaaaaatcttgtttgaacagtttggttgtttgcatgcttccagtgtttagacttttaaaaaacgatttgaaaaaatatgatattgaagtgtactttgattttctttaatttaaataaataatagtcatatatttattaatcagatgtattaatgtaatacagtttacaaagaaattttatgtatattctcttagttgagccatacacaaaactagtgatatagtcagggaagttattaatgatctcgttcagcagaagaggaaaccaaagattatagaggtaactgattagtttaaaaagtggcatatctgtcagcattatgtgtgttcctattgcccagttttgcccatgtaattttctgtgattatggaaatgtttgatgttggcactgtctacacatgtagccatttagctacatgtggctgttgagcacttgaaatcatggctcatgtgactgaggaactaaatttttaattttatttaattttaatttacgtaaccatgtgtcactagtgactataatattggacagtgtaccctagactcaaacatatgaataaaagcaatttgaattcctggaagaaaaattagagaatacttacctttcaatgtacagcatatgttttgagcaattgaatattcttacattagaattgtgagattaaataaatttccatatctctttttatgttgaatagtaagatcattgtttttgcatattgtattaacttactgcttaatattcagcacaattataaacttttttagtttactatactttgagatatatattactattataattttaggtattctggtgagttcaaggataaaaaacatggagtgtaattgtgaaaatttgtttatgtatttgaaaatatatcagtttgccaagagtgaatcaatttcatattaataatgacaccatacttgatagtagtaatcatgaaattttgtataaaaattacattttttaaagaaatgtatgcatgtaactttttgtctcataaagtactgtgacaaaagtactacaactttactgtggatttactcagaaaaatgtatgtcaatttcacactgagattaaggtgaagcatgttgaaagtaaaacttttatcttttacattttttatttctaaatctattattaaattattaaaatcagaagtgatgagattagcttctagttccaattaagatggagtaagtaaatgcacatcactctattcctcccactgattatgcctaaaaaagattctgaacagaatacataaagtagctgtagaaagactttgaaaagtaaatatagcaggaagattggaaagggaaatcaaaacttgaaaagagacaaatacagtagtgaatttcctgcttttagcaatttcttcctacatcctccagcttagactcaaggcagtcagaattccagaactgtacagtggattcagacagaaaatgctgtggctcacgcctgtaatcccagcactttgggaggcccaggcaggcagatcacgaggtcaggagatggagaccatcctggctaacagggtgaaaccccatctctactaaaaatacaaacaattagctgggtgtggtggcgggcacctgtagtcccagctgctggggaggctgatggcatgaacctgggaggcggagcttgcagtgagccaagatcgtgccattgcactccagcctaggcaacagagcgagactccgtctcaaaaaaaaaaaaaaaaaaaaaaaaagagaaactctctttctctaatgagagaccctgtaaggaaatccctggtgacaaggaaaaaaatcaatgaaattccatttgtttgtttgttttctggtcctgctttgagacaagatatactcctaaaactgcactcctgtgtcagtggcagtagcaacaatgaccaaacaagtacctcaaattatgagaaagaatggagacaacccagaaaagagtcagtgaattagaacagaagatcaggagaaattgtctattgtaaacaacaggaaaacatttgtttaataaagggaaaagagccttaagaatctgtaaaacaatataaaaatgtctaaccctacaggtctttgaaatcacagtagaagaggaaagagattgctgcagaaatttctaaaaaaattgaatatgtaatggctgaaaacttctcaaatttcgcaactgacataaatttacagattgaagaagcttagtgaatgccaagaaaacaacatccaaagatataaccaaattactggaaaccaaagagataattcatcaacagcaatgctgctttaaaagaaatgctaaggaaagttatttaaacagaaaataagtgataccagagagaaacttggaacttcatgaaggaaaggaaagcaacaaaaataataaatatctggataaatataataaattgttttttctcctcttaagttcattaagatatgtataatggtagaaataaaaagttaacaatattgtctgttggggtttccaatgtgtataggtcggaaacaactaataatatgaaggagaagactttaaagagaaccaaatgtctgtaaggtttataagttacccatgaagtgataaaattttaattctagctgggtgcggtggctcacgcctgtaaacccagcattttgggaggctgaggcagggggatcacctgaggtcaggagtttgagaacagcctcaccaacatggagagacctccctctctactaaaaatacaaaattaggtagtcgtggtggcgcgtgcctgaaatcccagctactcaggagaatcggttgaacctgggaggcaggggttgcaatgagccgagatggcaccactgcactccagcctgggcaataagagcaaaactccatctcaaaaaaaaaaaaattaattctaagtagactttgaaaaatgaagtacatatactgaaatctctagaacaacatcaaaaaaagggaaaaaagcaactctgcaaatttgcagatgttcaagtaattcaaaagaaggcagagaatgagaaatggaagtgaaaaacagagagaagagactccattttcagcagtgacatgtaaagaacctagaatctaccactagcattcttacaagataaagctaaaaaattgagaatcagtgttttgttgttttcttccccccatcagagaactgagattgcagggcaaccactagcctgaaatctggagagaaaagcaaatccagagactcatggccgagatctgcttacttagagccaaagccactggagccataaattggtgggaacatttaaatgatagttttgacaaactgctggaggctgagtgtggactaacatgggagtgtgacacctctgggagcagcagtcttagggaggcccccacactttcatgggttttgcttctatgtattttatcaggtacttcatattctgatgaagatcctggaaaaggtcccctcgtagttcttgcagagagagggagggtaatcattatgaaatatacccagagtattctccaacaaaggtctactctgtaggggaaaatatattattagacccctatcctggtttggggagggcatttctcccacttcagctcactctagccttcctgtgtcggtttcagtgggggaaaatgtataccactggagaaaagcccatgaaggtcacagctcagagaaaataggcaaagtaaaaaataaaggtttaatcctaaaattatagactgtatttcattccccataccttactaccataccaacagagctctggtataataacaatgcatttcagctggaagagttgcaagaatggactctttttctgaggaatagtactgagataagctcaaagtcaatggatgagacaaacataaggatactagaggaacttgaagtttctgacatctatagcaaacattaaacacagcttacctcctggccagattaacaaatccacatcatatgtttacctttgttcttattactcaatgcaacatggtgaactttcaacaaaaaaaattagaaggcacacctaaaggcaagaaaaaacagtctgtagagataaagcaggaatcagaaccagactcagatgttacagatatgcgaattatcagctaaggaatataaaaaaaccatgattaatatgttaagggccataatggaaaaaatagacatcatgtaagagcacaggagatacataaagcagagagacactaagaaaagatcaaaaggaaatgctaggcataaaaaacactataacagaaatgaagaatgccattgataggcttatcaatagaatgggcactgctggggaaagaatcagtgaggcaaaaataggtcaataggaactccctaaagtgaaatataaagagaaaaaataatgagaaaacaaaaacagagcatccaagaatggtgggacattttaaaaaggtatatgatttatctatcattggaataccagaagaagaaggaagaaaaaagaagaaatatgtgaagtaataatggccaagaatgttacaaaatcaatgacagactttaaaatatagatccaggaacctcagaaaatatcaagcagaatgaatgataaagtaagtaaaccgtgcacattatatttaaaaactgcagaaaaccaaaaactaagagaaaatcttggaagaagcaagagcttggaggggaaaataaaaacttacctatagaagaacagaataagaattatggcagacttctcatcaccatgcaagcaagaaaagagtagagtaaaatattttaaaagttgaaagaaaaaaaataccaactgacctataattatatatctgtgaaattaaccttcaaaactgaaggacaaataaaataaataccttctcaaacaaatactaaggttattcattgccaacagacctgaaactcagatctacataaagaaaggaaaataatgataaaaggaaaaaaatgaaggtaaaataaggatcttttatttttcttattcctcattgatctaaaagaaactgtataaagtaacagtaggaacaacatgctgggtgataatgaaacaggaagttttccctgatgccttcgtggtggtgggggaattggagtgctggtgctggagctagttggcggctttggtcagcttcacttggctttactctgcttcacttggctttactcggcttcactcgctcagatctgctgccctctaccccttgcgggagggggagcacagctgagccagtgcaggagccaagacgagtgcttctgggcactgccaggagccaaactccatgcgggccatggcaacacctagtgagggagtacctgcaacccctcaaagccccagaagtaatgttacagtcagtactcttttagctttgccatccatggatggcttaagtgtttaacagttcagtggaccctttgcctgttcacaagttcagagagtgtgatagccttgtgtatcctgagctcttgtcctgcgtacaggaaagattaggttgcatgaatgaattgaaggacagtaagtgtgggggattttattgctgatggaagtggctctcagcgggaaagggagctggaaagaggatggagtgggaaagtagtctccccttgaagtctctctggctagactcttctccaaagtcccactgtcaagccattcctctgaagtcaagctgcttctctccaacgttcagctgctgtttctcctctccatgtttggctgcttctccttctctgccagctgggtcaggggtttttatgggtataggatttggggcagggcaggccatgggtggttttggaaaaggcaacattcaagtgagaaaacaggaatgtatgttctcactttgggccgtgcttccaggcttgaggatggggccttcgctggggaccctgcccttttctgcctagaatttttctgcctcctgttcctaccaataataccatatggataagggaaatgaatgactgcaatgttaaaagagataggagaaagtatttgggaatactctattacaaagtacctgtactgcaaagaaaacagtgtagtgttatttgaaggtggacttagattagttaaaaatgaatactgcaaactgcgggacaactaaaaaggattctaaagagagatataagtgaaatgttaagagataagattaaatagaatcataaaatgttcatttaaaaccagaagaagaagaaaaataggacggggaagaaagaataaagtcaacagttagaaacagttacaaacaaggtggaatataactatgtcagtagtcactttaaatgtgaatggtgtaaacatccattaaaagacagttcagagtggataaaaaacgaaacttagtttagaaaagcaagacttcctcccatctcttatgacatggcagttattcattttccttgtccatattgaaattatcacccagtatgttgttactattgttactttaaacagtttcctttagatcagtggggaatatgaaaaataaaagattcttattttactttcatcttttcttttatgattttttaaggcaagctatgcattgtctgtaagaaactcactttaaatataaagaataggtaaggtaaaaaggagcgagatggagaaagatataccatataatcactaaccaaaaggaagctgaagtagctgtatacatttcagagaaaacaaacttcagagcaataaacatcagggatttaaaaaggttgggggagcattacatacgtatttggcagtcaattctccaaaaagtcttatcaatcctaaatatatgaacttaacaacaaagtatcaaaatacttgaagcaaaagctgacagaagtgaaatgaaaaacagccaactccactattatagttgaagacttcaacactcttctttcaataattgatatagattaagcaggcagaaaatcagtgtaagtaggtaattgacctgagcagtactatcaatttgatgtaattagcattcattaaatgctccatttaacaagagcaaaatatacatttttttcttcagcttataggagcatttaccaagatagaccacattcttggccataaaccacatttaacaaatcttttaagatagtaatcatgcaaagtatgttcttagactacagtggaattaaactagaaatcagtaacaggaagaaagctggaaattagttaaagaacatatttctaaataacacatgggtcaaagaagcctccagagaaattttaaaatattttaagctaaatgataatcagagtacagtttatcaatttttttttgcaatttagtaaaggcagtgcttaggggaaatttatagccttaaatgcaggttctagaaaagaagaaagatctaaaatcagtaataaaaagttctaccttagaaaactagagaaagaagagcaatttaagcccaatgcaagcaaaagaaaagaaataataaaaattagagcagaaatcattgaaatggaaaacaataaattcaacaaaactaaaagttatttgaaaaaaataaataaaattgataaaattctagccaggataaggaagaataaaagaagatagaaattaccaatatcagaaatgaaagatggatcttcttcactgaagcatccatgggcattaaaaagataataaaggaatactatgaaaaactttatgccccaaaatttgataaatgaaatggaccaattcctacaaactatcaaaacttacacaagtgtaaataaatctgaatgcttctatagcttttaaaaattgaatcgattatttaaaaattataattaataattttcagaaaaagaaagaatcaggaccagatgaattcactggtgaaatatacaaaataaaaatcagttctaagataacaaacaaccctattaaaaagtaggcaaaaatctgaatagccatcttattaaagatatagatgtcaaataagtatatgaaaagatattcaatattatttgtcaaattgcaaattaaaaacaatgagataccactgtacacttactagaacggccaaaaccacacacacacacacacacacacacacactcactctgactgccgattggtgacaaagatgcagagcaacataaactctttttcgttgctggtggtaatgaaaatggcacaaccactttggaagacagtttggcaatttcttgaaaaattaaatatagttttaccacacaatccagcaatcacacttgtaggtatttaaccgatttaaaaacaatatccacacaaaaacctgcacatgaaaactgcacattatagcttccttcataattgccaaaaactgggagcaaccaaaatgtccttcagtaggtgaatggataaactgtgatatatccattgacatggctaggctttgtgtcaccacccaaatctcatcatgaattgtaatccccataatcgccatgtgtcaaagaagaaaccaggtggaggtaattgaatcatggaggtgttttcctccatgctgtactcatgatagtgagttttcacaaaatctgatctttttataaggggctcttcccctttttgcttggcacttcttcctgccaccttgtgaagaaggtgccttggttcctcttcaccttctggggtgattgtaagtttcccgaggcctacccagccatgctgacctgtgagtcaatcaaacccctttcctttataaattacccagcctcaaacagttccttatagcagcatgaaaacagactaatacatccatatgatcaaatattattgaattatataaaagagctataaagccgtaaaaagacatggataaattttaaatacatattactaagtgataaaaacactgaaaagtctgtatactttataattgcaattatatgacattctggaaaaggcaaaactcaccagtggtaaaaaatatcattaggtgccaaggttcagggaaacacaagggattaattagggttgtgaaattattggatacatggcattatgcatttgtccaaatccacagcacttacagcacaaagaacaagtcttaatgtacgcaaactttaaaaaaactcatttagaaggttgatggatctgaggatggaatgcaggaggtgaaaaaataatataactgtagtacaaatgtatgaaacaacctactgaagcaaatggagttgaaatgtgttgacttaagttaccttgaaaataagtggagtccgtaagactggaggcaaaagagtactgtagtctagttgataaagttattttccatgggaataaagttgttaacctacctaccaggttaacaattctgatatttctatatgtatatactgaaattgaacaagtaaataagttgatggtggatggtgggagccaggtttctctctatttgagtaggatttacagataagcaaggggaggcagctagaagaaatcatgtagtaatgcattagagttggaaaccagaatgaactcatgctttgcttatagacacagttacatatggaaatacttatcgataagggaataggcaaatgttagtatacacgtatatttccttgctctcagaaaagagggcctagaagcaacaacaccccagtagatgaatgtacccacttgccagatcttgatttctaagaccattctccagtaaaaggaactaaggctccttggagaaatggatgattctaaaagggctggggcaggaaatacacaaagtgagcatggggcatcttgcagtgctagaaagtaaggatgtgctcaaacacatacacaggtgtacacacatgcacacatacacagtgatggaggtatatcaaagggacataggaggaagttgatggagcttcccatggtcaaaatggaataatttgaccaacaaaataaataatgtaatgttgtataaatgctacaggcattaaaagagtaatgtgtacattagaaacaactttattacacaaagttgacaacttagttgaaatagaccatttcttgaaagatgcaaactactaatattcattcgagatgaaattgataactcagtaatactctgtttattgaagacattgtattagtatttgtaatcttcaaaaaaaatcaaaaacaaaaacgaaaaacaaaacactgtcccagatagttctgggaaattctacaaaacatttaaagaagaaatgataccaattctcacagtttcttctggaaaaatataagacagaatacttctcaacttattttgtgaagccaatcttaacctgctaccaaaatcatgcaaagatggcacatgaaaataaaactaccaagcaatgtatctttatgaacacaaacagaaaaatcctcagtaaaatattagtaagttgaatccagcaatatatacaaggaatattacaccaagaccaaaaggggttcattctgataattcaaagctggttcaatatttgaaaattaatctgtgcaacccaccatattagtagactaaaaggtaaaaaccacatgattttatcaacaaatgctgaaaacacattaggtaaaattcagcatcctcctaagataactcttcactaacccaggaaaaaaaaaggaaactttgttatctcaataaggggcatctacaaaacagtgtctacagctaacattttagtagttaatgatgaaaaactgaatgctttcttcctaagacttggaataaggcaagaatgttcattgtcaccaccttgttcaacattgcactgtaattcttgaccaatgcaataaggcaagacaaataaataaaaggcatacagattagaaataaatagttcctgttgaaagacgacatgactgcctacatagaaaattgcaagaaatctataaaaagaaagtctcctaaaactgagtttagcaacaataatatataaaaataatatatagtagcaatgcacaatgtattagtttggtacaaaagtaatagaggtttttgccattgaaagtaatggtgaaaaccacaattactgtgtacccatctaataaaacatttttaaagaactgtttacaatagctccaatttttaaaatacttaggtataaatctaacaaaattatgtgcaagatctgtgtgttgaaaactgtaaaacactgatgaaagaaattcaaaagacccaagtaaatgaagagacatgctatgattatggattgaaagactcaatatggttaagatgtcatttcttccaataagcataatccaaataaaatcccagcaagattatatttgtagacatagataaactgatcttaaaatttatatggaaaggtgaagaaactgtagtagccaaaacaacttcgaaaaaaaggaaaaagggccgggcactgtggcttacgcctgtaatcccaacactttgggaggctgaggtgggcggatcacgaggtcaggagattgagaccatcctggctaacacggtgaaactttgtctctactaaaaataattaaaaaattagttgggtgtggtggcatgcatctgtagtcccagctacttgggaggctgaggcaggagaatagcttgaacccaggaggcggaggttgcagtgagtcgaaatgacaccactgcactccagcctgggcgacagactgagactccgtctcaagaaaaaaaggaaaaaaaaatagaagatttacactatcagatttcagacttactagaaagctatggtaatcaagacagtatagtattggtgaaagaattgacacatatataggtcagtgaaagagaatagagagtccagaaatagactcacacaaatatggtcaattgatttttgacaaaggtgcaaatgcaattcaacagtaaatggatatataaattgtggtaattccatacaatagaatttagccatataaatgagtgaatattaagatacacaacatagataaatcacaattgccatactatactaaatgaaagaagccaatctgaaaatgttgcatagtctataagtccacttatatataacattctggaaaaagcaacactattaccctaaaacctttatttgaatagcaggagttatagtcatgtcatttgtcctctacatggagcacatacatcatttacacattaaatatgttttcatgtttttcttttatttaacctttaaactctaaagtacatagttctgcttggccccaagatgattgtaagaaacatggacaatgaaattttatggctataggtgaccgtcttaattaaaaccttctcatagcagattttcagacctgggacaatatatccaagaatgaatcttacccaccactattttttcaccccaacttcttcactcttatttggaaaataactgcatttaaaaataaaatgtttacttcatgtggtaatcagtgtcttgcagtacaagaaaccctgatctaggagtttgaagacctaggtgactttgggcaagtcacttaatgtttatttttttgcatcttaaaataaggataataatacctgtgctgcttactttatttgtaaggatctcaggtgcattacagtaatttcacaatggttttacagagtaaatcactttatatgtggtaaagtgcttggtaaatgtgtcatcactattattaaataaaagaaaccaatattttgtggtattttgtggcaattaaagctggttcaactctgaaaatttctataattttaaaaattaatgcagaatgaaggaggaataaaatcaacctcatgaagttgattactctctagttttaaaatcttatttaactacaagataagctattctggtaaattctcggtgcatggcgagacatttagtgcgaattaaagttgtggaaacaccgctaggaagaataacaagcaatatacttcttaaagttaattgcagttatgaaggaattcatagttttagttaaaactgcagttgtttctttctagcagtagatgccagtagagttcttctttttatttttatttcttaatcaaaaatcaaatatccgaagtacttctatagcaatagcttcctggtcacattaccacatatagaaacattgctttaaatattaaatattctattttctggaaggacttgataacaaattgaaacaattttatttttaaaacagtgcagatttaaaatacggtgttttcaagatactcatctagtgaagtttactctttttgctttagtaattttgttttaaagcttatgcattgttttaaataaagtaatcttagtgttctagttaggaatctgcaacttctgtacttgagcaacattgaatataaataaaaaatctggctagatgtgttaaaaatgaatacggtccagctgaaatgttacgattagtttgtgtatttggcaatggaataccatgagtgtaatactttggggaggttaatatgtcagagaggtgaatgattaaagggggtaattggaagcggggaaaacaagaagttaagaagtccacattggcactgagtaaaaatgtaattcaaagaatgaataaaatttagtaacaaatagaaaaaaggagaagttcaatgataacagttctattactcttgtctctatatatgagcaacttggtgcttcttggattatctataaatatggtcccatcataaataaaattcaaacattttcaagtattcggtgattctacttagacctttaaattgttaaaaatgagtgaatacttttttcttttaacatgtttattgagtatgtaatacatgcatttcatttatgaattcaagtaactcacaatttagggtcatataaattcataaacagtaccttttaacataatattatgaggtcagtgaaaacaaagcagcaaagtttgttttcctaggaagtatgtggcagacttcactgaagaggtgacatttgaactaagccttgaagatgattagaatttccttcagtagagcaaatcaagggaattcagtaattttatccacttcttcccttacagaatcagtccatgctctgtagatatttgttgaagactacagacatttaataagtgtctgttttgtgtaaggcactaccagatgttaagaaacaaattattgttatgcacacataatatttatacataaagctacaaatttaagaattttgtcatatagatgctgttgcatatttgtttagattgataaaaattttattacacaaaacaaagtatacagaaatgagctgttacatggcaaaattcattggtcagtgttttgttaactgttattcacacataatatttatacataaagctataaatttaagtttatcttatagatactgttacatacttgtttagattgatatgaattccattacacaaagtatacacaaatgaactgttaaatggcaaaattcactaatcagtgttttcttattggccttttatgtagtcctaatttgattacattattgttcctatttattttacttatcagtattgtttctattttttatgtttgtcaaacagttggcagtaaatctgaagtaagatttttttagatagattgttttagatagacctttttctttctttcctttccttcccttccctcccctcccctctgcttccaaagagaaccacggaaatttcttatcctttagtgtcaaaaaaacaagtactcaaaatttttgttaaatgccacaggttactttctttcctgaaaattgacaaggcaagttttacttacttttaatcaaaagagatgttttggccaggcgcggtggctcacacttgtaatcccagcactttgggaggccaaggcgggcgtatcgcttgaggccaggagtttgagacaactcctgacctggccaacatggagaaaccccatctctactgaaaatacaaaaattagccgggcatggtggtgcgcgcctataatcccagctactcggatgtctgaggggcgagaatcgcttgaacctaggagcggaggtcgcagtgagcagaggtcgcaccactgcactccaatctgggagacagagtgaaacaacgtttaaaaaaaaatagagaggtgtttctaagtgagatcactaaatcaggggtttaggtaagtagtagtcttcagtggtaaggttttaaaattaacatgtctcagccaactagaaggaacttttttctctcaattgaaatttcttgctatggtggattttatataatttaaatcttgtattttgttcttttcaaattttagaatgttttaaaatgtacccctggtaatagacatatgtcagcagattataagtttgataagcaatactgacatactaagtgtatgtagttcctgtatgtattaggcctaaatcaatgaattagaaacattcaattttttaaagtgctatttcacattgttttatttatacgtgttataaatttgttttgcaagagttttttcatacccatttcatactagtttttttttatgaaaagttagctgcttataaggattcataaaatctgtatattagttgatttcctagaaaaaatacaacctgtctttagcatgttgtgtttggaggacagcttggccttcagttgtttgcatagacttgtcatacatgtttaactagttttctttttaaagaatgtttagcctactatatatataaagctttatatttaatgctctcattagcctatatattaatattaaaacacccaaacataaagccttttaggcagatattgcaagtttttaaaatcctcaactctagctgaaaagtgttttgctaagaaaagctcagtaatgtgctgttttatattaacaggaaacagaacagcagtagtggtttgaataccctgcaaacaggaagtttgacacatgcatagctcttagcttctgtgtaagaagttgtgagctccttctggaaacatttgcagttacattaagtaaagtgtaaatgcacatgaatggcagcttatagagaaccaccttgtaaccagtatacaggtacaactacagctcttcagaaattggaaggttttgctagccggttatttcatagacactctaaaggtactgcacatgatcagaaaacagctctggaaaatgacagccttcatttctctgaacatactgccttatgggacagatcaagtaagttttgttttttaaatgatacattataactagcaactaaaatggtaattggagttttacaatcaaacataaagaaccctcttttgtttgttgttttctgattttcacaaggacattttgcaagatgaagttgaaagaattccataaaaacttgattataagttgagctgaatcattcagctttcatcattgtatggttttatttttgactaagttcaatatcagtgacaagattttctataaaattcttacatcatttctaatgtacttttttttgttgttcttacataaaaatgaaatacttaagtttcagaaacaaccatctgtttacttcttaaaatgtcttgtatttataagctttaaactttgaaaggggcaacaagactcttgaatttataattacatttctattgtgtttgccatggttttatttttaaatgcatgtgagaaagttatttcagttttacaaacaggaatttctaaaataaaacataattattctatctaaattcttacacttataacattatggatatcaaaaactttataattatattttatgttatttatacatatgactcaaatgcaggaaaagttggttatgcatgaatcacattctttcaggcatgttaaaatgtttgaacttgcagctttgctaaaatggtgctggggaaccatttttggtgccatacactctaaaagataaattgcacatataaacaatactagtgccgccattctacatctcaccttggaccctcctcaaggtatttctgtgactccaattagaggaacaatagaattacccttgaaacttttgccctctttggtgtgtttgtttgatcatcaaatagcactagcgtttgactctttctgtttatgtatttggtagcagttaaggaagaaaactcagcttaacaaccacaacagcaaaatcaagaatggcttacaaaatttactcctaggtttatacagcaccttgacagtgttatagaagcttatttgaattaattttttactaaatcagaaatttttttacattcttcaaactatttttgggagattgaggaagaacatgtatttgtgcattttttccacttaaaaggttttgggttatttatagtctttactgtatagcaagttgatggatgaggaatatgaatatatatcttcaagttaatgaactgttgaatattaaaatagtggtataatattaaactttaccatgtaacaaaagcttgttaattattgtccttgccctattcttttaaattgcagtcttttaaatccttttggaaattatttttatgcatttcaagtatgttttaatttaaagttaaatgaggaattaagacagaattgaattaatttctgtttcattaatacctgctcttcatatagtgggtgtttagtaaaagtgtctcaaataaatgaatgttaggggtttttaataattaaaagttatgtttgaactagactttcaccactttttaaatgtatgggatctgtgatgctttctaaaacatattttaaaatctagtaatggaaaatagtatcatgagccatgatttctattggataaaatgctgttttgttttttttttattgtgaagtcaaaacaaataggattcttgtacacaaataaaattaggagcaaaccatgtagcgctgcaaataatatgcatgatgtaagaaatacttaaagagtaactgaatgttcattaattaagcattcctctacttgactctcctttttatatccctgaataccataatagagataataattttatgtctaaggatgagtatggtagcatgaagctataatttcctattatgaaatgtattattgtagaggagaaaacactgatagagctgaaatagaggaatccgatcatttcaaaattccaaggtttatttttgtggtgaaaacacaatttttatttatttggcgaatgagttatagaaggagttctgactgtacaaagtttcatatgaaccacattcttcaaagctacttaaagcagtttacttgcatgactcatttgacaagggaatgtaatgtctcctgatgataaacactgaatatgtttgttcctaaagtgtttttataatgaaataaactaagcatagaaactacatcaatttacaaaaaaaattcataaacctttgtataaagatcagttaccaatttaggagacatgaaatgcagcatgcttcaatccaagtttctttcgtgtccagtgacattatgtataggaagaaacacagaacaaaggccacatagtggtctcaggtgtttcatcttttactattaaactaagtaacagaaattcctgtttgattaaataaatatgtaacagctaattgcatgcacatataaatacatgaagttcaaagaaaagcatggaggaattctgctttttgttccaactcagaatgaatgagagcattgacatgcgttaagttctctttctagcaaatttattatagttagctttttaatcttcctttgatcataaatgtgtagagttatacaatgctgacttaatgaaggtctaactacagtattttaagaagcaaataggtcaataccatcaaatactttttctttcccttttcctatgaattgacaggctatttctcttgtaaatacaaatccattttagtaaatcttagatttaaatatattaaacaaatgagcagttttgattatggatgtcctctagcaaaatcataaagtggttacagtagaccacttcagtcagttttacctttgcaaattttatacaatctctcagacagtttacctcctatttgttagcccattgaatctgtatcattttaacttctcagctaaaagactttccacctttgtctttttatcagctttttccacttgaaactattccataagcttcttgataatagtcaatttctactcatttggtaaaacttttttgagtatttactatatcatagtaagtaagcaagtttccaggaaaaataagatctagttcttacccccaaaaagaagagcaaacataatataatattcaaggcataatgaaatagttgctttaaaatgtctaagcttactgtggaagctaagtgtaagaaaaaagttgttactaaagagaaaatgggggacttcaaaaatattaaagaatgaatagaattttgagacctagagaagaaggttattttaagaaaataacatacacaagtatttgaaaatatgaacatttagaacttacttaaaaggtttagtaagatactgtctagaaaattaggttctggatttaaactttaaaagttttctattagacatccagaattttgtactacgctgtattagtggggagccaatgcagttttttaaagtggaaaataatataatgcaacctttgttaaaagagcctaaagattttaactagcataatacaggataagttaacttactttactacagagaaatgtgtatagctactatacatcttccgtttttgctgggcatttaattagaactaacgcttttgacgtgacagtcagcatggcaatgaatagtcagataatggattccttttacaacagtgcttgttcaagttgctgcttctgtctggaattctctttcttcacttctaccagtggtgagatttgcccatactttaggcatcctctcaggtatcatctctgtaacaaaaccaccaatgtatcctattcatctatccttcatccttcttagagtctgtgctcttccttatgttcttatatcatcttatacttaacttttattgtggtttatttatagtatttatatggtatagtttgtatactatatatattatagtttataatatttaaaatgcattactattaatccttatgtatctgtctctcatgtttgattttgaactccttgaaggcaaataacttgtcagtttatttcagtattactagcataattttcaataaatcttgagttatttgttaaattaacattaaacatcactgcagtattacacaaatgagcttcttactaatttgtgctattgtgatctttgcaatttattttaaaagcccatggccattaaccaaaagcagtcaaatgctgacctggctctagtaaataccaattttcagtgttacctgtgtatttttatcatgatttccaataaaaatttaagtaacaagcagactttatagtaaaactaaaatagttgggatattaaatgatgttgaaatcaggaaatcattccatgagccatttagcaatgcaagtactatatcaactgtactaacataacgagaagcttttacttgcttgtgctttgcaaaaatagccatatgacagagttagaagacagcttgctactcaaagtgtggtccctgtccagcattattagcatctcctgggagcttgttaggaggaagaatcccaggtcccacctagacctacttagtcagaatcagcattttaacaagatttcccagctgatttatatgcacattaaggtgtgagaagcactttttccctaataacattttaatatgatttccaaatgtatatcttcactggagaaaattttgaaactacaggaaaaaacaaaaaggtaaaaaaaagtatacataattctgccaaaaggtaatgactgttaatttttgtatatatactctattttgtgtatagacacacaaatttctaccagctccaattttttttttttaaacagagtcttaccgtgtcacccaggctggagtgcagtggtgggatttcgactcgctgcagcctctgcctcccaggctcaagcgatcctcccatctcagtttcccaagtagctgggactataggcatgtgccaccatacccggctaattttttgtatttttggtagaggtggagtttcaccatgttgcccaggtcgatcttgaactcctgaactcaagtgatctgcctgccttggcctcccaaagtgctgggaatacaggcctgagccactgcacccagcccagctccagaatttggatctttcaaaacataatgtttagttaacatttttctttataaagagttgttctacaatactattttgtattaaatcataaggatatactataatttatttaaccaatcattggccatctaggctgtttttaatgttttgctattaaaaaatgccatgataaacatctttataactaaatatttgtacatatttaggattatttttatattttataggattaatttgaagaagttatgaccattttaaggcttttgcattaaattaattgaatcccagataaacatgcatatctttttggagttaattattataataattattttttcatagattatagcacttgagaatgtgtgaaaataattatatagctactatccttaatgatatttttaaaaacaaatttaaggccaggtgtggtggctcacgcctgtaatcccagcactttgggaggctgaggtgggcagatcccttgcagtcaggagttcaacaacagcctggccaacatggtgaaaccctgtctctactaaaaatgcaaaaattagccaggctccatctacaggtgtggtggcgcacacctgtaatcccagctacttgggaggctgaggcaggagaatcactagaccccaggaagcagaggctgcagtgaggtgagattgcaccactgcagtccagcctgggtgacagagtgagactctatctcaaaataaattaaaataaaataaaataaagaaaacacatttaacattgtaaaatttattctcaaaacagtatattgatatttttaaaaattaaaaatataatggcccattatacttccttctgttacaactaccagggtcatggtaagaacattatatgtttgtcccctccaaatctcatgttggaatgtgatccccagtgttggaggtggggcctaatgggaggcgtttgggtcatgggggaggatctctcatgaatggcttggtgtcctcccaatgggtaatgagctggttcttgctttattagttcatgcaataactggttgtttttttaaaacaaacatggcacttccccctctctcttgctccctctctttgcctgtgacatgcctgctccctctttgccttctgccatcattgaaagcttcctgaggccctcatcagaagcagatgttggcagtatgcttcttctacagtctgcagaaccatgagccaaaataaatctctttataaattattctgccttaggtatttctttatagtaatgccaaaatagaccagtccataacaaaaatctgaatgtgaaaaatatggatttgagaatttaactccattcttaataagttgacactggaaagtttatttcttcctccctccccctcagctttattaaggtatacttgacaaataaaattgcgtatatttataatgtacaacatgatggttcaatataagtatacattgtgaaatgactaaaacaaatgaatatccacctcacatagttactttttcatggcaaaaaatttaagattgaatctcttagcaattttcatgtagtcatacctcagagatactgcaggtccagttccagaccaccacaatacaactaaagtcacagtaaagcaagtcacacattttttggtttcccagtgcatttaagttatgtttactctatagtctattcagtgtgcaataacattatatctttttaaaagtacatatcttaatttgaaattattttattgctaaaaaaatactaatgatcatctcagctttcagcatttcccaatttttttgctggtggagggtcttgcattgatgtttgcctgctgattgatcaaggtgatggtcgctgaaggttgggatggcagtggcaatttcttaaaataagacaacaaagtgacacacttgactgactcttattttcataaaagatttctctgtagcatgtgatgtttttggtagcattttacccacagtagaacttcttttaaaattggagtcagttctctcaaaccttgttactgctttaccaactaagttgatgtaatattctaaattctcaggtgtcatttcaataatcttcacagcatcttcaccagaaatagattccatctcaagaaactactttctttgctcatctgcaagaagcaactcctcactcgttatagttttatcaggagattgcagcaatagagtcacatctccaggctccacttttaattctaattatcttgtaattttttaccacatctgcagtgactttctccactgaaattttaaaccgctcaaacgcatctatgagagttggaaacaacttcttccaaactcctgttgatgttgatattctgacctcctcccataaatcacaatgttcttacggcatctggaatggtaactccttttcagaaggttttcaatttactttgcccagatccatcagaggaatcactatctgtgacacctttagccttataaaatatatttcttaaataataagacctgatccatgcctgcagaatggatgttgtgttatcaggcatgaaaacaacgttcatctccttgtacatcgagctcttgggtgatcaggtgcattgtcaattagcactaatattttaaaaggaatctttttctgagtggttcccaatggtgggcttaaaatagtaaacaatgctgcaaacagatatggtgtcatctagcctttcacattccatttatagagtacaggtagagtagatttagcatagtttttgagggcactaagagtttctaaatggtaaatgaatattggcttcaatttgaagtcaccagatgtattagcccctagcgagagtcagcctgtcctttgaagctttgaagccaggcattgccttctctctagctaggaaagttctagatggcatcttcttccaatagagcactgttaattctgcattgaaaatctgttgtttagtctagccaccttcatcaattattttagctagatcttctggataacctggtgcagcttctccattagcacttgctgcttcaccttgtacttttatgttatagaaagggcttctttcctttaaacctcatgaaccaacctctgctagcttcagacttctgcaacttcctcaccactcttagcctttatagaattgaagagtgtcaaggccttgttcttaattaggctttggcttaaggaaatgctatgactggtttgatctttccagaccacacaactttctctatatcaacaataaggctgttttgccttcttatcattagtgtgttcactggagcagcacttttagtttccttcagtaacttttttcttttgcattctcagcttggctgtatggtgcaagaggcctagcttttggcctgtctcagctttcaacataccatccttactaagcttaatcatttctagcttttgatttgaagtgagagatgtgcaattcttcctttcgtctgaacactaagaggccattgtaaggctattgatcggcgtaatttcagtattgctgtgtcttagggaataggaaggcccaaggagagggagagaaatgggggactagctggtgagtggagcagtcagagcacacacaacccttatcaattaagctcaccattttatttgggtgcagtttgtggtgccctaaaacagttaaaatagtaacatctgaacacagatcgccataacagatataataataatgaaaaaggaaatattgtgaaaattattaaaatgtgacacagagacatgaagtgagcacatgctgtaagaaaaatggcaccaacagatttgcttgacacaaggttgccccaaccctcaatttgtgaaaagtgcaatatctgctgagtgcaataaagcaacacacaataaaatgaggggtgtgcctgtattaatgcattattattaactgcagttaccattctatacgatgaatctccaggacttattcatcctgtctaagtgaaattttgtaccctttagccaacatctcctaaatcttccttccctgaaccctcccatccttcagcccctgacaaccagcattctattctctacttctgcgattttgatgtttttaggttccacatgtgtgacattatgcaatatttgtgtttctgtgtctgccttatttcacttaatataatgtcttccaggttcattcactctatcacaaatgaaagaatttccttctttcttaaggttgatagtgtattccagtgtgtagaataccatacgtcgatgccatatcttgtgaataatgctgtaatgaacatgggagtacagatatctagatatctcttagacatactgatttctttcttttgatacatacttagaagctggatcatatgatagttcatttttaattttttgaggatccttcatatcattttccataatggctgtactaatgtatattctcaccaacagtgtgcaagggttctgttttctccaggtcttaaccagtgcttgttatcttttgtcttttttataatagccattctaacagatgtgaggtagtagctcattgtgattttaattttcattaccctcatgagtagtgatgttgagcatttttcatatacccattgaccatttttatgtctgcttttgagaaatgcctattcaagtcacctgcccattttttaaattgggtatttgttttcttgctattgagttgtttgagttccttatatattttcaatatgaactccttattagatatgtggtttgcaagtattttctctcattctgtaggttgtctcttcactctgtcgactgttttctttttgcacaaaagcttttagtttgatgcaatgaacaaaccaataaggaatatgaagactcttaatcagtaatcaaaaaaaccccaaacaaaataaaacctagtagtatttcatggcttcactggtgaatttctatcatttaacaaagaattaatgccagtccttctcaaactctcccaaaataactgaagaaggggaaatacttccaagctcatttaccagggcagcattgctctgataccaaagccagacaaggatactgcaaaagaaaattataggccaatatccctgatgaacatagatgcaaaaattctcaacaaaatactagcaaattaaattcaacagcacattaaaggatgatacaccacaatcgaggatggttcaacatacacaaatcaacatatgtgatacactattaacagaatgaagggtaaaagttatatataatcatctcagtagatgcagagaaagcatttgagaaactttaacattcttttatgatggaaactttttagttatggaagtgctgtacttcaacataataaaggctacataggataagccctcagctaacatcttaatagcggtgaaaagatgaaagcttttcctgtaagatcatgaacaagggaaaggatgcccactgttaaaacttctactcaatatgatactggaagtcctatccagagcatttaggcaataaataaataaataaatagcatctaaattggaaaggaagaagtaaaatcttttacatgtgcaaatgatattatcttgtatattaaagaccctgaagactctaccaaaaaaactgttaaaactaacaaattcaataaagatgcagcataaaaaattaaaatgcataaatcaatagtgtttctgcatactaacaatgaactatggaaaaaagaaatcaagaaagcacttctttttacaatatcacaaaaaatgcataggaataactttaaccaaagcagtgaaagatttgtacactggaaactgtaaggcatttatgaaaaagtgaagaaaacacagtgaatggagatatctaatgtttatggatctgaagaataaatgttgttaaaatgcttctagtatccaaagcgatctacagattaaatgccatctcttccaaagtttcaatgacaggtttcgcaaaaataggaaaaacaatcctaaaacttgtatagaaacacaaaagaccctaatatcctaagcaatcttgaacgaaaactttttccactgttaaaaattggtcagtgagtaatagcagatgatctgagagacaaagaactttgaaaataagatgtcattcagaaagaagtaataagttgaacaggaagaatgatatgtgtctgagagattgaatattactttcatgtcctgaaaccatggttgctttcagctttggtgtttcattattgttatttaacaagtatggctcacttgagagacaaataagttgtcatcttttaaatattcagtttaatcaccggcacacttatctattcaaattagcaagaattccaaggaggtcttttcttagagtcttcgttcagctgcttcaagtattgctatactcctaggagtttactcattccaaggagactaatttgctctccaaaagttagttgaagaaagagatggagatttttattttttggagacagggtcttgctatgttgcccaggctggagagtagtggtgtgatcatggctcactgcagccttgttctcctgggctcaagctattttcccacctcagcctcccaagtagctgggaatatagatgcatgccactgtgccaggctaattttttttaagtttattttttgtagagatgagatcttgctgtgttgcccgggctgttcttgaactcctggggtcaagcaatctcctgtattggcctcctaaagtgctgggatcacaagcatgaacatataagctagtgatatcacttttagccactgttgattttaccactgctacattgtttcgtgatttaaaagtggccccaacaaattttatgtaccttgtcttgttgatgtgatgccactgatccttgcggagacctcagtggttcttaatgacaggatgattcactcttcagtattatgttcattcaaaggttatgtcaaaggatttcatttccttaatttatactcatatgcttagtcatcttggcttccttgccaagttggatgtgtgagaaggtactttcagcccatccccacactgtaccaaaattagcctttctttcttgaaatctagtccagggatagaaaaccagtggtctgtgagccagatgcaacttgcagatatgttttgtttagttctcatggtatttttaaaaatagttgaattttatatcattatataaaaatataaaataccgtgattttaaatcaagagattcatataaatatctggactttcatattcttgaaccattggagaaactgatttcagtgacctcttattctctcaggagaaaaaatgggttgcactgaataattgtcctctttaatcagatatacactatctgatttgctccagcattcactatttctgttgctttacctgcctggcctctgtagtcacttggatttagcctacaatgtctctacttttcagcctgaatcaccaacccagattatcatttcccctttgataaagcctccttaagcatatattcctacttgtaagccacagacctatcactaaaatctatgaaagagatttttgtaattctgaaccttgaggaggatggagtctaggagttgatccctttcagaattcctgtttcatttttttatgcagatctatttaccttctttactttaattatctctgtttaccacagagtattgagaaggcatggcccttatgaagcctcaaaagattttgttagatcattcccctgaggtaatggatgcctaccagccttacatttgcataattaaattgtccactgaaatgattcttcccacagcaaagatctatttcaagccaactgtttcctcctcggtagagaagcatttgacaactttttttttaattgaggtatgttttcataaccatataaatcactcattataagtgtataattcagtattaattagtaaatttaaggatttgcgcaaccatcagcacaaatcagttttagaacatttaatcacccacaaagttcatttgttacccatatccagtcaatccccactctcacctcaatctcagataaacactgatctgctttctgtctctatagattttcatttctggatgttttatataaattgaattatataatatgttatcttttacttttggcttctttcactagaataatattttttaggttcatccatgttatagaatatattaataattggttccgatttattgttgaattatactatgttgtatggatataatacattttgtttatccattctgcagttgatgcacatgagaattggtttgtttttggccatttggataatgttgctataaatatttgaaaagaagtctgtgtggacatatgtttttatttctcttgggtagatatctagaagtagaatttctaggtcatatggtaaatttatgttttaaagaaattgccaaattgtttcccaaagtggtggtaccattttatgttttcaccagtaaggtaagagggttccagttttttcacatgctcatcaatgcttggtatcatcagtctttctttcttttttttttttcccctcctgaaacaaagtctcactctgtcacccaggctggagtgcagtggcgcaagtgattctcctgtctcagtcttgagtagctggcattacaggcatgcgccatcactcccggctaatctttgtgtttttagtagacatggggttttactatgttggccaggctgggcttgagctcctgacctcaagtgatccgcccgcctcagcctcccaagtgctgagattacaggcatgagccactgcacccgtcttatcagtcattttgattatggccattatgtgagtgtgaatccgttgttcacagttgtttcactttgtattttcctaataactttatgatgttgagcatattttcaagtttttataacccatttgtgtatgtactttggagaaatgtattttcaaatcttttgcccactttcaaaattgagtcgtttttcttcttattatcaattctcaataattctttgtatattctgaactaagttcttttccaaaaatataaatatcaaatatttccttctagtctgtcttatgttgtcatttttaaaaatgatgtatttgaagagcaaaatttgtaattttagtgaagtccaatttatcgttttttcctttttggattgtacttttggtaccagatcttaagaaatttgtatctaacgcaaggtaatgaagattttcaatctgtacttccttctaaaagtctattttttgagttaatttttatatatgttgtgaagtatgaattgaagttcttttttcaacatgtagatccattttttactgcactacttgttaaaaagaatttcctttctctatttaattatcttggcatctttctcaaaaatcagttgaccataaatgaaagggttcacttctgaattctcaattctgtcccagtgaactacatgtctgtcctcattcctatactacactgtcttgattactaaaactttaaggtaagttttgaaatcacatagtgtaagtcctccaactttgttcttcttttatcaaaattgttttgtctattttggggtcctttgcattttcatataaatttctggatcaatttgtcagtttctaaagaaaagctttattagattttcatagagattatatattgagttcatagattaacttgtagagaattgttattttaacaattttgagtcttggaatccatgaacatgaaatgtctctccatttatttacatattctttaatttctttagcgttccagtcttgtaaaaatgatttctaagtgttttatttctgttgatattattgtgaatggataagtcttaatttcacatttggattgtttgttgctagtatatacaaatgttattgatttttatattgatcttatatcatcctatgatgttgctaaactcattttttagttctagtagtttctttatagattccttataattttctacatatagaataatttcatctgcaaataaagacagttttatttcttctttatcctttaatatctattttcttgcctcattgcactggctagatttcccagtacaaagatgcatagaagtggtgaatgccttatgccctatcttaaggggaaagcgttccatctttcatcattaaatatgacataagtatagagtttcccctgccccacatgtcctttatcagtttgaggaagttcctttctagtcctcgttgttgagaggttttctcatggctgttggattttgtggagtgcttcttctgcatatattgagatgattatttggttttatactttattaatataacatagttcgttaattgattttcaatgttgaaccaaccttacctttcatggaataaatcccacatggtcattgtgtatgatcctctgtatatactgctagattaagtttgctggcattttgataaaaggtttttgcatcaatgtttgcaatggatattggtctgtggttttcgtttgatctttgcctaactttggtattaggcctcttagaatgagttgggaagtgttcctgccacttctgaattctgaaagagtttgtgtagggttggtattatctttgaatgtttcatataattaaccagtgaagccatctcgacttgagcttttctttgtgggaaaaattttaattactaattcaatatttgtgttacaggtttatttacattttctatttcttttttagttagtgttggtaatttgtgcctaagagtttttccatttcatctgttgtcttatatgattgggataaggttgtttatagtattcctttataatccttttaatttatctagcatcagtggtgatatcatagtttcattactgatttctgtaattaatatcttctgttttctttttgttcattttgttttgatatttggtcagtctagtgaaagttttatcataagacttttggtttaattcatttttctctactgcttttctatatattttactgaatatattatatataatataatactataatatataataatatatacaaagcttaagttactgatttggaacttttctattttactctaaatggttaaagctatgaattttttttctaaacctgctttatctacctccaataaatgtagatatgctgtagtttattttcatttacctcaaaatattttctaatttcccttggaatttgtttgtgatttaatatctaaatatttagagatttctaaaatttctttctgtttttatttataacttaattctgctgtgattatagaatatattttgaaagctttggcaaacccttcaaattaattgagacattatattttctagcatttgcttaatatgtagaatatccatgtgtgcttgataagaatgtgtattctgctgatgttaaattctgtattttataaatgtcaagatttttttgatggtgttatttaagttgtttgtctcttttccaatttcctgtctagtttttccatcaattattgagagagaagtatggaaatttccaactattagtattaaatatttttctcctttcaattctgtccgtttttattttagtactgtgggggctcttctgttcaatgcatatgcatttctaattgtcacatttttcagatgtattggccttttataattatgaatgtcccttttgtctcataatttttctagacttaaagtctattttgtctaatattgatataggcattccagctgtcttatggttactgtttgcatgatgaatcttgttttcctgtttttactttagcctatttatatctatgaatctaaaatgtgtctcttatagatgttatatagtttgatcttgatttttatccaatctgataatttctgccttttgatttgtgtttcttccattcatagttaatgtcactattgatatggttggatttgtagcttccattttactgttttctgtctcatagtttttgttgttcctcttttccctttctaccaccttcttttctattacgtatgttttaattatttggttttgatttttaaaaataaaatttaaaaggcattttcttaatatttctttagagattataatacacaagattataatttatcttatcatagtttacttcaggatagtactgacttaattctagtggaatagaactgctttgatccaatatagcttcatttcttttccaaatttgtgttttttcacatatatttatatattttataaacccagcaacataatgttgtaattattgcctcatacaactttaagtctcttaaagaaattaagagagaacagaaaaaatgtgtatttatatagccttttatttatatatttaccatttttagtgctcttcatttctttctgtcaatttgagctgttgtctagtattatttcctctcagctttaaggacttaggtatttctgcttacaacaaatatcctccgttgtttctctgggaatctttcatttcacctttatttttggaggataattttcctggatagagaaatgttggtggatgggtttgctttcttgtttcttttagcacttcatttctctgccttctggccctacttatttctaatgagaagtcattaatcatatttttcccctggacgtgattcatcatttttctcttgctgctttcatgacttttctccttacctttcaacaatttgactatgatatgtctcagtgtggatcttttgggttttattctagttggcattggctgagcttcttggatccataggttactgttttccatcaaattgggacattttcagccattattccttcaaatgttttttcatcaccctttgtctctctcctttttttctaattcccatgagatatatgttggttcccttgatatcccataagtttctcaggctctgtccacttttctcctgtctttttctgtgttcttccgactggatgatttccattgatctatcttccagttcactgatttgatcttttgctcttttaaatctgctgttgggcttactatactgagttttaaaattttggttattatacttttcaaatctgcactttttatttttaaatagtttttctttctatattgaaagtttctatatgttgttcattactgtcgtgttttcctttaggtatttaacacaattttcttttaattattttcatatatgtataatagctattttaaagtctttaaagcctttgtctgctaaattctacacctgggcccattcagggacattttttattgactgctttttttcctcattgtggatcacacaagtttttgtcaaaaatgtgttttttaaaataacatgtggtagtagctctgggttttgattattttttccctgagggttggttttgtttatttttttattaaaaacttcctttgtcttaatctatggaatctgtatccctcatgatatgtgactactgatttctctgcttagttttttcttcttattctaatttttattttttaacctggtttcctagggattgccctgtgtctctgtagcttaattgttatttaatgattgatcagaggttgtactcaaacactgggaccagccagtgctgatggaactgtgtgcaaattgaggagcacatgcagtatttaggcagttcggaagtctgtaccagctttaactttccactgggccctctttcgtgtcctttgtgcttgtcattacctcctagtcagattgcatagcaaggtgggcagactgggtggcctggtgaacttacgtagcctctgtctgtctcatcttcatttaccccatgctatgtttcttgctataccaccaatgtgttgcttagccctaccaaggccatagccttagactgttaatttctttcagcttgcttttttcgttgacaatatcactaatgagttttttggcctccacttcaaatcaaatcagccccctctcatgtcagccccttccagaagtgaagctgctagttttcatgaccagccctaccctggtagaagtactctcctgactgagctataaaggagtgggagcagccccaggcaagaacatctctgactcccactgtttttaggcagagttcagtggttcgtcacaaataaatgtttcttaatttgttgtttatgactgctcgatttccagagccatgaaatcattgtttttgataattctgttcagcttcatagttgtttcttaggaagatttcctgacttacttccacatcaccaaaagtcctgcctcacatggcaactgttaaaatggcaagttcacgtgctgaagttctacttaacaaggaaccattctatagattctttgtaccattttggtacaaattttggatctctggtaatcaaaacaatctgttcaccatgctacccagtcagcccaccttgctatacaatctgtcatcttagtcctgtttcatgtgaggaattttacatttctgcaataattgccagtaacttttttgtgtattattttcttttgaataccacatggatggcatctgacactgtttgtaatgctgaatttaatggaagtttacaaataagttattctatgattctcctttaaaaatgcagatatacatatatgtatataatattattctcttccataacacagaatgtttaaatggttaacatttgtgctgcagtatagctttctggctcatgaaaaatgaaagctatcagcgatctcggcaataagattcatcgccaatagtcactagcaacagcacacagcattttaatatcagtgaggtccacagctagcagtaagagctggtgtaattgaaagacgtttaggtgcaatcattctgctgtttgctccttgccaggttcaacatgggattgtgtgagtatttgaagaaaacagcaattttttcatatctttgaaagatgtaaaaagcgtagattagtgcttaaatttaagaaatctggtaatttataatcatgtggctctaaaataaaaaggtattttatttgtctggtggattaaagctttagaaaagctacgccttggatacaagtgaaccgataattctggtctaatgttgccgtggtaacaactcatgctgatataattgagaacatcttatacatcctggttcgaacattttctccctgccattttgagttgttctagtggtatatgaaggaggctgggataactagcttgaaagaaattcagtctagttatagacatctttggcattaatctgatgtttactagtgatatctcatgctaggcagttatgctttgcttctaggggcttctctttttaaaacaaaagaaagctcttttcgttttctgtgtgctgcatgctccagtgtgtgtgtttacaccatcggttcttctccctctagagattagcataactccctttgctgttggattgttattttgagcaatatgttttggaaaggttggttttcatcatgagtggtaagtatgctctctgagactctgcagctgtttatttaaaaaatatatttataagaggaaaaaatatttttaaagggacagttataaagccacagctactgtgaattatattttgtggtgacgcttttgtacttaggcattatagtaaattgccttcaaaaaccagtaagaactgtaaacaattaatggcactattaataatcaataccaataatcagtttctaattttctttatggttcgatttattgtatttgttgggcactgttattaattgtgttataaattagtaagtagactaaccataagagaggattttcttttagtatctgatcctgaagataattagtttaactttcctttgattagctttgtcattcctaatgctaatttttattagattatttttattagattttttaaatagtaattttgaaaataagatgctgccagaattttgttgatgtcttggttgcttttacctacaatttattgagaaataaggatttaatgatgaaataattagagcattttggttttgtagggtttgttaaaatttttaataaacagtttttgggggaaataattttttagaataagtacacttgtgacaactagtcttttttgttataatgtgatttattttttctaaatatttccaaaactgtttttttgaaaaaatatactacagtatgtactgcagtttatcatagggtaaaagctgtcacttcaagccaaacctgcagctaaaaatagatatcctgttgttagagtgaaaaacatttgcttagagcataattcattagcatcttttgcttaaataagatgcttggaagttaacctttgattcagatatttttaagagaagtagaatatggtttctctgataacataacagtcctataatttgcatttataagatttggaattggaatttagaaactgaaaggtggatttttgctgtataatgatagaattcaaaattgacgaaccttttctttcataactggagatcacctcattataaccaataaatattctttatcctgctacagtacaatataaacctcttaaacactgttatatatttgtttatagaataatattagatattaaagggacattttaacatgcaaaatactaagaattaactggattgttattttcctgttactgaaatagatctgttttaaataatctgctgttttaaatttgaacgaatattacaaaaacaacttaacattccttaggatttctatggatatcaaactgaatatacctggttgtcatacatatatttatttgaatcaggccaatgcatattttctctttgaaaatttggcatataatctagaatctttaggtaaccaccatggtgttctggaggttttacaacaggatggattggatttagctgaaggaaaatgttattgcttcactattgctttatttttctttaaaaagctatgcattgtagatagcatttgatatatttgatcatattggctttcccttctagccattttataccacaaataatcatagtaatcacaactaggtgttctgactttgtcgagaatgcccaatttcaactgattttaatcatgtcataaatggttaagtgtcctagccatttcaacttggaaaattacaagagaagtgtggttttatttgtaaaaataagcaaatgctaggccttttaatctaagtctgtaactacacatgtgatatttatgtgtacatggtacttttctcgttataagactattccttttatcctttgccaattaaatgttggttttctctgagaatctatcttttggccttcttttgatgctacattttctccaaaaaatctcatccatgcctacatcttcagtcattacctgaacgttcagttcaaaagtggattttcttttatcatccctaaatctgctccattttcattgactctgatatctgttaatgatctcactgcccatacaggaagtgaaaacagaaaccttggtcatttctaacttgtttcttaccctcagacatgtactcagtcattaagttctattgattctacatcaaaaatcactcaatattctccagtcttactgacactgggatggcttctagatctcttctcaatcctattataataactgcattactggtctcccagcttccagttttatatccttccaggccattttccacactgaaaattttaaaatgcaaatatgcccattttttaaactaacatgaaaactttcagttactccctattgcctttaaaataaaagttaaactccttattaggtcacatgcaatcaatgacttacctttttggttttgtttgcaaaatctctctcacaaattttgatctagccatactatattacatataattccttgctacctttccatatttatagtctttatcataaaaatttagagaaccagtcattacctccgacactgaccctgtggaattaggtgatttctctgtactcccaaagcaaacttacaaactacaacaattattgtattatattgaaattataaatttgtatgtcactttctaatctctaaatgttgaactcaagtcaaggacagtgccttattcattgtatgtttctagtagtcaccccagtaccccaaacacagcaaggtacccaataaatacttatagaattaatgataaactaaatataattcatttttacatacttgaacagttcccttacattgccagtgaaaaataccagtgtgggttttgactttttttggttcagaaaaatacaataaccatagtatttacttgttcctttatcaactttgtaggatgaagtcatataaaatgcttaagaaactaaattgtaccagtcagtacctttatctttctagtatttaaaaaattggttatatgtgaaaagagccttcactttctaaatgtttttcttactcataactctttttgtgaagtttttgcccttgttaagcaaacaaggtctataaagaaatactaaaggaacttctctgaaaatcagtcaaactattgtaaggcccttatgtttagaggttgtagcaactcactcaaataagcttaagcagaagaagatacaggtattattgggatgcagaggatgtcatggagctcaaaggcaaaagtagagttgagctgttccaaagagtagaattgatttggaaagctgactggaatcataacagtacctttctcagtttttctctctgagatcacatgacgtctttacttttttccttgtatttgctttattatcctcactgtgtagcgaataggtttctctgatgcttgtgcaaaatggagcttagtcatctgaaagcttcaaagtttatgtgctctcctagttcatgtgctttttgatgtaactagcatcattatatcaaaatcctgggtgagaatcctggcccagctgtagttgagggcaaatctctgaagaagaaggcatgaatctgctatgaattacagcaccatacagacttgaataccaacacttcattaatttccctttctagattctgactgaaaatactgtgagaaaaaaaattgggaaagcagtacatcatttctgaaattaaagatggttatttgcccaaatatgtacaggattttgatgatcagactccaaagtctaattaacagttttaacttgagtagcttttctttatggaaaagaaagaaataatagtttcaccctcactaactgggagggatgaggaaaataagtggaagatccaacactgctcattactttcattctaaaacagctatagtgggacaaccaagaatgtattaggccttttcaagttgaaaagtggcctctctttaaatatagaaggctctttcctgacatagaaggcatcactaccagcaaggaatcctatagtcctggccacattcccatttatgaaggtcactggattacttacctgataatgtaaatatgtgtacgctaaatgatgtgaagagtttagtctaacagcatctaaacaggaaatgagaagggccaaagaaaaaccacttaccttatttggggcatttgtaaagttttgaaaagcttgtaattgttcttgaatgaataaaaaagaaaagcaacaatgtggaacctataaaagaggttatacaccataaaacgataaagttacagtctccaagaggtagagaatgaacttatatttagaaaatatttgtgcaggagagtataaacacaaaaaattatagatgccatctgtgttaattcttaaaatttcaagtgagcatggagttagtgaactaagacatgaaacaaagataaaacaagaacctagaatgaaaagattactggctgagaggcaggaatggaaaagaagcataatgttgtgataggaaaaagttgtaagaaataaacctggcatttttagaatataaagctgcattagaggcaataaaaaccagaataatcattgcagaaaagtaaattaataatgtgaagatctctccagatagaccctaatagaatgtagaggaaatggacaagataaaaattataagatggaaagtatgttaaataaaagcaggacaagaaattataaaagaaaataaaaggacattttacaaattgaatggatagcattccacagaacagagcagatatgatttatagaacagaaaagcagtaatcaaaaatatgattcaggaaaacttgttagttgaagaaaaacttgaatctttaaattgaaagacctcattttgttttgacaagattaacaaagatgccaatgcctaaatacatcctggtgagcatttggaatttccagcataaaaaaatgaaatccataaacattctgatgtctttgcatcttacaatctaacatgaagcttgtcctataaagaaaaaaatgcaaaattggagactagataacttaaaaatcttttgagggcagaaattatttaagatcaacagcaccttgaaatgctgaataaactgtaacaagtgcccctttaaatgaatacctgaatttaccctttaagtgaattctaatttaattaaaattaaataaattcccaaagtgcaaaaattgaagtggtaaatgagaaccagagctgtaaggggaagcatacttcaactgccctgaggacatttttagaccttggtggggctttcgtttaaaatggcctaacagagatggatgataggttgtttaatgcatacagtttaggatttcttagccccctgtataaagccaggatcctgcaaggatcataacctcagtgaaagcatagatgagaaaataaaacctctccactgacaaaaggagaaaataaggaagcttgtgtttcttggcttgggttcctgggaacaggggagggatgtgtgtgcatgtgtaggatgcctctcctgagaatttttaatcaagtgcctcctctcaagcaggtttcagtttttaatctgtattaattgtgtggtctaggaacaaccaataaaacacattatcagaagagttgtaggcttgtaacatatactctacaccagctaatacaaaatcctatactgggacacattctcagaccaagacctgcaggtttctcgcagataaagccccaatgaactttgtgttcacaatccaaaaacaaaatacacacacacttacacacatactgcaaatgatatttagatacaacaggattagaacctgccaataatgtcactagacatagtaaaattatcacatatgactactatattaaattagtgacataaaaataaatatgaggaaaaaatgtatgtaattctaacagagccttaaaatatacaaaacaaaattgacctatgtaggagaaattttatagatatagatagagaattcttacccagtaattgaagaatacataggaatatgtagaacacttacaaaattaataatatgactaaatgtattcaacaaatttcaaatgattgatatacaggctacagtatatcaattcttaattacttaactaccacaaggcaattaagttcaatcagtaataaaaagctttaaaaaaatcacacaaatgtatacatttggagatttaaacattttaaataacttaccaaataattaactcgtaaatttaaggtgtaactatgtatcagaacttgtggggtgcagcaaaagtggatatagagttaaattttaagtgctcaaattaggaaaaagaaagacattcatgatataagaaaacaagtttaaaaagccacatggttaatcaaaagaagaaagaaactgataaagacgagcaaagatcagtgggtggaatagaaaataaagatacatgagaatcaaaggttagtttatgggaaaatattttaaagtactaaatagaactatacctgttttaaaaattgaatcacagaatctttatgcagaacttaacaaaattaggactggagagttttacatacaagttttaggaaaccttcaaagaacaaaaacttcaatcttgtatggaattttccagagcattgaaaaagagaaaatactcttaaatgcatttactgattctagaatagttttacaagtcaagtataggaaaagaaaattagatacattttctctgaagttgggaataggaaaaggatgtccactgccattgtttctgtacatcattgtactgttagtcataacctgagcagtaaaacaagaaaaacgtggagagaaccaaattgtcattattcacaaatgatttgtgattggttacatagaagactcaagtgaatctaccaatgtgatttcagaattgataacagaatctggcaagattgccagatattaaaaaaatcaatatataaacatcgactatgttctatacatcagcaacaaacaaaaaaggtaatttttaaaaatctcccttttacaatagcaaccaaagtgctaaagaacctaggtataaatctaataaaagtgtaataagacctttaagggaaaaagtataaaattctaccgagggatatttacctaatctttaacaatcagacatgattttttatactcattagattagcaaaaaatggaaagtccaacattaacaaattttgttgaggatatagagcatcaaggatatggtgggacaataaattgatgctaccatttactgagtcatttgttactgccgaagttgatactgtgcattccttatcatctaggaatccattcttaactccatattgtcgggaaacaagacaaaatatttgaattcaggcctttctggaaaatccttgacatatgattgtagtagatataatactgctacaggaaaaagcctcattgaacaattaaggaagtaaaatatacttcaaggagcatttcaaagattgcctgggtcattagttttatgactataaatttactttgagttttcattacaaaattatgtaggaaacatcacgagtcaaacatggcatggatggcctacaaaatccatagcatccccagatggagagctgttgggagagaaggcatgtacatatgattagttgtgaatgaatacactgtgtgaattcatagtgtatccatctatccatgtagatgctagtcaaataagttaatgtatttctttctagaatgattatttaaatatatgtctcattaaaagtgtttatatttttccatataaaactatagtaaaaatttttatttttcacagttcagtgagtcagtcaattatgctgttcacttgtaactaagacttgatgaaaaattaacaagtaataaaacacagagaggaaagaagagtaaaataaattttgtaataggaagtgtaactttcattgcctattaaacttccaaatactcatatatatgtggctttagtctttatagaaagactaattaatcatcttagaaatcaaaggtaggcatagtccaatccaataaactgtacaattacaactgaagtattaaagttgttttttatactcgctatcatttttaaggttatagtgaatttagtttgaatcagtatgtttaatatgatgaggcaagtgccccttcagcaaagtgaacacaattattcttcagtttcaaaggacagaagatgataatttattaacatatttccagagaagagttttggttggttaaaaaaaaaggatatccaaagaatttcttgtaatccttatataatacatttttggtatgtatgttcaattgttttatcattctatttctatgtgcagtacagtagtgaacatgtatagatgggtaacttcttgtaggtatgttattttatgtgttatttaatctctgtttattctttttgatcaagcacgcaaatcatcagatgcatctggtaggaaaacccctttttttacagaataattctgttactttgattatcgtaagctaaatttttatgagatattttgtggcaattagaatattttgtgttgagtttttacaattctgtttactgaaaatatttttagtgtgtgtgtatgtggggagggggagagtatttttagaaataccaaataaagctctaaagaggtagatatttgaataggggtggaagaagatggactaatgcattcccctagatttacactttccagagatttttctgctgttatttaatgatagaacttggtattttcataggtaacttaccttagtttccatcctcttttgttctttctggcatgcactaaataattcttaaatagaataatgcttttattaaggtaaaagagggagatgaaactaatgacaaagtagaaggagcatgaattattatcttttcagtaacaaatttttaaactgttattacaaaaatgacactattaaaaacattattgcttgtggttcctaatattttatctttctctaatagaaaatttttaatagccctgttccttattccctacaaaaatagccatcaacatctaacatattgagacgtctaatcctcatcatccctcattattttatcctattcccctctcccttagcaaaagatcttgccttctggttcccggaagaaatagaatctagcaactgtgaactaactcagtttacttctgtttctacccatgcgttgaaaagcatcactatgccaaaaaatgcctccctgattcggcatctgcttgcctgtgcacttcatctcccactgatgttttacatgtccccgatgctgcagttattacaagtcagttgctgtttcctggataaaccatgctcttcttccatgccatttatgtaagatcgtctcagcctaggaggtctttttccccaactttatctgccagaggaattcttatctttcaagattcagcacaaatgctgtattctctattatgccttaccttactgtccaagaatttccccctcccagctctcacagcaccttataattgcctttgttgtagtctttgtcccattccattatgatgattcatgtaagcttctcatttccttaacagtggaaatatgtttattctttgtagtattcagagtctagctcagaatctgacaccactaaatggtgctcaataaatactgttgaaaagattgttaaaccagcactgaggaagtggaatgactgaaaaatactaaagtttttcaaaaggaagaaaccaggtgttataatgcgtaatgtctttcctacagtagattttgactgaataacagaactccagagatggtattgcaatagttacaggatatgtatgtcaatatttgcttcttaatattgttatgaggactattgttgtgagaacttaaagtttttgttagttgttgttttaaggaaaataagaaggttattgattttggcactaaacaatagttacttatttctttaccatttaatttgaagataacttatttgaatacatacaatcaaataattgaatttctacattaacattttatttctgtatatagtattctgaaaaaatgcgtattggtgacttcatgctaatatgttattcatataatttaatcattttctaatttattttttggacacaagcttgctcctcttcagaaatatctggtaggcaattactttttaataaaacaaatattacctttaaaattttttatttattgtttgcaagtttttattttccttataaagttatatatttttaagtatatcaagttaatgaaatattttcattgatgaaggaaatagtttgtttagttttgttgggttttatctatataaatgatttatattgtaatttcttgtgtggtattttagaaagaataactgtagcaccatgaaacagtagatgtacaaagtagtagaagaaagattaatacagtaaaagaaagataaataagtagaagaaagatttataaactcttaatacaaaatatgaatgatattcttttaagaattggataatggtatactgtgactaacaacatactctttttatcataagcagtaacctagtttatcttacacagcagtcaaaaatatctaataaatacatttgttaaatgttaatagtgaaacattcttatagtggaattacctgaattatatgggatgaagttatgctgtgcctgaattttcagtcagttttcctaatgtttaaaataaactttaaaatctgatttttaaactatgttctatgtataaatacattgaaaaatttgaggggggataagaagtaagttgtgtttttatgaacttgtgaaaatgcataaaaattgtctctcttttttttttcatctcttgaatgtgggtgaatgttcctgcaaacaaatcttgggtgaacatgtagattcctttggtatgctcatttcctttagaatgcaatgtgatagactatttaaatcatacaaacagaaaaaatatataattgaaaatgtatacttttgggaataaattaattttttgtgtgtcctcttttttgtagtatctactttgttcaattatttaccagtagagaataaaatgtgtttcagaaaaatcattctttgaaggatttttttcttaagaagagttactaatcactgttagatgctttggagataggtacctatggtcacacagctaggaagtattagagctaatattctaactcagatgttccaagctctgaaaccatcataataatttaagtggttaaatgtagatatggcttatatattagaacacaataagtaaactaaataattgagaacttcaaactatatgctttatagggaattctgggttgaatgtggagcagtatttgaatctggctgtctctgtcacatcttattttattaattatctgccaacactttatttcagtggatagaaattttttaaataaccagagaagagaaaggcatttagaagttacatccaccaatatctaaacataataaaattcaaagcaaatgcatgtggttctagattgcttattgttttagggttacacataatccaatatattgtgaaatattttatttttggtagatttgttattaaaagatgtatattttgattaacttatatttttacaaataattatgtttatctttgcatctacatagtacacataaaaactagagatttcatatgtgtagatatttttatatgaaaaaaaatgtttcaggaacaggttttcctcatagaactatttaataacatcatacttagtgcccatcctttaatgtactcgaaaagaaaatccctttatattttgaagtaattcacaaaatataataatatatttgattaatactcatttctgataattttcacataagacctttataaaaacttttccctacttttacagtattatttgacagtaaactcaggaatattgatgagtacagagagtattttaaagaatttcttgcatattctattagtgaataaaattaaataatgccggaaatttttcttttagcttatcaccaggcagggaaaaggaatttttttcaacttaccatctttgacaaatactgtcagtccttcctttgatcagttacttttttcttaactccagatccacttagcataaagtgacaggagaagctgaaacaggatgttaaagttgttttttttaccttcccttactcttttctttgtctctaaattatttatactcatataggcatctggagagtttatattgcaacttgatgtgcaagttctataaataaaagataactaaaaatatttttcagaagaaacaaggggtatattttgggaatcacaagttgttttttcttaaatgccacagtgcatgttgcaataaattatgtttttaatttaatttatagccatcatgtccaagtgaatgccatgtgcagatatgtctgctccatgcaaaaaaagaaaatcttacctataaaattactctttttctgttgtaactagcacattcatttttagaagcaaggatgacttgaaccatcctaaattccaagaaaaaataacaatttggccggacacagtggctcacacctctaatcctagcactttgggaggctgagccagaaagttcacttgagctcaaaagttcaggacaagcctgggcagcacagttagaccctcatctctacaaaaagtaagaaaattagccagacttggtggtgcacatctgtagtcccagctactcaggaggctgaggcagacggattgcttgagcctagtagtctgaggctctagtggactgtgatcatgacactgcactccagcctgagtgacagagcaagacccagtcttaaaaaaagtaatagaaagaaaagagaaaatgtaagaatttgccacccttaatccacccctcaggaagaattagattatatttggatgattaggtaaaattctttgattcattgttttagtgcatgagattttcctacaatgggaaaattctaagtttaaaaattctttttctcagtttttctaaaaaaggcattctgagagtattttacagtaaaatacaaaggacagtttatagaaagtactaaaataatgtcttcagagattcatactctaatgttacttaaaaactaatgtctgctcttggtgcctgtcatcatcattttgaaatctcaaaacatttaaaatgccaaaagcctttttggttagtaacagtattttcccaaaggtatgacattggtatgacatttataaaggaggaaaaataaagtatgttttaaaataggtacctatctcacttcaatactactgtatcattgagaatcttaaagaatttgtgagcccttcactagtatagtcaggttttattcttatacctaaagatatgaacaacaatacattttgttaatgctattttatctctttggaatatttttcctatttgtttttaaacatctgaagttgttttctaagatagcttttgaaaatggggaaagttttaactggttcatcatttaatttacaaatttaaaacttcaaaccatagctctataaaataatgtggctattttatacccacattattaatcaatatacaaacacttggttttgaattgctttactttagtgcattttaaattgggtattcagacatttagtttatgctgcaaatttagaatgagattgttaaactggattttttgttgtcgatgttttgttctgtttttaagtctttgttggtgtcctttatgtgctagtctttgcttttattttttccctttgccattagtaaagagaacacaaatctaatacataacataaatccttacacctgaaaacagctctttatcaagatcaactatttttgaaattccacgaatcagtaggttaatgttctccacatgttttcaattcttgtatctaaaggctccgttaatattactgatggcctttttacagtcactattttgtcctaaattaatttctgactttcttacattactttctagtatgttttcaggaacagaatttttgttatgacatttgaaattatcaaagtggtttctttatagaacaatattagagaatcttagagatttgagaaggttcttagagatactaaatagctctttaatgtatcatggtgataaatatacattttatcacaatagatgacatgtctttttttaagtgagaaaaccatatgcaatataaatattcttatacagaatataaatattcttacaagataaatttgtttttatatgtatattttcagtgaaagagtttctagccaaagccaaagaagactttttgaaaaaatgggagaatccaactcaggtaaggaatatttagatttttctaaaattaaaaatcttgtattaataaaatcaggattcttgcctaagaaatttattactttagaaattttaattttcatgtggtgttagtaaacagaagcttaaaatgggaattttgccatagttatactttgatgtattaattaataatcttaatgtatgcctaaattgcaggaaataatttccagtataatacctaattataaatttgatactgattccagttgctataaaatcttaatattttcaaatatattaattttgaattatgcctttgatagcatacttataatttttattaattacaaaaataagagtccttacgtacagtttaaaattctcagtcatagagaatttggctatcaacaacatccctgatacacaggcatcttttttatcatcattttgatgggttatgttctatataattaaagtattttagatcttaactaggatctaaaaactgtatataaaaaaccatctatactttacaaaaataatatttttggagttataaataatgaatgaattttaatagtaaattaaattttgttatacttcaagttctgggttgcatgtgcagaatgtgcaggtttgttacataggtataaatatgccatggtggttgctgcatccatcaacccgtcatctacattaggtatttctcctaatgctatccctcccctagccccccaccccgcgacaggccccggtgtgtgatgttcccctccctgtgtccatgtgttctcattgttcaactcccacttatgagtgagaacataaagaccaaaaaaaaaaaaaaaaagaggtcgttatttgaaaaagatacttgcacacgcatgcttatagtagcacaattcacaattgcaaaatagtggaaccaatgcaaatgcccatcaatcaacgaatggataaagaaactgtgatatatatatatatatatatatatatgtatgatggagtactatgcagccataaaaaagaatgaattaacacatttgcagtgacctagatgagattggagactattattcaaagtgaagtgaaagtaactcaggaatggaaaaccaaacatcatatgttctcactgatatgtgggagctaagctatgaggacacaaaggcataagaatgatataatggacttttggcacttggtgggggagaatgggagggaggcaagggataaaagactacaaatatggtgcagtgtatactgctcaagtaatggatgcaccaaaatttcacaaatcatcattaaagagcttactcatgtaaccaaataccacctgtaccccaataacttatggaaaataaaagaaaaataaaagatattataaccaaaaaaattaaattttgaaagtcttttctgcctagctcaaaagtttttatttcaagtattttctcactaaagaattctaagtaaatgtttcttaaagatgccattactatcaagatttagagtatgacctataagttaaaacatagccacaaagattaaacattgtgattacaaaatgttagacattgtgtaacatgaaacaataagagaggtaaggaagataacatatttttataatacaaagaaaagcaatgaaaaaagcataaagagcagaaacacatattctgttgtctattaataaagtttgttttcattatttggttggtactatggtaaacattttaatccatccatgttgataaaacctaagattaaatattaattaaattaattcagtcagaattataagagctttctgtgttgataaaaaaatcttatgactacttaaaattattttaaattttaagctgtgaaatcaaactatgatgaaaacaagctataagtaaaacagaattgcctgctgtctgtaatgatccaacagaaagctaaaatgggtctcaaaaggcaaggtttgatttgcaatacagataaaatccaactacagtgaactgtaatacctatacaaattcctcactggacaaagaatcatactgcatcacattttttcaagctaaacactacatactgggccttcagaatatttttctgatattttcatggagttctttgcaatgaaacctattaaacaaatgggtcagcaattactacttcttgccatttaacacataatttgtccctaataattttcattttgttgtggcaggaacaaatttaatagattgatgcctccaattatttgcttctgtgctgtagtcaaagccaaacaaagatgtttccttataacaaaacatctattcaagaaaaaaagagtctgattattgttctgggattctggcttttggttctttgtagaatgaggaactcttctttccttattgttgttgttttagataatactgtgtttttataatataaagagagaaagccactaggctctctcatgctgctactatctagttctataagcttatataaagacagaaatgaagcaagactgatttcttcacaggtaactttagtgaaagagctctgatccctcagtttatctattcattacagttatttgcaagtgcattaagtctgtatggcttctatgactctttgtcagtatgcctctggtcagtttgtaattattaaaatatgaaactaatttattggaagttcagtagtaagattaaagtccaatactaggaatgcatactggaatataatctttaatatttcagctgaggctcttatttcctcctattactattatgctctgttttccaatacattctctcctcagatattaaatactttcttattcaaagggaaaaatagaaccaataaactggaatctcaatagcttttttgtattgcatttaaatggatagttataaatgggattatccattatgattatgtattattaaagcatttataattcccatagtgtttttacgagaattttaaattttatttatgtatttacatatagaataatgccggacttgaagattttgaaaggaaaaaaacccttggaacaggttcatttggaagagtcatgttggtaaaacacaaagccactgaacagtattatgccatgaagatcttagataagcagaaggtgagtgtatttgttgttatttaccttcagggtaaactttagttttatcagctagactattaaacagattcagtataatgacttaccattgacagcttcaaataattttattattaaatttaatttttattgtaactaaatttttattgtaactatattatacatagttagtatacagtcagcccttccatatctatgggttccacgtccatggatttaaccaatcacagattgaagatatttgggaaaaaaattacatctatacctaacatgtacagacttttgtttcttgttattattccctaaacaatacagtgtaacaactatttacatagcatttacaatatatcaggtattataagtaatctagagatgatttaaagtatatggacagtgtgtataggctttatgcaaagcctctgtcattttatataagggacttgagcacctgggcattttggtttctgctgtaggtcctggaaccaacccccagggatactgatggacaactataatttattgtgacaattatggactaatttgttttgtaactattacagaagttaaaatgtgtacagtagtgatccaaccacttcatgttacaaattttgaaaacctgaggcccaaagatttgaaatcatctcaagtcagaaagttagttaaataaaaggcctagattaaaacacaaatctgactcctactcaatttatttgctcaatattatcagtatactcctaattttatatattaatacctggctggtatctttaattacttttgttatttatatttaacttcttgacttctgtgactatcctcacattgaccattagactccagcaagaaagaatgccaccttctaatgatttacacatatacaagaaaattatttatatgtcttgctaaagtcaccacttcttaaattcaaaatagaatcacatatggaatagaatcacagtcttcgtgaagtcaagataaattactttccccttctattaaatagaaaatctagaggaagcttaagtctaaatgacctaggatacaaagatagtttttgttataaagatagttttttccccaatattttgtgtgtcctcttctatggcaatataaaataaatttttagaatttatacctatatttatttagatattataaaatgaaaattgttcatttttactcactatttttcagttatggactttctcttcatttttaattttcttattcatcttctgaagtatttaaaatcactatctacttattgcagagatttgagccagcttttatagaggactttaagtcattaggaccttagtattttcacattcatttttaaattaccttaagtaattatatatttatttaagcataattgacataactaatttttaaagtaatttcttatgagtttgtttcttattcctacttagctctcacttcttaattgaaaccataattgaccttcctaagaccaagttttaaatcctctattaggttttcatttgaatcctattattaaaagtaatggcaaaaaccgcaattacttatgcaccaacctaaaagttggtaattgttattatcttccttatccaattctaacaattttgcttatccaagtttattactatatggaaaacatttttttaaatgataactttttaattttgcttaaatacattaagagatatttatctctcaattacaggttgttaaactgaagcaaatagagcatactttgaatgagaaaagaatattacaggcagtgaattttcctttccttgttcgactggagtatgcttttaaggtaaattttagtaatatctaaataagatattttcaacctaaattttttttaagatgaaactataaatggattctaaaccagatgataagcctgaagaatatgaataaacaaaacgaatacctctagagtttgtgtaattaaatcctattgtgcttataacttaggtaacgtttgaaaaggttttgattctccctggggaaattgttcaaaggtgatactcatgagatggtattacaaaaagaaatatttcaatttatcaaaaaccatagggatatcttaataacaattcttatgcaaattcatacacccaacacattttctactttgattaagccctttttgccactatctcatcttcttttacttagtaatttgagttctagtcttttcacttatacaaagcaaaatttttgttccactattcaaatgtctgaaaaattgtaccacatttattatttaaattggtcacttttgagctctttggaatgatactggcatctctctgcaatattgaatcatatgaaacattttaatcttttttctcctttattctttaaattaaatgaagacctatgtatttaaaatattaaaaccattaatcttttatacataaaatgtaaatattcttattaactttttaaattgttttttacctttgttattcttttgcatatattataacgttacttcattgcctgagtatttaattgtttgagaactagatgttctctgcaagaaaaggaagagcaaaagtcccagactagtttgtggcaaaaataactaggaggggaaaaatatgagtgtctctgtatagaaaagctagagcatgttccatttattctttatttctcaaggttattaatctgtcagagagattttaaatttttctaattcagcattatataatattaaaataattttgacctaagttgaataattgtatttcctttttatttgttcataggataattctaatttatacatggttatggaatatgtccctgggggtgaaatgttttcacatctaagaagaattggaaggttcaggtaactaatggttttgctttcttcaaatctttatatgcttgtgttgtttaaccagatttttaagttgatgccaatgccaaaaacttattttgtttgattaatattttggccatatgaagcattaggtggaaacaaagaggccacatcatacacaagttttaatataaagaatataaaaatttaatataaaaaaaggactttgaagccaatttaaatgttatactactgctagatattgtgagggtccactacttgaagagttttcagaaaatggaaaaattaattgaattttaaaatatcaatatttattaaacaaagattaataatacaactccaggacagaggattgttttaaggatgaagatggaaaataaatatatagagaaataataataatagtattatggtaataagattataaaagtttgtttttcacaaatttaattctccttaaagttcttgctaagtttagtttttaaaatatacacataatttaacgggagtttgtacctcatcaggttatgactaataagatctcagagttattaaaataggttatagaatctgatggttttacctgtacttaatagtttataagcttctaccgttcattaataatcactaatagaataaagctaaaataaaaaacaggtacagcttcattcagtatagtgtgttgaagtcaaaataaaaatgtagagacaaatctctaaattcaacattttattgaggaagcaagaattgcagtttgaggcatatacacagactaggtggtcttcaatgtgtctagaaaacaaagaaaaggttggaggttttataaaaagaaattttatgtttatttgttttgaaacaaagtttactagcactagttaagttttggggagctggcaagctctgattggtgagtgatggtggtgggtcagactcgtctaagagtcgcagtaggttgtctcagtagctgttagagaaaactggtttcaggttacaataggcagtttcagcaactagacttgtggaaaatataatttttttgtttgtttttggttttttttttgagactgagtctccctctgttgcccaggctggagtacagcggcaccatttcgacttactgcaacctctgcctcctgggttccagtgattctcttgcctcagccacccgagtagctgggactagaggtgtccgccaccacatccggctaatttttctatttttggtagacacaggttttcaccgtgttggccaggctggtctcgaactcctgatctcaagtgatccaccctccttggcctcccaaagtgctgggattacaggtgtgagctaccacacctggccttaattcttggagcaggtgctgtgtgccctgagtgcgttattccctggcccctcgactctgatttagttaggtatgatgagaatgactaatttgtataatcagctttcacatttttcccttttgatcaagatctttctctgaaagcattgcttgtcaaccatcttgaagttaggcttaattattccttggtgctcggatggacttgttctggttgtctctgtcccacatatgagagaagttatctgttggggggtgtctatgtagggacctgggccacattcaagtaacgaggaggccagaaggaaaatttttctcaaagtagatttttgtctggagtccagccagcatcgagttcccacttatcacttccataggtattagcagtcatctttaagtgttgggctaacgttattctgttgggacagctgcctttacaaagattagataggcactaagaacaaagcttacaaatgatagtacaaaaaaattaacaatatagtaaaatgtatttgtgcagtgcttttgaactaaagcccaggcctaagggcaaaaaactaaagaaatcaaaggaccaggggaaactggtgagacctgctatagccattgactaacattttatgactgggttgaactaaagcagagaatgccaaactttgcaagagggaccaccagcacaaattaaacaaaaaattgtgttaaggatattgtcgatgttgtgactagatgaactgaaagaatttcttaagtcaggctttgtcaatggctttagcaggtctcaccagtacctatagcagttactgattgtgaattttaaattacaatattatttggttaagtgaaaaagcaggcattaagaggggtaagagtttcattacaatatggagtcttgttctagtgttttgagaaaagctgttcacaccatggaaaacatcaactttcttggctttgtttacagtgtaaatgtctctggctatggctttgggcagtttgatgaactttctgtgtggcccatacatcaggcatgagacttgtttcttaaaatttatatagtttcagctaacaggacttcaggaacagagcggttctcattttagtaattttatggaagaaagttcgattggaggaacctagaagaatttaggaccttgtctagtctataggtagataacaagactcaaaaataatgtacagacttacagtctaataacaggtatattatagttattctttagaaaaaacttttttctctacattgattacataggaatcttggatttaaaaacctcttgaggcaaggaagccgaaccaaggcagtcttagattttccttacagtcttgaggttcctggtcctgccaggaagtaacagtttttatttactcattgtaatgctgagaaacccttgaagtcaggcattttatgcactttttaaatacgatagttcagttagagccttagtaatataatcagtgttttcatattctgctataaagagagagcagatttttactggacctgtgcaaatagtcatattcccataaaagtacttacaactaatttttgaattaaggagaaaaaaagcaaatgcttttatctttttttacaaaaatatactttaccaaattgctataaattataaatagctaaagagataagtttttttaaatctggaaaccaaaatatttaagaactaacaatgtaacaatgttttaaatgaaagttatgaaaacattatttttatcaattatttaatttcatgtaatttttgttctgcttgatcttaattagtattttcatatactcatctttttttattagggttctggaaatttttatttagtctattgatcttaaagttattaaaaacctgtatttaagggtacttgttggggtcttttctatgaatctgattgtaaataattttgagaattcaaaatattaactctggatgacaaaaatctagaatagccatgggtaaaaatctgatgaaagtttacaattaacaagtaaaattagttatttctattttatctagcattttaagacaataaccagaattatgaataacgttaatttctctgaatttatataatttttgaaacattcatatgaacaacatagccataaatgcaactaaaagatctagtatcacatcatttatacaatctcttatataatttaaaaataaatctaattatttaatacgtctacaagatgagatctgtgtcttcaaatgttttccaagggcccagctggaaaatcccaaagctaattctagattaagaacatttaatttaggatttgatttttgggaagtttgttaaacatcttaaaagacttaaaacccttggtcaaaacggagtaacaggtcactgtaaaataatagtcatttatttaaccagagtgataatcaaaagacatcagatgtaatacagaaagttatatgaatgtgaaaacttttattatttttaaagctcagtttttctgagtaatgaaaaacctgataaagacaacataggatattatcttgataaaatataaaatctagttttttagacaaatcaccaaaatggtaaagaaaaatcttctgcagtatgctcattatttctttttcccatttagagctttccattaaaaaaattaccaatcatctgaaagttgattgagtacttgaatttaatcagacacaggaagaatgtgtccagggttattgagtgtacactgtgttatagaaaaatatgaacaagaagaggactatcttgagcagggaaatacatggctctcagtaacagcatgagaaatttcctggttacatgaaataatacagacataccaagaagagccaagaatacagattcaaattatactgaaagaaaacttcgtttttctaggcctttaagataaacgtttctgcatcaggccataacaaagttcaaactgaaaaaaaaaaaaaagttctaggagttgaggaaaaaggttgaaggagggagttatcaacccagccaagcaaaaagatatacctttcaagaaagagaaggggatgtatgaccttcaaatcatgtgtagtgtgacacagcaaaagccgaacttctgaaatataaatttcaaaaggaaaactttacctcaagaaatggaattactatttttaatgaagaggacagcatttcaaacctaaaactagggaaattaattagatctcaggaagaaatgtggcagaaatagaaattgcactttggaagatggctgtcaaagaaacagattttataattaaaaatcacaaccttttgcagtattattgagagcagatcaatacttcaagaaagttttgtttaaatatagagagcaagattctggtcctttgtcagtgcacccttgacaccaatcattaatttttagaaaaatatgtaaacaattttcctttccaatttctttccctaactatttacacataaaacttttttcataaggtccatcctttcatttttccaaacccccagtcttaatcttataatttttcttttcttcttcctccgtttttggaacagccaatcattttactttaggaaaaatatttaccacctaatatacttttcatacaacatatttttttcttacattcatattttgactactagacctcaatatacttaaactttttatagaacttaagaacccaataagggatttatatttatttagcaatttgttttagtttttaaacttatttgttatggcccagacatctaataagtatcttattatttaatttaatataacataactgtaagactttaaattacatgagacattgatttataaatgtttatttaattaacattcacctaatttattcatttttattaattatccctggattacttatgaaaattgagatattaggcagagtcgttattttaagttatttttattagccaattttatagcctgttaatatcaaatgtttacctaaataagaacttaaagttagatacatgaatattctttcaataactcagaagatacacgtttattaaatcagtaatattaaatcttatttatcaaataatagcatatacaaagatcattttgttttagtctgggtttatagcttcatgaccttaagaaatttatcagaggcaaatataaaactctctgaccaggaaatctaggcaaaaatctgtgttgacaattttgaagacatttctcattttattttgttagtaactttttagtatagttaagtcttgttgaattgaacccttgatctttatgtaatgcccttctttgtctttcctgatcatttaagttctgttttattgtatgtaagaatagactcctattcttttttgttttccatttccatggtagttctttctccatccctttactttgagcttgtgagtgtccttataggtgagatgggtctcttgaagatagcagacagttgggacttttctttttatccagctgccttttaagtgggtcatttagaccatttacattcagggttagtagtgatatgtgagattttgatcctgttattatgttaccagctgattgctttgcagacttgattgtgtaattgctttatattgtctgtgggctatgagcttaagtgtgtttttgtggtagcagatattgatctttcatttccatgtttaggactcccttaaggaccacttgtaaggctgatctggtgataatgaaattcctttagtgtttgcttggtgtctgagaaagattttatttctccttcacttgtgcagcttaatttagtgggatattaaattcttagatggaattttttttctttgaggatgctgaaaataggcccccatctcttttggattgtaaggtataagctgagaggtcccctgctgatgcacctgatggaattccctctgtaagtgacctgacatttctctgaagctgccttcaagttaaatgtggtatatatacaccatggaatagtatgcatccataaaaagaatgaaatcatgtcctttgcagcaacatagaagctgctggaggtcattatcctaagtgaattaacacaggaacaaaaatccaaatacttcatgtttttacttttaagtgggagctaaacgttgagtgtacgtggacataaagatggaaacagtagacactagggactactagagaggagagggagggaggagaatatgggctgaaaaattacccagtgggtgctatgctcaccacctggatgataggaacattcataccccaaacctcaggatcatccaatatgcccatgtagcaaacctgcacatgtactctctgaatctaaaatataaattttaaaaaataaataattaaaaaaccaattaatttatcaaagatgtacttaagtcatgtgaactaaaatattttatataagcacccatttatccaaatagaattctttaagggatttctagacaactatgtcagatattattatatagacacagcatacaatatatgtacatatgcataaaagcatctaaacacctatactaatgtataaataaaaatattacagcttttattttagaactttaatcatgagatagtaaaacaataagcacatcagtttataaaaagagttagatccaaattatttttctaacaaaatgggatgaggctaaactttaagctttttttaataggtaatattatgaagtatgtgaactaaattataggtagagtagtttgagtcagttagcaatatactggaatagacaaagaactgttaactgagaaaatgtgaatgaattatgtgaggagacccaaatgataggagttattctaattaggtctgtacaatattttcttgtctcaattctttgtccctgaaggtaagattgttgccatttcttttagtatagggacagtgtcctttacattggaattttatcttaaaaacaaaacagcatgaaaatcacaatgattttcttttttatctgatgattttcaagtgtttttaattaaataatatgccaaaatagctgaggatttttgggaaaaaagagtttagtctagattaggataaagaagaggaattgtaaacgtggagggaaaagctccagaagggaacttgtctccgctagctttgagacagtattttgtaacaaggcaatctctgagtcctgaaatttttattagccttaagatatcagttgagatatgagtcttatttggagtatatgattttgtcaccatggtcttttagttttgttgtaagaacaacagactgtttgaatgattcctataacgtttgaacatgttaccagctggagtctcagaaaatatcttggcatgccttcaaactttgagagcctatttttaactaaatgtatttaggtgattcggtttaatgccaaatacgtaagagccaactaaacacaggtgctgaatacacaaggccaaataaacacaagcaccaacagaaaataaagtatgtccttaccaggaagaacaataagccttctccaaatgaaggggaaagtctcctcatccaaacctcaaaactgaggtctaaaccttacacctgaagtcaacagggggaaaataaccctccccaacaggagatcagttaaccaggaggcaaaagacgcctctcaaacaggagtgggaaagagaaagaccccttcccagccaaatcccaaataaaacagaactcaaccaaaattaagagtttagtccaaaagagactcactaaggggaaaagaggggactccccagaagcagcgggactgaaagggctccaatgggggtacttcatgctgtagttcccagggccagtgattctccctgaagtatgtcagctttaggatcccacttctgacaccaagtatatcaaagtcaaaataaaaatatagagatgaatctctagatttgatattttatttgggaagcaagaattacaatgcaaggtatccacacagaccaggtggtctttggtgtgactgaagaataaaaagaaggttgaaagttttataaaaaggagaagttttacgttttgggacaaagttcattggcactagcaaagttttggggagctggcaagctgtgattggtgagtgatggtggtgggttcaaactagtcttagagtcacagcaggttgtttcagtagctattagataaaactggcttcaggttacagcaggaagctttagcagctaggcatgtggaaaatttaattcttggagcaggtgctgggtgctctgagtgctttattgccctggcccatcaactctgatttagttgggtatgacaaaaatgacccaacttacacaattaactttcataattaaatactggcataactaaaacacaagtatgaactgaaacaggactgatgatggtaatttgattcataaaatgatggtggcagactcagaatatcacaagatgatatcaagtaatgagcaaacattggagtcattttaattacccgaggcctaagccaagattcatttattgacttactatgcacagggcaactaatataattaatatagtgtcaggcactgtgcaaagtagcttctgcttatctttgagaattttctttcctctcctatcgtcctctctctcctactgccccttgttcaagcagaatcctcatattgccttatggttatttaaagtttacactaaagtaccacacctgaacctgttctcaaaaaagtttttgttaactttatataattggtaacttcttttctttgcaactcctcacagtcttagtactctttgatattgactctttaatacttgacttggtactaaaaggatagcaagttgattgaaggaattcacactgagacacttgccttatctcatctttcacaagtactacatatacacttgaacaattgccagtgtccatcttagaagttttgaggcaataggaatatgagttattgtttagcatggctttaatcagaatcaaatgaggcattataattctctacttaaagctgtctggacttaaaactgctacagcattagcccttaccattgtcttcctacattcaattaaatattaagtagaaatacccaataacactttgcacttggaacattttactttcacctttcaagaattcgattataggttgagcacagtggctcatgtaagcctgtaatcccaggacttttggaggctcaggcaggtggatcacttgagctcaggaattcaaaaccagcctgggcaacatggcaaaccaaaccctccacacacacacacatacaaatacaaaaaattagctgggcatggtggtgtgcaactgtagtcccagctactcggtagactgaggtgggaagattgcatgagcccaagagtttgaggctgcagtgatcatgctacagcactccagcctggtgacagagtaagaaaaaaaaagaattttattatagatctatgtaatgtatgtgttcctccaattaaacaccagcatatggaaattaatattttataagtaaaaagtaatcatattaatgacattttacatttacagatgcatgtaaacgtgcattttatgtttacagatgcatggataaagtaagaggggacctcccaggtcagatgtttcccagtttaagcataaatgttgcaatgaccagaatgattattttaatctctgcttacaatgttctcctcattccttgtcatttggcatacaatgtggattgacagtgttgggatgaagctgaaactggaagggtattataaaattttgctccccaaaagcatttttctttacatatgcattctttcaacaaatatttactgagcacttgggaaatgcagtgacaagcaaaaaaaggcagcacataaagtcttttgttggaatttgtatttctcttgctaccagatcaaattcataccaaccatcttgagggaaatcctattcatagttaaggttgttcactgaggaaacaaatctgaaagtcattgttatttatcaggcagattagtagaattcaagtaatacattagaagataaattagaaactcagaaaattggtacatccttttggatttttcagattctgacatcaaaattacactgatctattaatctaatatatacataaaagaactagctgggtgcggtggctgactcctgtaatcccagcactttgggaggctgaggcgggtggatcatttgaggtcaggtattcgagaccagcctggccaacatggtgaaaccccgtctctactgaaaatacaaaaattagccgggcatggtggtgggcgcttgtaatcccagctactcaggaagctgaggcagaagaatcgcttgaacccaggaggcggagtttgcagtgagccaagattgtgccactgcactccagcctgggcaacagagcaagactgtgtctcaaaaaaaaaaaaaaagaactgtacgtatttacactaacatagagattatacttatgtctgtgaatctatgtaaacaagcatagtaaaagatttggaaattctgatgccaagattgtatctatggtttctgaataggtttatgagtattcattattcttcatcaatattttatgatatttttccataacgagcgtatgtcatttttgtaacaggaactattacaaaatgggtaaaatggcattaatctgcagataaatgcagctaaagagcttctacatagggaaattctataaacacttgaaatttgtgagaaaagtagatggagcctgttaactatagcagtggccccgatagacactccatttggcacatttgctttccaattattctcaagatcagacataattagaaagacatcaatatatttaaatatgggcaataatgattcacaatgagctaactattttaggtttatatttttcctcaacatatgcttccccataaatttatcagagcgttatttgaacaaaatatagagatttaataaatatttgaaaagtaacaaggttctttacatactttttaaaaaaatactttttgttcccaaagtacctctacttcatattagtttttatgcataatctactaattagaatgtattaactcatttttacagaaaatcaatggttttatttctttgcagtgagccccatgcacggttctatgcagctcagatagtgctaacattcgagtacctccattcactagacctcatctacagagatctaaaacctgaaaatctcttaattgaccatcaaggctatatccaggtatgactttaacacattatgtgtactgtatatgagaaaatactaggcaagacattgtatgtatgtaaccccaacttggaattttttttgaagaagacactttctcctaatagtttaagtagagctcagagttttgctgctattacagagaagcaaaaatcctgttatgaaaggaacttgtttatatctccattaatctatagttgtgaactgagtatagcctcttgcataaggagatattaatagctaaatctatgagcagttattagtgccaggcatattccacttgttttacatgtattatttctttaatcctgataaacctatgaagtggaaataccattgttatcttcattttaagattaacaaaactaagacatagcaaggtcatttagccaataaatggtagagtcagaatttgaacctaggcagtctgatcccagagtccatgccctttacgactacaatataactgccaaagaatccctgactaccaatactgaactcgtagcaacgttttctttccacttctactactaataaagtgggagcatttctttttacacaattattgatagattctcccattgacgtttttacacttctgatggtgcaactaatggcagaggacacattggggtaaggcagacatttagcattgtttcatttttattaatgctatttatttttaccttttattttcacttttttattccttgggtctaggatcttataataatgactgaaaagagttttgttgttattaatttgttccttttctttgagttgaggaaggatttccaacttggattgtttaaactttcattcactagatattcatgaatgaatttcaattacgtggacttaattttttttccatttctttcatagtttcaatttgaattttaaactttcaacgtaggtgcaataaatacatttattgtgaggtaatacattttcactagtattctttttttcttttataggtcacagactttgggtttgccaaaagagttaaaggcagaacttggacattatgtggaactccagagtatttggctccagaaataattctcagcaaggtatattcataatatcaacacataagaagtagaaatatgagacatgcatccctatggacttttgtaaaaacagtttattgatctaattttacatttttaatttgatctaagttatgaatttaaatctatttgtgcatgattactaaagaattattatttagcatctaccactaatcctgtaacctctgtcaattttaactctgggtcttagagatataatatgaataaatatgacctctagatccatgttttgcaaccaaaaacatagtcttttcttaattattcctagtaacggaagggtagagaagacttgctctggattataccaagaggtaaatctagagatgatatgtactagttgtccattctttctttgtttcaaatttaccagttaaataaaaggaatgtatgagaagtgtttttaaattttaaataggactattaacagcaattgaatagttttagtcttattgaaggcagctctgcttttctaaatagtgaaacgtggtgagagaaactgtacctatatccaaaagaatggttaacttttcctctgccatcacttggtggagaaatctagaaaggagaacctaacaataaccaggcacaaataggagagaggaaaaggaaggggataagacacatgcttcactggttcccaaatggaatcattgaaatatggctaacttatagaagtgttaaaataaaagatttctttcaacttttctctcattatctttcataatttaaataatatgtaacttcttgatattttataatctaaatatcattgtagttaacacatttctttaaatacagttaacaaataatgggacaacaaaatgagcactaaaacttttacaaatgtgtatatattgtaaaagtaatactcattatacaaaatttagaaaatacagaaaaacataaacaaacaaccaaaaaaaaacctatatgtaatcccaccaacctagacgcagcctttttaaaaacattcatatatgtatgtacatatatgtatatatgtgtatatgtgtatatatatacaccacatatatgtgtatatatgtgtatatatatacacatatgtgtggtgtgtgtgtatatatgtatatgtgtatatatacatatatattcatatatatgtgtatacgcatatatgtatatatgtatatgtgtatatatacatatatgcgtatatatacacatatatacgcatatgtatgcatatatatatgcgtatatatgcatatatgtatatatatgcgtatatatgcatatatgtatatatatgcatatatatatatatatacacacacattttagctttattttagctttcattttaggttcagggatacatgtgaaggttggttacagacgtaaactcatgtcatgggggtttgttatacagattatttcatcactcaggaattaagcccagtacccatagttatcttttcttatcctctccctcctccctacctccaccctcaagtagaatccagtatctgttttttccttctttgtcttcataaattctcatcatttagctcccacttacaagtgaaaacatgtggtatttggttttctgttctgcattagtttgctgaggatgatagcctccagctccatccatgttcatgcaaaagacatgatctcattcctttttatagctgcatagtattccgtagtgtatatgtaccacattttctttgtctagtctacaattggtggacatgtaggttgattccatgtctttgcttttgtgaatagtgccacaatgaataaacaaatgcatgtgtctttatgatgaaatgatttataatcctctgggtgtatacccagtagtgggattgctgggtcgaatggtagttctgcttttagctctttgaggaatctccatactgctttccacaatggttgaactaatttacactcctaccaacagtgtctaagtgttcacttttctctgcaaccttgccagcatctgttattttttgactatttgtttatttatttatttatttatttattttctggagatggagtcttgctctgtcgcccaggctgcagtgcagtggcgtgatctcggttcactacaacctctgcctcctgagttcaagcgattctcgtgcttcaggctcccaagtagctgggactaccggcatgcactacaacacctggttaatttttgtattttttagtagagacagggtttcaccatattggtcaggctggtcttgaactcccgacctcaagtggtgcaccctccttggcctctcaaagtgctgggattacaggggtgagccactatgcccttccatttttttactttttagtaatagccattctgactggtgtggaatggtatctcattgtggttttgacttgcttgcatttctctaatgatcggtgatattgagcattttttcatatctttgttggccgcatgtatgtcttgttttagaaagtgtcagttcatgtcctttgcccaccttttcatggggttgtttgtttcttgtaaatttgtttaagttcctcatagatgctggatattagacctttggcagatgcatatggtttgcaaatattttctcccattctgtaggttgtctgtttaccgttgatagtttcttttgctgtgcagaatctcttcagtttaattagatcccacttgacagtgtttgcttttgttggaattgcttttggtgtctttgtcatgaaacctttgtccattcttatgtccagggtggcattgcctaggttgtctttcaaggtttttatactccggggttttgcatttaggtctttaatccattttgagttgatttttgtatatggtataaggaagggatctatcttcagtcttttgcatgtggctagccagttatcccagcaccatttattgagtagggaaacttttccccattgcttggttttgtcagctttgtcaaagatcgggtggtcgtaggtgtatggacttatttctgggttgtcatagttgaaatcatagtaaatatatatagtcttgtctctgacttttttcacttttataataacaagcatgcaaacatcattctaatggcttgtttgtaaatgtaccataaaatatgtagccactcttctatcgttgagtgttcaggttttatttttgatttttttattattataaataactatgataaacatccttatacataaaagttttttccttattttacattatttccttagcatatattcccagaagtagaattactgggtcaaggaataggaacatttttaaggcttttgatacatattgccaaattgctttccaaagttattatgccattttacacttctaccattagtgtattatagtgcctatttcataacactatcactgggtatactcatttttaaaatatttactgatttcataggcaataaattgtatctcattgttttaattctcatgttttttatttatttttcaaatggttaatagccatttggtatttctttatgtgtctgtaaattattagttcatttccttggcccatttatctattgtaatttaacatttttcttattgatgtgttttgatttctataccttgggtattaacttgtgtctgacatatttactataaacattagcacacaatttaaacatatgaatcaaaaagttaaagagagttaatgcctatttctattaaaaaacaaagtgctattcctgttataccactccttcccttaaaaagatatacacagtatcaggaaaaaaaagagaaaaagaaaatctctatagcgctaaagtattatatttttgctagaattttgaaaactaagtagtttgtaaagctaaaattttgacaaaagggtggaatgtggtgagtcgtgatggtagagggtacctctgagggcagagcaatagatctgggtagaattcagcttatttctcttcatgacaggtttttggggttgttaaaaaatctcttgtgtcagttgatactgaccatagttaataaactatattagcatgttaatatgaagatgttattcttatttattttcttatgaatacttacaaattttaattttagtaagcttaatatgaaaaaaacaaacataacctgtgatttttacatttggtttgcaaagcactttttacacacgttactccctttcatttgatacagtcctcacaaaactctgtgaattcatttttttcctgcatatcttttagatataggaagcaagacagtagatagcagaagtaaagtatacctaaatatttacatgaattgaattttacattaaactttttgctttcacaaaatcctatgaagcagatgggattatccctagcacattcaccctcctaactccaaaaatatagagtattttgaagtcaacttcattatttactatgtagtccagtttctattattttctttgaaaacttttgatctttctaggcatgctgtggaaaatctgtttcataagattatggacctagagtgggccttaagaagtaatgtggtctaactgccttcctgttattgagcaagaactaaattataccagtgaaataaagaaaatttcattgtctataatattcttaataattttaggaagaagatttaatactctttcctaatatccaatttcagtatctggaaatcctctcctttgtttaatttaaatctgacctgatacatttggttcatttttaaattctgtcctgaatagctgctcagcaattgctttaaaaaaatttttatatgcttccagatcattttgaaattatctttgacttcattctcttttgagtaacttaagtaacaattgacattggtgttggtttatctcagggctacaataaggcagtggattggtgggcattaggagtgctaatctatgaaatggcagctggctatcccccattctttgcagaccaaccaattcagatttatgaaaagattgtttctggaaaggtaagtaaaacattttattattcctctcttattactgtatatgaattttaagcttcatgaattgaaactatattgtgtcataattattattctacattgggaaaaatatagaaaaatctacagttgctgctcttactatcataagaattgaatcatttcagtctcttaagaaaaaaagggcagttttataaagaaattaacaaaacagtaaagcaatttctgtatttagtatttttatcacaaagaacaggatcatagccataattctcgatattccttcaaataaataaaaatagtttattatttcatgtgtctatcttcatggagaaaagttttaggggctgttttatatgcccttccattttcaggagagacttcttgttttaattatgtccaatactataacattggaagtaaaagtaaatataaaatgaataagcctttttcagatggaaatttatagaattgattttaacagaattgttcatatagattgtgattatacttgtcattggtttttagcaaacatggaaataacattaatttttcttcaacatgagtagacttactgtgttgtagtattttacattttgtaaatttcttcataaaccttccttcttttgcacttataacctctaatttgctttcaagagtgttttgtttagggtcagtcatttgctgttgccttagctcagacctcggatctttttttaaaagaccattgtcaattcaatagaaatgagcttgaatttcctaccatgcagcaatgaaagaataggcttttaaacattcccagaaggagaccttctatacattaatgacaaaatatatgggaagggatattttgcttattttcccttctttctatttctacatgtggtactgctttgtcttttcttttctttcccacatagtcccatttagaatatgatcaggaaatagagcatcaatctttatcacattagcctgagatgttatagagttgaggtttttttgttttattttttatttgtttgctttgtattttgtgaccttcttaggcagagataagccggaaggagatagtagagggaaggtctttatttctttgtatctcagccatattcaagctctacatttagtgtgaaagcttacccttggcatctatcaacttacaatttccattgttaactattcacaaggtaccctgaatgtctctaatgtggtaatttattttttttgccaacactcaaatttaaatcatagatgctgcacagctgggctgtagcaacaagacatttgccaatagaattagtctatccaatcacctagaacatacatttcagcacagtattgttccctatctcatagtacatatgcactctacctgggtcatgagattttcccttgtattttgccacgttttatgtagaaagttttatttattatcagtattcacaaattaggagactgactaaagaatttatactccaactatgtcaaaggtaaaaaaataaatacctcttacagataaataaacctagctaggtgttgaatgctgtgcactgataaaggcaatacagaaaagcagaatgcagtacttatttaaacaagtatcagtatcactgctgttcttcttacatttgtagatctctggcttcagacttcttatctttgtaattgttttctcccagcagaacttttgatatgaacaaaacaaaactttgagaaaaattaacagacaaggcagtgatttatttttgaagaatttgagaagtgtagactctcaagaggactaaaggtcatatgaagaatgatgagagaaccaaaatacattaaaatcacaaatggaagaagaatattttactaatacaaaaactaagaatgtaaatgttataataattgtttcaaatcatttaattgacagtaattataaagttcttgaatctttactatattacttttatttatattcatataagaaatccaattttctaacaaggatactgtcataactaaatttacatttattaagaaaaactgctttagttaaaattaatgtgtcttcatttttatgcattggcctcgatttgccaatcattctctattggttaaattttatattcagctgtttatgaatatatattcattttatatcaaactttaaaattttgtatctaataatcagcatatattctaaaatcataacagtctaaatcctgggcaccttagaagaatgacaccagaaaaccttattatatcacaatattctgttttccccttcatttatttagaaatatgacaggatatttggtgtacttttgttttttaactaaaagtaccagattatctctccccatgtgggatataaaattatccccatctcttactccctttactcatctaaagtagaagtcatgaaagtggaatttttgccattaaaaggctctgtattatgtgaagttagattgtattaaccatttcccaataaatcatctgtttcaaaactcaaattcaaactagaatgtgtctctattcacattgcaaaaatattattgtctctctggttagtggctaaaagccaaattggaaactaactagttttttaaattttttaaattgtgcaaattattaaaaatccaatttggtcttatatttgtggatccttatatttatatttgcatttgaacttttaatggttttaatgatatatcatttaagaatatgcttttcattcagaattgtttttgttgattttagaagcatattattttatgaaacagcatcttatattgattatatccaccattctgaagtcacgttataaagattataggtatcaatgacttatcaaagttaaatttattaattaagtgataaattcactaaagtacatatatatgaatattagattgtaaaatactttctctattacaatattttaactcaagctggtatttttaaatgcacacaaagatgatcaatcaacttgttagattctctcctacacatattttgcctttaaaaaaacagaggaggtggtatttaaatgtcacattattcatgcaatgttaaggtttgagtctacaaattcatagttgaaagaaaagatttatgattcctgcattaactatgcctcatcctaacaatacatatgctgagtttctgtatgtagtctttaaatttcatgtctcagtgtcatgtactccatgacaagaatcagttatggtctctatagcacctttgtctggctgcgttacccatggaaatatagaaagtttatattgcagtcaaaaattatacttgcaaataaggtactcaagtaacagctactatggaaaccataactttagagcccttggcttatgtaatttaaaaaaattcttagcttcaacatatctaatgtaaatattgttccactcctaatgagtaacaatatataaggagacatgcaacatagagaagtataaacataagtatatactgaatgatcaaagagttggttaatttttcctgaagggaaattcaatatttacatgaagggtaattgattatcagcccaattgctattcctttctgtctcaggagtccccaagactgtctccaggtttgatgattcaccaggaggactcaacaagattcagcatacagtggtacttgaggctaagatttattacaacaaaagggtacaaagtgaagatagcaaaagtccagaagacaccaggcacaagctttcaagagtcctctcccagggcattcacaagggatgcacataattccttcagcaacaagctgtgacaagcgtgaaattttatctaccagcaacactcattaaatactcaatgcccaaagttttcattgggggttggtcacatatgcaccctctgcctagcacatgccaaaatcccagcctcccagaacaaaagtagttgttcagaataaactatgttgtttgtaccaacagtgtaggcacagtgagccactctaatcctttagggaaagtttcatgttggtataagggcactggtactattcaagttgccagacatctctcaagggccaaacttgtaagcagttctttctaagggtagcagtctcaggcctactatgttaagtcttttctacacacattcggtttcctaaataacatacacatatgcagatattccactatactttttctaagatactattgttaatgcttttggggaaattacaatgtcatttactattttgctatggccatagttaaagagacttagaagtattcagaaatcattttcataaaacacaaaagcagttttactcttttcataaaacccagggccagttttaaacacttcactgtggctatttaaaattcttattaataccttctttctgacagctcttgtggtcctatgagcaaataattgcaaaactggcttcttatgtgagagcagggggagggagaatggggtggatcataatcctctgcaaccttgtagactcattatatctaccactgtttctgcataggtaagggaacagattagagagcccacagatgcagtaccaatatttataaatatttttaatgtcttagctctttcttttcacatatagaatccaggctgattaaagatgcccaggtcttatgaggtagtgtggaactcggcaccatatctataacatgcctagcgtatgaaaagttattatgcctgttgaaaaattgtctaatgtgtatgttcatttttgatcaatcaattctttactgggattgcagatattttgagaacttactgtacctaatttataaataatttgttaaaatttatctcaacatgctcgtagccagtagttagtagattattgcttcttggctgtatataaacccttttgagtcatgtaagcctaataattttatcctgattcataaaagataatgttactagttaaatgatcatttctcctgccaataattgcagaatagcagtaagatttttccctcctttcgaatatcaactttgtaatttctgtgattaagcttagtgtaaacaaatttgatttggctttattttatttcattttcttcttattcatttttattttttacttttttgagatggaatcttgctctgttgaccaggctgaagtgcagtggcacaatcttggcccgctgcagcctctgcctcctgggttcaagtgattctcctgcctcagcctcctgagtagctgggactacaggcatgtgccaccacgcccggctaatttttgtgtttttagtagggacagggtttcaccatgttggccaggctggttttgaaatcctgacctcaagtgatccacctgtcttggcgtctcaaattactgggagtagtaatttgaagtcagtaaactagatagtgagtttaaatcactcagtatggataccatgaacaacatgaatggatttactttttggttgtaacttcatcttgaacttttagaagataatagttatttctaaaactcaaatgtacaagactttataatcagtgctgaaagcagaaaaaatattctgttgagtttgctcaattcagagtgaattttatagttcgtttaacatattacataatgtaatttgacagtagtttaggatatcagccatattgacaatggtgtctttataaaacaaatttatagtaagacattttctccctcactttatcaaacttaggaccttaagaaaagatgaaagtgtttattctataaattaacaggtggagcctgagacaagatgaaaggaggaacttcctatactttcccaatgacttttctagcacagactgtccttggcgcatctgtaaaaataatgatagatatggctgtcttctacgttctttctttaattcaaaaattcagtttcagatcattaaaatagtattctaatgggaaggcttaaaaaataaaaactgtgttgaattaatgtctacagaatactaggcataatacaaggcagtttcatgttaagtcacataatttcttttcatacctgccagatgagatatactctcattgttttataaatgaggaaactgagactcagaaaagttttccctagattgcagagcatgtatgtaagtagagttgggattggaacccaggaattctttctactaaagaaatagcttggtagaattttttaggtggcaaggatgttcacttttatttcatttaactctctagtcctatatgtaggtaaatcaaaactcagaattacccaaagacaaaaggtagtttgtggcaaagcaggaaatagaagaatctagttcagtgattcatttgttattccttcacttggcttcagtgactttgtatcactaatcattccctctcaatctccttggcttgatccccttctcttctttctatgcacttcctcaatgggtggtttcatccagtctcatgactcaggacaattcccaaactcatttttccagtccatacctgattcccaaattccatactcttgtatctagtttctaacttgaaatcttcacttggatatctgatacctcaaattcaacctgtctaaaactgacaagtttttgtcctctttcctacactccacccacccccctccacgaagccttccccatctaaactgatggcaactccaccctttcagttggtcaggccaagacaccttcgagtcctcacttcatatctaatgcacagggaaaccatttttgctttgtctttagaatttacagaattcagccacttcttaccacatccactgctgtcactcttaagtgagtcactagagtggttccttaaaaatgttaaataatatcctattattcttttcaaaaccttgcaaggattccccgttttcttcagagtaaaagtcgaagaccttactatgcaaagtttcatgaaaaagataggataacattgttaaaggatcactcggttgctaagttttaattgtcttcctcactagaatgtaaactccatgaaggcagaaatcttcatcttattttgtttacttatataatccaagcacaaattcctgagatatattagtaagcacatagtacttgcttaattcaagcataacacatagtagaggttcaatcaatatttgttgaatttcaattcatgcattcattaaatatttatgaagctcctagtatgtgccagaccagttctacatgctggatacagcaagtcagttgtggtctctgccttcatgaagctttcatgaagtgtactctatctttggtatctctccagagacatactgactcaagaggccttctgtggattcaaaactttttttaagtatcacaagtgattctgataaacaccatgtgttgagagcttgttttgtgtatctgtacctcactggggaattagatttattctcaagaaaatataattagaaaaatcagaagtaatatggtctctaatggttggaaaacaatcctaaacaataaataatattgaagaaaaaatattaaagaaaacacgttgggaagtgtatatatcacaaacacctcttttatgttgtacaaacacctcttccatgttaaatgatgccagtttcccataaccttatctctcagacctaatggcttaatgattttagactttctcttttcaatatctgactctttacatttactttcacattatttgcctatcttggactggcagaaagctcataggtatatgtcaggaagattaggttattttcccaataattctactaacggagttggtagcctcacaggagctcagattccttatctttaaaatgagagtttagactcaattaaactaagctccctctagctccaatattagaagattctcatttcactttctatagtagttataattgataatgataaaagtaatacccttttgatatagttttaaaggaaaaattagatagtcgctcttcccatcatagaaatctttagtgtctccaggttgatgtattacaaataaaggttgtacacttaaaacaattttgttgaagttattttctgtttttcactaattccagtttgataaatcaacatgactctttgaaaagttcagtcaacaaggaaattacatttcaggttaaatttcagaataatcatgggaaaaaatactttcacaatgactttcattatttctcccccaaaatactttaaatatgtgatggattcccattattaacatgaaccactatgagagtgtgggctacctatgagaatctctggggaagagggtgtgatatggaggtgaggaggatatgtctatgatttgaaaaggttcccaaatcgttctgatatctgctgtcacaacccaccaccactccactgtcacacacacacacacacacacacacacacacacgttcaagaccatcactttatttgcattccaaaataaagaattacattatttagatgattttatttttcatgcattccactgcatattacctgaattccaaagataatttatatgtagtacattactgtctgccatctgaatgtaatgaaagagataactggtacattaccatggaacagttcacacaaatttaatcttaaatatagatgtacttcaaataaattatttctttggaatctaaataaagtttagatttatcactggaaaaatctgagctaatatacccactggaaaaatgtcatgttatttttaaagtagacagtgtgccttttgaaaaccccttattctctagttattacttcatctaggtaaatgaggaaatgtgcagcaaaatatttttaagaaaatttcagtcttttagaaggttcctgataatgactatttttaggttattgaatcatggaaggagaatagataattaaaaataagtaccctgaagtcagtgtacccagtttggaattacacctttactatttattagctctgtaatcttaggcaaaataatttctgtaggtctcaattgcttcacccctacctatgaaatttggataataatcatacctatgttttggattttatgagccagtacagaaagtgtttagcataatgcctagcttctagtaaaccactgtgtcaagaataaaactagagaaggtagaagttcacatatcttattattttagaacataaaactgctcataatctaggataataaagggccttgcaaaaatgagattttgagttgctaatttatatgagttgagcctaaatcctggtcatttattaactattaaccctttaaatagtctttagttgttgatagaatattagttttcctctggtatgataatgatttcaatttacagtactgtattatttacatttaaaatgttatgatcttttactagcatagaaaataaaacctctgcataaagtagtgaacagagttgagaatagtgcttttcaagcttttatgtacatatgaatcccttggagataaaagctcagattttcaggcccaatgcccccatcatctgaggcaagccacaggaatctacatttttatccttttgtctcccagtttattctgatgtgcatgggtcctaggaccagattttgaaaaaatttacttatagactagcacaaaagtggcagtcaaaagctatggttatgaatttaactttactataaaacctatctttgcatgcatgatttaacttctactttgagaacatgagaatgtatgtcaagtaggttgagcttttagaaagtcagaatataaattaaggagtctatatatttgaagacagtgtaataaagagcaaaattcatgaagctacaaatcatgactagattactggtcccaactctgccactttatggcctgatgactggggaagctatacccagtaacattgctgaatcttagtttctccatctttaaattggagttaataccatattcactgaatttgtcctatccaactagaatgtaagttccatgaaatcagagacttgccaggttttgctcactgctatatatccagcacctaaaatagtgcctggcatatagtaggtattcaataaataattgtaaaatggatgaactacagtatttgaaatagtctaataaatactgagaataaaaatggcacaataccttccctcagaagctcagagcctgggggagacagaaatatgcacaaatactatagcatagttgaataaataaatgtattataaagagcaactgaggtaatgtaatgatgcactatgtaagttatgaagtgatggtagtacttgtagtggtagcacttgtagagaaacaaaataagaatgcagagagtttggggatgcgcctcttaaccctttaaagtgttttctacaaagtgctatgatcaatttgtagttgaggctgtaataatccagatatgtatacacatacatgtgtgcatacatatgtatgtatgacagggaagagggtaatgaaagggattgaacacaagctggaaaggatagtggagaggtggtagtgatgacaaaaaagaataaggaggcatagatgcagctattccttcatcctttggtggtacccattttaattttttaggtacccatatcaatgaaacagtaataaccagaagttagattggtatagaggagaagaatgtgtttaaacaaaacaaaatgaaaaatagacttaggtctcctataaatgttactttaaccttatcgattgccaaaaatcttcacttatttgggggttttccatttatttttaaggccagaggccagtctagtaattgtaaagtcttcacaatttagtaggtagaaaaatgcttttaaaccaatctaaatcatttttatactgttgcataataggagaattatttttaaaagccaacttctgataaatgaaaaatgttttcctatactgtgaaaggcagtgtgggtttttacaaccatttttagacttcctttttgatagatctcttttcaaaatgtacatactgatttccttcatatgctggttcttctatttatattacaaagttaaatttatgtatctttgagacacaggtttgtaatgtatgatccaaagagattgctcttaaagataggtgaactttctgatattttgcaaaagttctgtaggtgtgcacatttttctggagactgctccatgttcttaaagacatcataaccaaagcaaggccctaagagaacaggtttagttcattcacccaagtaattctcttctttatggctactgtggggactgtaacatgtagttaaaagtatgtgaaggtcatcgctccatatttttgtttatataatggcttgttgccttgaaaaaaaaactttatgaaatcaaaacagaaatatcatgagtcttagaatgtgtgttttaccaaatggtgtgtttgtgtaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggtgagactttcttttttaatttaaaagcttttttaaagttggtgtttaaattatatgtggtggagatattttcaacttaacacatagttttaatttttttaccttttgaattaatcttgtgcaggatctaaagtactttacagcccataacttaaaaatgagtttccccctagaattttttttttttttttttgaggtggagtctcactctgtagtccacgctggagtgcagtggcacaatctctgctcactgcaacctccgccacctcagttcaagtgattctcctgcttcagcctctcgagtagctgggactatgggtgcatgccatcacatctggatgatttttttgtatttttagtagagacagggtttcactatgttggctaggctggtcttgaactcctgacctcaagtgatctgcccacctcggcctcccaaagagctgggattacaggcatgagtcatcacacctggccttacctagcttaaaaagaaagcatatatgctattttgaccatcaacctgaaatgtttcctttgttaaatttttcctatctatgcttgttacgcttcacaaaactgtggaaattatatattagacaatgtcctaagggttttcaaaactgatgtgaagccacattaggaagatatataaataaatgtagttgcccatccagaattggcatgtgccagatatataataacattaaattgctagtttcattccttgttagtcttcattttcaccttcttgtggcatattggtctctctttagagatacagctttcctttatccatttgaaagctaatttgaacataattcatacaaattaggggttttaattcatgcatttttggaaggtcaaagcaaattatctgaagttactacttttttccttttaacaattatttattcacgtaagattttttccaaatagttatcaggtccctgcttgtatgttaggtattctgcaaggtgctgagaatacaatgatgagcaaaaccaacctttattcctgcccatatgaagcttatacttccaggggacagggagattagtcagatggtcgtataaataaatgtaaaagtactatactgtgagaaatgtggaaattcagaataactttgcacctgagtttttgagatttgttttgtttggtcttttgtttgactctttgctcgctaaagggattcttagagttagaaattcaggcaacttgaagacttgaatataagtatagatcaagttaatcgctggcattattataccaccataataaaatagagaagaaaccccagctaaactgtagcatatttaaaagaaactagtattttgttttgttttgttttttgctacacaagttgccagtatgacagttgtggtaacagtactatattaattgatagcagttatcatttcacttttgtaataatttgagacatttaagaaaagattttgctgcactgaattacctttatctctcattttgcttcttacatgcttaaagatgatttgcatgaataaagtgttttcattttgaatatatttaatttttttcttcttttttttcataaaaccaaaacttctaatgttttagagacatgtcatctttaataatgctgtgcaactacatgattgagtttccttaaggaaaaaaaaatttaatgctctaattaagtattaaaagcacagtttttctaatttatatattttacaaatgattacagtaacaagctgggtgccctggctcacacctgaaatcctaacactttgggaggccaaggtgggtggattgcttgagtctcactcaagagtttgagaccagcctggcaaacatggcaaaaccccgtctctacaaaaaatacaaaaattatctgggtatgatggctcatccctgtaatccgagctacttgggagactgaggcaggaagatcacttgagcctgggagattggggctacggtgagctgtgattatgccactgcactccagcctgggtgacagaacaagaccccgtctcaaagaaataaataaataaataaagattacaaaaacaaaacaattaaagaattttaaaatgcagcaaaaagaacatatagccagaccaaaacaatgtgaatgcaatacagcctatctcacaagagggatccagaaactctctgttaagttcatgaatcatggctgtcagcattattatcgcaaatagatatgttatatagtcaataacaagattgatagcactttaaaatagatttagatctcataaaaaactttattttttatattttttctaaatttgctaacaccaatgcaatactgtataattaataaaagcaactccctataacttctcttttcagtcttcaaaataatcctgtgaaataagtgataccattttccccattttactgatgtggaaatcagctcagagaggttaattaatttaaacataatcatgcagctgctaaataatacctatatttgatcccaggttcttcagattctcaattccaggtcacattatccctttaaagtccttttgacatgattcttaaaatgaaactccaaaccactaaacaataaattgtttcacaagattttcatgaattttacgtgtatcatcttcttaacttttatgctttgagcattttgggagtaggaagactctgtctcaaaaggcagcaaaaaaagagaatgaactgtggtgttaggtagacattgatctgaatccctgatcaaccaatcattagcagtatgatcatgaacaaacgatttaacctctctaaagcatcagttttatcacccttaaaatttgaatttggatagagaatacaaaaggaagagcagtttggtgagaaagattagatggattggcccaggctccattttcctttctggttgagatatgtttcatatacttataaccaggtaatttattaagcaaatgaatttgaaattatcataattccaccatccaaatagaacctagtatttgatatatgtctttttactttttttttccctgtgcccttcatcactgcagttcagtcctatgatctcagtagccaattaaaatctacctcctccaaccctgcactttaccatttccttcagtctcttatctcacagttgctacatactacataattacatctgagtgacttactgccatattatacaattgttttaaaacaggccaggtgcagtggctcacacctgtaatcccatcaatttaggagtccacagtgggaagatcacttgagccaagagttcaagactagatgggcaacatagtgagacatcatctcttcagaaaataaaaaagaattagccaggtgtggtaacacacacttggtcccagctaccctggaggctgaggcaggaggatcacttaagcccaagaggtcaaggctgcagtgagccatgatcatgccactgcactccagcctgggctacagagctgagaccctgtctctgaaagaagaaaaaaaccctactccacaataagtgtatctatcgaacttctattttcttttagtgctttctgaactctaacttattttttgttgttgtaattaaccagttgtcccctccatatttattgaataattcttatttggcctcttatttgaaattctacctttactaatattaaattaatatatacatctgtctatttctgaactttttaaatttttattgctgcatactatttttatatattcatgaagtacatgttatattttaatatatgcgtagtatgtgtagtgatcaaagctgggtatttagcatatccactaccttgatcgtttattgtttctttgtgttgggaacatttcaaattttctgttccagttactttgaaatatataatatattgttgtgaaatatacaatataaccagcctgctgtgctatgaaatgctagaacttattccttctgtctaactgtatgtttgttctcagtaccttagttctcttcatcccttcccccacacacacacatccttctcagcctctggtagctgtcattctatacgttacctctaagagatcaacttttttaggttccacatgtaagtaagaacatgtgatattgtctttctgtgcctggctgatttcactttacagaatgatctgtttctatccatgttgctacaaatgacaagatttcattcttttttttacagccaaatagtattcctatatatattacattttctgtacccattcatgtgttgaaggacacttaggttgattccatatctttgctattatgcatagtgctgcaataaacatgaggattcaggtattgcattgatatactgatttcctttggattaatggaattgctaaattgtatgatagttctatttttagatttttgaaaaatctctgtactattttccatagtagctgtactaacttacatttttaccaacagtgtataagaattcccttttctccacatcccctccagcacttggtgttttttgcctttttgataatagccattccacctgggtacgatgatatctcactgtggttttgatttgcatttccctgatgattaatggtgttgagcattttttcatgtacctgttggccattgtaaatctggttttgagaaatgtgtacacatatcctttacccattttaattagattgtttatttttggctactgaattattggagttccttgtatattctgcatattagtcccttcttggatgaatagtttgcaaatatttttttctcccattcaacaggttgtctctttactcttttgaatgtctcctttgctctgcaaaagcttttaatttaatatagcccaatgtgcctatttttgtttttgttgcttgtacttttcaggacttagccataaaatcttttttgtttgtttattaggttttttttttttttgagttggagtttcgctcttgttgcccaggctagagtgcaacggtacaatctcggctcgctgcaccctccacctcccaggttcaagtgattcttctgcctcagcctcctgagtagctgggattacaggtgcccacaaccacacccagctaatttttgtatttttagtaaagacagagtttcaccatgttggtcaggctggtctcgaactcctgacctgcctcagcctcccaaagtgctgggattacaggcgtgagccaccatgccccacccataaaatctttgactagaccaatgttctagagcatttcccgtatgttttcttctagtattgttatggtttggggccttatttttaagtacttaattcattttgagtgatttggggatatggtgagagagagggatctagtttcagtcttctgcatatggatatccagtttttccgcaccatgtattgaagagagtgtcctttccccactgtatgttcttgatgcctttgtcaaaaatcacttaggtgtaatatgtggatttatttatgggttctctattctgttccatgggtctctgtgtctgtttttataccactaccatgctgttttagttactatagctttatagtatattttgaagtcaggtagtgtgatgcctccagcattgctctttttgctctggattcctttggctattcaggctcttttgtggttccatacaaattttaggatttttttttctatttctgtgaagactatcattggtattttgataggaattgcattgaatctgtaaatttatttgcatagttgatcattttaatatatttatttttctgattcatgaccatgaccatgggatgtctttccatttgtttctgtcctttttaatttctttcatcagtgttttgtagtttttcttgtagaggtctttcaccttcttggtcaaatttattcctaggtattttatttatttttttgtagctattataaatggaattatattactgatttctttcttagcttgatcattattggtgtatcgaaatgtcactgattttttatgttcattttgtattctgcacctttacttatttttttatgagttctaagaatattctggtggagtctatatgtaagattatgtcatctgaaaggaggggcattgtatttagatgccttgcatttagatgccttgtatttctttctcttccctgattaatctggctaggacttccattactatgttgaataggagtggtgaaagtggacatccttgtcttggtccaattcttagaggaaaggctttcaacttttcctcattcagtatgttagctgtgagtttgtcatatatgacctttattatgttgagtaatgcctcttctatgcctaatttgttgagagtttttgtcaggaggggatgttggcttttatctaatgcttttttctgcatctattgagatgatcatatgatttttgttgttcattctactaaagtgatgtatcgtgttaattgatttgcatatattgacccatccttgcatccctgggataaatcccacttgatcatgttgtattatatatttgttgtgttgttggatttttgttagctagtgttttgttaaaaatttttgtgtctgtatttctcagagatgttggtctgtagtgttctttttttgttgtgtgcttgtctggttttgtatcagagtactgctggcctcgtagaataagttaggaagaattctctcttctttaattttttggaatagtttgagatgaattgatgctagttcttctttataaggttgatagaattgagcagtaaagccatgcagccctgggcttttctttaatgtttgatgggaatctttttattacatattcaatctgttccccattattggtctgttcagattttctgtttctatctggttcagtctttgtaggttgtatgtgtccaagaatttatctatttcctctaggttttccagttagttagcatatagttgttcatgatagtctccagtgatctcctgtatttctgtggtgtcagttgtaaaatatttttcttttctgattttgttaacttggatcttctctctttttttcttggttagtctagctagcagtttatcaattttggttatttttttaaaaaaaaaacctttcatttttatgatcctttgtatgttttttctctatttcatttagttgtgctctgatttttattatttctttccttctactaattttgtttggtttgttcttgcttttctagttccttgaggtacgttattaggttatttgaaatctttatactttttggtgtttattgctataaacctccccttagcactgcttttcttatattccataggttttggtatattgtgttttcatttttctttgctttaagattgtttttatttctttcttaatttcttcattagcccaatagtcattcgggagcatattgtttcatttccatctatttgtacagtttccaaagtgcttcttgttactgatttctagtttttcccatcaggatctgagaaaatcttgatatgatttcaagtttttaaaatttgttgagacttgttttgtggcctaatataaatggtctatcctggagaatgttccatgtgcttattagaagaatgtgtattctgcaactattggataaaatgttgtgtaaatgtctcctaggtacattttgtctacagtgcagtttatgtccaatttttttggttgattctctctctcaataatctgtacaatgctgagaatggagtgttgaagtcctgaactattattgtattggagtctgtctctctctttagatctaataatatttgctttctatatctgtgtgctctagtattggatgcatatatatccgttatatccttttgctgaattcatccctttatcattatattatgaccttctttgtctcattttactgttttgacttaaagtttcctttatctgatataaatttagatactcctgcttgtttttgttttccatttgtatgaaatctttttctgtctcttcactttcagtctatctgtgtgtttacaggtgaagtgaggttttttgtaagcagcatatagttagatcatgttatgtttatatattcagacagtccatatcttttaagtagatatctgatttatttacatttaaagttattattgataggtgaggacttattcctatcatttaaaaattgttttctggttgctttgtatatccttcattcctttctttctctctaattgtttatcattatagtttggtggttttctgtaatggtaatatttgagtcctttctctttctcatttatgtgtctgccctaccagtgacttttatactttcttgttttcatgatggtaaatatcattgtttcacttccagatgtaggactaccttaagcatttcctgtagggctgctgtaatagtggtaattccctcagtttttgcttatctgggaaagactttttttctccttcatttttgaagaaaggtttcttggttagtctagtagtttatcgttggtggcagggtttgtttttttccttttagcactgtgaatatatcatccaattctctcctggcctgcagggtctcccctgagaaatccacgttagtctgatggaggttcccttatatgtgacttgatgcttttctcttgctgtttttagatgtctgtcttgtctttgacttttgacagtttcagtaaagtgtgtcttggaaaagacctttttggattgtatctatttgatgtttgagcttcctgtatctggatttctaaatctcttaaaagaactaggaagttttcaactattattaaattaaatgagtttttctatgtcattacccatcactttaccttctggaaaaccccaaatttgaatatttcgttgctttaaggtgtcccctatgtcatgtatgctttgttcattaatttttattttttattcttttttggtgggtctgtctgaattatttcagaagacctgtcctcaattcttctccctgatatagtctattgacaaagctctcagttgtatttttcatttcattcattgaattcttcagttctgggatggatctgtttggttgtttttttttgtttttttgttttttttgaaatggtgtctcgctctgtcgcccaggcaagagtgcagtggcgtgatctcaactcactgcaagctccacctcctgggttcacgccattctcctgcctcagcctcctgagtagctgggacgacaggcacccgccaccatgccccggctaattttttgtatttttagtagagacagggtttcaccatgttagccaggatggtctcgatctcctgacctcatgatccacccaccttggcctcccaaagtgctgggattacaagcgtgagccaccatgcccggcctgtttggttcttttttatgctatctctctgttgaatttctcactcatatcctgaattgttttcctgatgtctttgtattgtttgtctgtgttctcttatatctcactgagcttctttaatatcattagtttgaattctttttcagacatttcatcattttttgtttaattggaatctgttggtggagaattatgttcttttggaggtgtcatgtttctttgctttttcatgtttcttgtatacttacattgacatctccacatctggtgtaacagtcatttcctccagtttttaggattggcttttgtagggtaagacttttttctgtggatgtattatcatgttggtttgttgggcagtttagcttttattctgggtgcatgcagtagtgtagtctctatgatttcttcagctgtaattagcctcagtgggtgtctgcgatttcctcagtggcttaggccgcattattggtgtagcctgtggtgaggctttgctggggacagggacaccaggcatcctgatcctcaggccccagtggtggtagcagcaggccaagcatacctgcccctggtggccatacactggcatcaattttagcaggtctgcaagggccaattcttaggcctctatgtggcttgctcaggtaccagcagtggcagtggtaggctgagcatatggatgagaccttagtctcctgtgcagcatgtgtggcataagcgattgtaatagtgatggcaggccaaccctcaggctcccaggcagtacacactgctgctagtgatggtagcaacagattgggcaagccagaccctaaaccctcaggtggcatatgtgggtaagcgccagcagtggtagtggtggcagactgggcaggcccagcctcaggccagtagtgggtggggcagggcaatccccaggccctcagatggcatgcttgagcattggggttgcagtgccaggcagtgcaggcatttactcaggcccctcaatggtgcacgtgggcacaggctgtgttggaccaagtgaggcaatccccagaccctcaaacaatgtgtttgagtgcaggcagtcagtggtttgggtctgttgttagaccccctgatggtgcagtgcatgccagaagcagcaagcagggtggatggatccccaagcctccagacagtgcactcaatcactgtgggaggtgccaccaggcagggaaggcctgtccccaggctcctctgttgtacctgtgggtgcaggctgtggtgaacagggcagtctttgggccactggacagcatattttgatgccagtggctgatagcctgagtctttcgtcatgcttcttgatcatatgtatgtgtacccagagtgatagacagaggggggcactccccaggcctcccaggtggtgtgctagggcactaggaggggtggcacttaaagggacaggcctgtcctcaggcccctattggtgcacacagatacagactctggtaggcagggaaggactattcctaggcccctggataaaatacttgagaggtggtaggcagagtgagtctgtcctcatgcccccaaatagcatccagttgggccagttcccaggtccactgaaggtgctgcaagtacctggcagtcctgttgtgggggctgggcattgctatcagtggcagtggccccaggcaggaggccctcagactctggggagtgtatgctttggcttccggccccagaaacagccttccctagtgtgctgccctgcttgttctttggagtataagacactgtgtgggctcgagtgctggggacccagccgcaccattgggtccagccagcactgtaccactggaacccctttgatagacatggggcactgtcagttgggctccaggtgtatagagatgcatactctctaatggtagttggcttctcaaaatggcactgtgcttcagcttcttgggtcctgggggtgggtgtgggacctggaacaaactccctctctggaacaatgctattgtgtgaactccaggcaggtccctatacttgtctcagaattcacgagggttgtggggatcttacatggctaggattgcaagagtctgtggtggaaatgtggaccactggggatctctcagttaccctttccccatactggagaacctcttgtggctgccagctggtcccagctaggccagctgcttcacttccttttgcttatctgcctcagatgttccctgtcacttccctgctaaatttcagtgttctctcttagaggctttattcaacatgtgattatctactcactgttttggtccttctttgtggaggagagttctgagtcagccatcttgaagccctgacctttattttttaggagttctttttgtctgttcttgtactgtatatgtcactgctttatgtagctttaaaatattttaatattagatgggtccagtttcttcacccttgtttaccctttccaaatgttctgttctcttgccccatatgcattattttagagtcaagttaggtaatttatatttcctagaaaatcatccttatctcctgtatgttttctcttccttttttgattagacttgccaatggtttgtgggttttttgtttttttttttggtctctctaaagatttattgaatttggggattaacagtaaagttgcatattaggagagaacctgaatcttgagaatttaccattatgaacatgttgcttctgcatttactcaaatatctttcgtcattcagtaaagttttagagaaccccccttcctccatataggaaggaatttatgtcttaaaattattgcttaaatttatattttggttgctattattaatgtgtttgctttcccgttatagtaggatatgggcaaaacatcatttttatgtttatattataattgaccatgttactaaattctgttattgatttccacatttttcagtgattcctttggatttttattgacaatcataggagattggcatatcattttgtctgttccttttcagtatttacatctcatttccatttttgttttagtacatatattagaatgtctaaaacaatattttaatgcagtagggcccttgagctttcttgtcttgttcctgctttgaatggaagtgcccaagaatatactttcagggatcatttctataatttgttgcctttcatgttttaccaccaaatataaagttggccatttggctgagataggtattctttatgaggttaacaaaacattgttgatttctaatacactgtattttatcttttttgacatgttagtgtgatgaattatatgagggagacatcctcactttcctggaatgaataccattaatcatggggtattaacattttaatatttgcctgaaatctatttgccaaaattttatttagggtttttacttctgtagtcataagttttattagtctacagtttctgtttttttgaagttgggattatatgggattcataaaatgagtttagaaagtttccaggcttttattctgcagaaaatttaggaacatagagtcatcttatatctattccttataaattttaacagactaattcttgggtattggtctcttcaagtttttactttttgactcaatttaagaaatttatatttccaataaaatcatccatttccctttctaattatcattgcttatattatctttattgttgtatttattgttaattaatgctatttcgaggtatattctttagattgccttgaggcttgtcaactttattagtatgctaaagatttatggtgtatttgaatcttttcatatttatatttagaaataaaatcttctgccaaatagcagtcatttacttatctattcctattatgtgtttaatttttaataattattcctaaaaggggatagaacaggaaggccactactcatttaaagtgtatgtgcttttcagagggcttgacttatcccaggtagtaaacaggtaacctaccaacaagtggcacactgtaacatacagattgtagtaatggacaaattgattgacagccaaatcttgaattatcaatgaaacagatgtaaggatccatggacaatttacaaataaaaatagcagagtactttaaccatttgttttaatatcttctcaagtattataactatgcacagcagtgcaaaaatcatagtaaatatgaatagttttaattgtcttctttattctctgatgcatctccaaatgatcaaggaaaaaaaaaggcagaagaaagaagtagcctgaacaactcaaactgtacaatcattttctacacatgattgccccaataggtttgttattctaaattgctggctggctagacgtgaagcaactgtctgcttagctcattcttctgggtagtgcaaaacagcagtccccaaagcagggcgtgcaaggcaaccagctctcaaacaaaaagataatattagaagtcccattcctacttatttttaccttattctttttcaataccttatttgtgtgtgtatcttataatagtatagtcatacatctaaataaattgtaagtaaataactatatatatgttgattatgtgtactagaaaatgttttaatgaaagggatataaattaaaaacccttggagagctctgggccagaagtggagaatcatgaatatgaaacctgctttagccgcttatcagtcatgtgaatttggtcaatcgactcttttataatctgtaaaatgggagtaagaacaccagtccttccttcctcacagtgttgtactgagaacagaataaagcaactgtaattgtttgtaaattctataaaggctgtgcagattatgattttttttttttagcttttaaaatcttttcctcaaatgtattcagtacccacatttaatctttatagaagaccatattcgaagtagtgggaagacattttacttttaggatcaaaggagaaaaatgtttaaggtttaacaattctctaattctaaaagagttatatttctttccaaactctcagaaagttttgatggccagatattttaaacaaaataaacttgggaattaaaaaaggaaagcaattaaaagtaagtctgagatttagctgtaacttgaggagaaaagaatttttacaagagggataggaaaagataaggtcttaaaaacaaggaactaaaaattaagactgaagttttgtaaccttaggagccaggattttgatgccaacagttaattatcccagaaatttctttttttttttattattatactttacgttttagggtacatgtgcacaatgtgcaggttagttacatatgtatacatgtgccatgctggtgcgctgcacccactaactcgtcatctagcattaggtatatctcccaatgctatccctcccccctccccccaccccgtaacagtccccagagtatgatgttccccttcctgtgtccatgtgttctcattgttcagttcccacctatgagtgagaatatgcagtgtttggttttttgttcttgcgatagtttactgagaatgatgatttccaatttcatccatgtccctacgaaggacatgaactcatcattttttatggctgcatagtattccatggtgtatatgtgccacattttcttaattcagtctatctttgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttatttcctgactttttaatgtttgccattctaactggtgtgagatgatatctcattgtggttttgatttgcatttctctgatggccagtgatggtgagcattttttcatgtgttttttggctgcataaatgtcttcttttgagaagtgtctgttcatgtcctttgcccactttttgatggggttgtttatttttttcttgtaaatttgtttgagttcattgtagattctggatattagccctttgtcagatgagtaggttgcaagaattttctcccattttgtaggttgcctgttcactctgatggtagtttcttttgatgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaacccatcttgaattgatttttgtataaggtgtaaggaagggatccagtttcagctttccacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaacatgctgtgttggttactgtagccatgtagtatagtttgaagtcaggtagtgagatgcctccagctttgttcttttggcttaggattgatttggcgatgcgggctcttttttggttccatatgaactttaaagtagtttttccaattctgtgaagaaagtcattggtagcttgatggggatggcattgaatctataaattaccttgggcagtatggccattttcatgatactgattcttcctacccatgagcatggaatgttcttccatttgtttgtatcttcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcctgtgatttttgtacattgattttgtatcctgagactttgctgaagttgcttatcagcttaaggagattttgggctgagacaatggggttttctagatatacaatcatgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcgtgttgaattttgtcaaaggccttttctgcatctattgagataatcatgtggttttttctttggttctgtttatatgctggattacatttattgatttccatatattgaaccagccttgcatcccagggatgaagcccacttgatcatggtggataagcttttggatgtgctgctggatttggtttgccagtattttattgaggatttttgcatcaatgttcatcaaggatattggactaaaattctcttttttggttgtgtctctgcctggctttggtatcaggatgatgctggcctcataaaatgagttagggaggattccctctttttctattgattggaatagtttcagaaggaatggtaccaattcatccttgtacctctggtagaattcggctgtgaatccatctggtcctggactctttttggttggtaagctattgattattgccacaatttcagatcctgttattggtctattcagagattcaacttcttcctggtttagtcttcagagagtgtatgtgtcgaggaatttatccatttcttctagattttctagtttatttgcgtagaggtgtttgtagtattctctgatggtagtttgtatttctgtgggattggtggtgatatcccctttatcattttttattgcgtctatttgattcttctctcttttttctttattagtcttgctagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgccataaatttccctccacacactgctttgaatgtgtcccagagattctggtatgttgtgtgtttgctctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaactctgtggtcaatattggaataggtgtggtgtggtgctgaaaaaaatgtatattctgttgatttggggtagagagttctgtagatgtctattaggtccacttggtgcagagctgagttcaattccttgttgactttctgtctcattgatctgtctaatgttgacagtggggtgttaaagtctcccattattaatgtgtgggagtctaagtctttttgtaggtcactcaggacttgctttatgaatctgggtgctcctgtattgggtgcatatatatttaggatagttagctcttcttgttgaattgatccctttaccattatgtaatggccttttttgactcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcatactgatgggtcttgactctttatccaatttgccaagtctgtgtcttttaattggagaatttagtccatttacatttaaagttaatattgttatgtgtgaatttgatcctgtcattatgatgttagcttgttattttgctcgttagttgatgcagtttcttcatagtctcgatggtctttacattttggcatgattttgcagcaactggtaccggttgttcctttccatgtttagcacttccttcaggagctcttttagggcaggcctggtggtgacaaagtctctcaacatttgcttgtctgtaaagtattttatttctccttcacttatgaagcttagtttggctggatatgagattctgggttgaaaattctcttctttaagaatgttgaatattggcacccactctcttctggcttgtagagtttctgccgagagatccgctgttagtctgatgggcttccctttgagggtaacctgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcgtttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccgtccagctttgttccgttgctggtgaggaactgcgttcctttggaggaggagaggcgctctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtacctggccctatgaggtgtcagtgttcccctgctggggggtgcctcccagttaggctgctcaggggtcaggggtcagggacccacttgaggaagcagtctgcccgttctcagatctccagctgtgtgctgggagaaccactgctctcttcaaagctgtcagacagggacatttaagtctgcagaggttactgctgtctttttgtttgtctgtgccctgcccccagaggtggagcttacagaggcaggcaggcctccttgagctgtggtgggctccacccagttcgagcttcccagctgctttgtttacctaagcaagcctgggcaatggcgggcgcccctcccccagcctcactgccaccttgcagtttgatctcagactgctgtgctagcaatcagcgagactccgtgggcgtaggtccctccaagccaggtgcaggatataatctcctggtgcgccgttttttaagcccgtgggaaaagcgcagtattcgggtgggagtgacctgattttccaggtgccgtctgtcacccctttctttgactaggaaagggaactccctgaccccttgcgcttcctgagtgaggcaatgccttgccctgcttcggctcgcacacggtgcgtgcacccactgacctgcgcccactgtctggcactccctagtgagatgaacctggtacctcagatggaaatgcagaaatcacccgtcttctgtgtccctcacgctgggagctgtagaccgtacctgttcctattcggccatcttggcttctcctcttatcccagaaatttcttaagtattttgttgacctgcatacttccttgaatcaaaatgttgaggttaatagctaacctactgcttgctgcttcttctagcactattatattttaggaacctaatggcatctaaggatttcaccgtgtaataacagtgggaatttatttttcttggtgtttggaaactctcaggaatttttttttcctttttcttatttttctctccctctcaattataggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagac

SEQ ID NO: 36241 - DNA, 160435 bp, Homo sapiens; identical to SEQ ID NO: 36240

SEQ ID NO: 36242 - DNA, 44297 bp, Homo sapiens
gttgaagaagtacgagaagaccaactggatagtaatttccagatgcaatcagaaaatttctgttcttatatcttcacccatgcaaagaccaagaccctgagagagggaatccttgtcactggaaaccgtgagtctatttccctatatgggtgtttactgaggcctactgtatctcaaaaactagtaaactaagcttatgagcacgaacaactggtaaggagataacatctgtgttatgaggtgtgggataagtgaaggattttttctcagtgagggtataaaagctgtattgtgaatttacacaaaacagaaagtaagtagcatgtcatgagtttctgcaagcctattgagattttgagatacaaaattcagcgtaatcttataaacaaagctggcttcatgaacatgttacctgtgcagtcttttagtgctctgtatagaaaagagcttctcacagggtttgatgttctggcactgtcttaagtgtttttataaaagcacctgcatttacattcagaattatgatccacaaatgatataatttactttgctgaataaacgcttttaaatttttacttaagcagaaaagtttttttttttcaagaaacccttgctacatattgtttgtgattagtaattaactttgtaatgtgatgagctggagaacaaaatagaaagaataaataggaacaacagtcatgttatcgtaggaaagtgactccataaaaagtagtagtagtaatagtagaattgaaagaaggagaaggagggaaaattcatgttaaatggaattttttctgatttttagaatgctgatacataccactcgtaaaacaatgagtgaaaactttctatctattccctaaatttcctaaatcattcagggctggggatgctggtggagacctacctggatgccatcaacagtggagcgactccttgtctggagaatgcaatggcagttctggcccagtgtgagaactcagcagccgtgcagagggcagccaaccactacagccagcagatggcccagcaagtgagattccccacagacacactccaggagctgctggacgtgcatgcagtttgtgagagggaagccattgcagtcttcatggagtactccttcaaagataaaagccaggaatttcagaagaagcttgtggtaatctttgttatttttttttttcttgattcctgcctttctggaatgatacttatagtccacctttttaatgccatggttcatctccttcttgtagtaaagggagattggattattttatgtgactgaatttaatgggctacagttttttatttttctaaaatatgggaaatttattaattttctatcatgcataagaaattatgattgtagcacatttaacaacacatttatacaacatactaactacatttaataacaatgtattgcattcttgaaaattacttagagaatagtatttagaatgacaaatatttgagttaatatatatgttaattagcttgatttagtaatttcataatccatacaagttaaacagaattcttgtacagattatgttacatttcaaaataacctgatgtaagcattatacatatagaatttttttttattttaaaaaggtaaaataaagaagcacttgcctgactgagtgtggaaaaaatgcctaagctcacagctccgtaagtcagaagttctttttagggcatctgtgtgctccactcagtgtatcacaagctgaaaacaaggtgttgattgagcttacttcttacctgtatgctcaggggaacctctctccatcttcaagtcagcaataatgcatcaaatgtttctcttgtttctaatttctctggcttcctcttctgcctcaaggtaaacaaaaaagctctgctttcaaagagctcatgtaatttggtaattcttaaatactttcttgagtgtactcagtactacttgaatactctccatttctaaagtcaacagatatcatataatgttacctaaacactggagtacactccatcatattaataagcccagggactatggatagtgtggaaacctcggaggggaaatcctgggggatatcttaaatctgccattggcactgttattgaatagccttctttcagtctgtctattaccagtccacaagtgacagaaatcccttagtacatattgagaaaacccagatgcaatcatagcttagaagtgtaagcaaaagataataatgttcccatatcttcacattttaagatcctttttggaagaatttcaaaagagttccaagctctgttcagggtacaatcaagtcattactgggatgtgattatccagaagggttgattttctgtgtgcacattttatccatagcaatctgtgttctctaaggacactactactgccacaactgaattgtcccttgcttgttgtttatagttagatcactgttaatcatacttttgctgaaggaaagatagagttcatgaactttctacaggtcatgcagagaattgaccagaactggaactaaaacaagtcttctgactcttagtctacaccgtaactcagcctgctctgaggccatgagactacttcttccaagaggatcacagttggaccttcccttctaacagcttctttctactgtttttccctacacttttctggcaggacaccatggagaaaaagaaggaagactttgtgctgcagaatgaagaggcatctgccaaatattgtcaggctgagcttaagcggctttcagagctcttgacagaaagtatttcaagaggaactttctttgttccgggggggcacaatatctacttagaagcaaaaaagaagattgaacaggactatacactagtgcccagaaaaggagttaaggtgaggaataaggggagaaggggatggatgacagaggatagtcagagggtcttcgttgcctcttctgaaaatctaagaacacagcaccatttatcgacaaaaattgaagcatggcaataccttgatattttaaatcttaaaatccacaattatttagctactcttactaaaacagaactattttttttcccaaagaggatttagaatcagaagtccggatgaaacaaaccatttcttttatttatcaaataatgtgatagtttttgtgctaagtacagaaatacactatgaaaggaaaaactttgttttcagaatcttacgattttacacaagatggacaaattaatactcattggatatggtgtgattgtggttatcatattggtatacattgataggggtgataatgatggtgatgatgaaatgaatggttcatagacattgagcattcattttgtgtatcagatattattttaggtgattttgttggattatcaatttcattctaataatgtaaattagttactactatcttccacataggcaattgagaaatgtgaatgcatggagaggctaataaatttcctatgacacaatcaccaagtggtggagctgatgggctgatctatgtacttgaacgccactggaaactcaggattttcctttttgaagaaactgtcctgtgttctatgatgactatactaatttactttcctatactaatttcctcccaacggtgtctaagggttcccttttctccacatccttgccaacgcttgttatcttttgactttttgataatcatcattctgtgtgaggtgatatctcattatggtttttcatttgcatttctctgaagattagtgatgcggaacatgctttcacatacttgatggccatttaaatgtcttcttttgagggatgtctgttcaggtcttttgctcatttttttaaaaatcagttttgttgtattttgttttgttgtgttgctattgagttatatgagctcattatatattttggatattaagcacttatcagatatatggtttgcaaatatgttctattctgtatgttgccttttcttttttcctttctttgttttttcattgagtggtaacttagtttgatgtagtcccactagtttcttttagcacttgtttcctgtgctcttggtgtgaaattcaaaaatatcattgccaagaccagtgtcaaggagtatttcctgggttttctcttaggagttttacagtctctggtcttatgttcaaatctttaaccaatttttagttgacatttgtgtgtagtacaagggtccagttttcccaccaccattccaccatttattaaagatactatctttttctcatggtgtactcttgacacatttttttgaaaagtctttgactgtaaatgtgtgggtttgtttcctggctctctattctgttccatgcagttagatgtctctttatgccagcattacactacttgatacctttgtagtagattttgaagtcagatagtatgatgcctttggctctgtttttcttgttttggctatttggggtcttttatggttccatatgaattttataattggttttcttactgctgtgaaaaaacaccattggaattttgatagaaattgtgtaaacctgtagattttttttagatagtatgaacattttaacaatattaatttttccagtcaatgtacatggaatatctctccatttattttatgtcttcttcagttaatttcatcagcattttatgattgacagagtacaaatcttttacctctttggttacatttatttctaagcattttataattttgatgctattataaatgtgattttcttattttttcatatagtttgttcttagtgcatagaaatgtagctgaatttgtatgctaattttgtatcctccaactttgctgaatttattagtttaacagctattggtggacttctggttgtatttccaaaggaactaaagtcactatctcaaagagatattttcactcccatgttcattgcagcataatttgcaatagccaagacatgaaaacaacctgtgtccatccacaaatgagcaagtgaagaaaatgtgatatatatgcatatctatatgtaaatatagatatataaaataaagtattattgaatcctaaaaagaaagaaatcctaccactggcgacaacatgaatgaacctggaggacattatgcttagtgaaatcagccattcttagaaagacaaatactgcatgacgcacctttatgtgaaattatttaaaaagagcgaaagtcagctaggcacagtggctcacacctctaatcccagcactttgggaggctgaggcaggtggatcacaaggtcaggagatcaagtccatcctggccaacatggtgaaaccctgtctctactaaaaatacaaaaattagcctggcatggtggtgcatgcctgtagtcccagctactctggaggctgaggcaggagaattacttgaacctgggaggcagaggttgcagtgaaccgagatcgcaccactgcactccaccttggtgacagagcgagactccgtctcaaaaaaaaaaaaaaaaaaagagtgaaagtcacattaacagagagtagaatgggtggttaccagacagagaggggtaggaggaaaggggaaatagtgatcagtaggtacaaacattcagttataagatgagtaagttctggatgcctagtgtatagcatggtgactatagttaaaacaatgtactttatactagaaatttgctaagagagtaggtcccttgtgttcccaccacacacacacaaaaaaaagataactgcatgaggtgcagatatattagcttgattataataatcatttcacaatgtatacatgtatcaaaatatcatgctgttcctcttaaacataatttttacttatcaatcaacttcaaaaaacttgtaaaacaaaattagaaattagcctatattattaaaaagggaaaaatagcacatactggtgaggttgtagagaaaagggaacgcttatacactgctagtgggattgcaaattgtaaattcctctgtgggaagcagtttggagatttcttaaagaactaaaaatagaattattattattattcaacccagcaatcccattactaggtatacacccaaaggaaaataaaacattctaccaaaaagacacccacactcatatgtttatcacagcactattcacaatagcaaagacacagaatcaacctatgcgcccatcaatagtagactggatttttacaatgtggtgcatatacaccttgagacactatgcagccataaaaagaatgaaatcatgtcgtttgcagaaaaatggatgcatctggaggccattatcctaagtgaattaatgcagaaacggaaaaccaaatactccatgttctcacttgtaagtgggagctaaacaatgaatacacatgtacataaagacgggaacaatatacactggggaatacaagagggaggaggcagggagggaagtagggttgaaaaacgacctttggggttctacattcactatctgggtgactgttttgactgaagcccaaacctcagtatcacgcaatatagtcatgtaacaaacctgcatgcgaaccccattgatcaagttgggctatttgtctccactcaaacctcatattgaattgtaatccccagtgctggaggtggggcctcgtgggaggtgtttggatcatgggggaagatcctttatggcttgctgctgtctgtgtgatagtgagttctctggaggtctggtcatttaaaagtatgtggcacctccactctctctcactctctcttgctcctgcttttgtcatgtgacatgcaagctcctgcttcacattccaccaggagtaaaagcttcctgaagccttaccagaaggcatgtttcctgtaaagcctgcagaactatgagcccattaaacctctttgctttataaattaccccgaacttaaaataaaagttaaataaaaaaaattaaatgtagatcctaactctatacctaaatcattattgctcactcaccctaaaacagtagtgtccaaaaaactattttaaattcagatcagataaaaataaatagctacttgtaatcctccttggaaagatacatatatcaaatctgagtatgattttttacttcataagtcactaccagttaaacagaaaaaagtgcttaattctgaactgcaaggtcctttgcattctcagaacaaagcctagtacaggtcaggtaatttcacttatctgagtttcaatttcctcacaaaatgaaaagaaggtgactgtttaagaaatcaaaattccaagtgttgacaagaatatgaagcaactggaattctcacacattgctaatgaggtataaatcagaacatcaatttggaaaactgtttggttttaattgctaaaattgaaaaacaaataccaaatgacccagcaaatccattcctagatatatacattcacttaaaagactgggacagaaatggtcacaacagtatcattcacaatagcaccaaactgaaattttaccctaatgtccatcaacaatagaacaagtaaactagtgtattcacataatggcgtactatatcacaatgaaagtgaataagctacaatcacacaataagaaaaaaaattacccagtctcaggtatttgtagcaatgcaagaatgtcctaatacacccatgaatctaaattttttttgaaagaagggaacaaggaaaataaccgtcaaaaaatgcctaggtccttccttctgtgatgtgccccacacacccaaatttcagtcactaatcacttattggctgaggtatttatgcctctttttccttcccatgtgtgactgttaagtctatgcagtgttgtattttccttgattggtaatttcccattttggacagccatgttactcccttaaagtttcaaattcttaaagtttctcaggccaggtacagtggctcacacctataatcccaacgctttggaaggccaaggtaggaggattgcttaagaccaggagattgaaaccatcctgagcaacatgacaggacttccatctctacaaaagtaaaaaataaaattagccagctgcggtggcacacatctgtagtcctggctatgcaggaggctgaggcagcagcattcagcccgggagttcaaggttgaagtgataataccattgaacttgtgcttgggtgacagagtgagactgtctcaaaagagaaaaaaaagtttctcaactgttcaattttccattatattcaccactactcctaaatagactaaacagttacctgttcggtctttttaaggttttaactttttaaattaaatttgaatacattgtttacttttaatgaactattatcaacattcttaacagtgatcaaaagtaaataaataaataaataattagcctagaaaagcttccagtgaggtaagagctattaggtaaagtatcaatagatgttatcctaatttgaaaagggtaggcaggccttcaggcaaaagaaaaaagaaagcaaataatgcaaactatggaggatgtgtgtttgtagaactgcatagaaatctggttgtctgcaccgggggtgggtggtgagcagcatccctgggagaagaggctggacaggcaggagggaggctgctacacagggttttcatgtctcaacaaagagcttggactttttattgtggctgtggaaggaaagaaaccactgtggaatcttaagaataatgtgaagtttacaaggttagatttgtggctttgttgaacaataatttcctcatcacaagacaagatttctgctgcctgacaggtctttgctccttcttggttcttcaggcagacgaggtcctccagagcttcctgcagtcacaggtggttatagaggaatccatcctgcagtcagacaaagccctcactgctggagagaaggccatagcaggtacaggggcagggctcagctctcaggcaaatgggtaggttcttgcaacactctcttgatgttcagaaaaaaggattttccttataccaggagctttcttctcatagggaacacatgctctgctaaaactgaaaataacaaggggagttgggattgaacatccagccacttagtttcttcccacaacattcttaaacatgctcttgctgacatggctagtgacagaattcagagattctcaattccccaccttggtgcttttttcaaagtcattttggcctctgaactcaggagagtagaactcagacaagactgttactttctttttttttttttctttccaacttttattttaggtccagagggtacacaaataggtttgttacatgggtaaattgtgtcatgggaatttgttgtacagattatttcatcacccagataatgagcatagtacccaataggtagtttttcaatctttaccctcttcccatcctccaccctcaagtaggtcctggtgtctattggtccctttgtgtccatgtgtactcaatatttagttcccactcataagtaagaacatgtgatatttggttttctagtcctgcattaattcccttagaatattgacctccagctgcatccacagtgctgcaaagaacattatttcattcattttatggctgtgtagtattctaaggcatatatgtacaacattttcattatccagtccaccactgatgaacatttaggttgattccatgtctttggtattggaaatagtgcaccgatgaacatgcacattcatgtgtctttatggtagaatgatttattttcctttgggtatataagcagtaatgggattggtgggtcaaatgatagttctgttttaagttctttgagaactctccaaactgctttccacagtggctgaactaatttacaagcccaccagcagtgtttaagaattcccttttcttggcaaccttgccagcatctgttatttttttactttttagtaacagccattctgactggtatgagatgatatctcatgtgctttctacctgcatttttcttttttttttcagttttttttattattattattatactttaagttttagggtgcatgtgcacaatgtgcaggtttgttacatatgtatacatgtgccatgttggtgttctgcacccattaactcatcatttagcattaggtatatctcctaatgctatccctcccccctccccccaccccacaacagtccccggagtgtgatgttcctgttcctgtgtccatgtgttcttattgttcaattcccacctatgagtgagaacatgtggtgtttggtttttgtccttgcgatagtttgctgagaatgatggtttccagtttcatccatgtccctataaaggacatgactcttcattttttatggctgcatagtattccatggtgtatatgtgccacatcttctcaatccagtctatcgttgttggacatttgggttggttccaagtctttgctattgtgaatagtgccgcaataaacatatgtgtccatgtgtctttatagcagcatgatttataatcctttgggtatatacccagtaatgggatggctgggtcaaatggtatttctagttctagatctctgaggaatcgccacactgacttccacaatggttgaactagtttacagtcccaccaacagggtaaaagtgttcctatttctccacatcctctccagcatctgttgtttcctgactttttaatgatcgccattctaactggtgtgagatggtatctcattgtggttttgatttgcatttctctgatggccagtgatgatgagcattttttcacgtgttgtttggctgcataaatgtcttcttttgagaagtgtctgttcatatccttcacccactttttgatggggttgtttttttcttgtgaatttgtttgagttcattgtagattctggatattagccctttgtcagatgagtaggttgcaaaaattttctcccattttgtaggttgcctgttcactctgatggtagtttcttttgctgtgcagaagctctttagtttaattaaatcccatttgtcaattttggcttttgttgccattgcttttggtgttttagacatgaagtccttgcccatgcctatgtcctgaatgatattgcctaggttttcttctagggtttttatggttttaggtctaacatctaagtctttaatccatcttgaattcatttttgtataaggtgtaaggaagggatccagtttcagctttctacatatggccagccagttttcccagcaccatttatgaaatagggaatcctttccccattgcttgtttttgtcaggtttgtcaaagatcagatggttgtagatatgtggcattatttctgagggctctgttctgttccattgatctatatctctgttttggtgttgagcattttttcatatgcttgctggccatgtgtatgtcttcttggataaatgtctgttaatgtccattgcccattttttaatggggttgtttgctttgttcttaatttctttaacttccttatagattctggatattagacttttttcagatgcatagtttgcagatattttctcccattctgtaggttgtctgtttactctgtttatagtttcctttgttgtgcatgaactctttagttgaattaggtccctcttgttaactttttgttcggttgcagtggcttttgaagttttcatcaggaaatctttgccagtgcctatgtccagaatggtatttcctaggttttcttttggtggttttatagttttaaattttacatttacatctttaactcatcttgagttgatttttgtatatagtgagaagaaggggtccagtttcaatcttctgcatatagctagccagttaacccagcaccatttattgaataatgcattctttctccattgctttttttgttagctttaccaaagatcagatagttgtaggtgtgtggtattatttctgctttctttaaacttttccatttgttcatgtgtctgttttgttttgttttgttttttgaccagcaccatgctattttggttattgtagtcttgtaatatagtttaaactcaagtcatgtgatgtctctggctttgttctttttgcttaggagtgccttggctactcggggtttttttgttgttgttgttccatgtggatgttagaatagtttttactaattctatttttaaaaagtcatcgataatttgataggaatagcattgaatatgtaaatcaatttgggcagtatggctattttaacaacattgattcttcctatccatatgcatgaaataattttccatttgtttgtgcagtctcagatttctttcagcagtgttttataattctcattgtagagatgcttcacctccctgattggctgtaaacctaggtattttattcttggttattcacaatagctattgtgaataggattgtgttctcggtttgactttcagcttggacattattggtgtgtagaaatgctacttatttttgtacatttacttttttatcctgaaactttgctgatgtttatcagatggatgagactttgggcagaaattatggagttttctaactacagaattctattgtctatgaagagagagagtttgacttcctctcttcctattggataactttttttttcccctttgcctgatttctctggctaggacttccagtactatgttgaataagagttgttgagagtgggcatccttgtctgtttttggttctcaagtgaaatgtttccagctttttcacattcagtatgatgttggctgtgggtttttcatagatggcttttattattttgaggtatgttcctttgaggcccagtttgttgagatattttaacatgaaatattgaattttatcaaaagccttttctgtgcccattgagaagatcatctggtttttgttctgagtcccgtttgtgtgaggaatcaatttattattagcatatgctgaatcaaccttgcattccaggaataaagcctaattgacagtggtgggttcgctttttaatgtgctgctggatttggtttgctagtattttgttgaagattttttcatccatgttcatcaggaatattgtcctgcatttttctttttttgttgtgtctctgccaggtttttaaaatcagaatgatgctggcctcatagaatgtattaggaaagattccctgctccccattttttttggaatagtttagtagaattggtaccagctcttctttctatgtatggcagaactgactatgactctgtctggtctagggctttttctgcttggtaggctttttaatgctgacccaattttggaacttgttattagtctgttccaggtttcaatttcttcctggttcacttttggtaggttgtatgtttccaggaatttatccatttcttctaggtttcttagttagtgtgcatagtggtgttcataatagtctctcaggattttttgtatttctgtggagttgatagcaatgtcccttttgccatttttttattgtgtttatttggatcttctctttttttgttcttttttagtctaactagaagtatatccatcttatgtatttttccagagaaccattggtttcattgatcttttgtatggtttttcttgtctccactttattcacttcaagtctgattttggttatttcttgtctcagctagctttgtgcttggttcacttttgtttttctagttcctcaaggtgtaatgttagattgttaatttgagatatttctaactttctactgtagtcgtttagtgctattaacattcctcttaacactgctctagttgtgtctcaaagattctggtaggttgtatctttgttttcattaatttcaaataatttatttctgccttaaattcactgtttaccccaaaatcattcagaagcagattaattaattttcatgtaattgtatagctttgagagatattctttgtattgatttctatttttacagcattgtggtctgacagcattggtatgatttgggttttttttttatttgttgagaattgctttatggcagagcaaggagtcaattttagagtatgtgccatgtgcagatgagatgaatgtatattctgttattgttgggtggagtgttctgtagatgtctgttaggtccatctggtcaaatgtcaagttaggtcctgaatatcttcgttagttttttgcctcaatgatctgtctaatattgtcagtggagtgttgaagactccaactattattgtgtggttatctaagtctcttcataggtctctttgaacttgttttatgaatctagggtcctctagtattgggtgcatacatatttagtataattaagtcttctcgttgaattgaaacttttatcattatgtaatgcccatctttatcctttttgatcattattggtttggagtctgttttgtctgaaataagaatagcaacccctgctctttttgttttccatttgcttgatagatttttcttcatccctttactttgagcctattggtgtaattgcatatgagattggtctcttgaacatcgaagacagttgggtcttatttctttatgcaacttgccactctgtgccttttaattggggttgttagcccttttacagtcaaagttaatattgatatgtgtggatttgatccacacttgattgtgttattgctctgtagtgtcaatgatccatgtactgaagtgtgcttttgtagtggctgataatggtctttcattttcatgtttaatgctcttttcagcagcttgagtaaggcaggtctggtggtaacaaattcccttagcatttgcttgtctaaaaaggattttttttttcttatgaaccttagtttggctggatatgaaattcttccttggaatttcttttctttacaaatgctgaatataggtccccagtctcttctggcttgtagggtttcttctgaaagttccactgttagcttgatgggattccctttgtagaagacctgccccttttctcaagctgcctttaatattttttcttttgcactgaccttggaaaatctgatgaccatttcatgtgttggggatggtcatcttgtataggatctcacagggcttctctgatttcccgaatttgaatgtcaacctctctagtgaggttggggaaattttcatgggcattatcctcaaatatgttttccaaattgcttgctatctctccctttcacgggtgccaatgagtcataggtttggtctctttatgtaatctcatatttctctgagattttgttcattcttttttattcttttttctttatttttgtttgactaagttgatttgaaaaatgggtttttgagctctgagattatttcctcatcttggtctattctacatttaatactctgattgtattatgaaattcttgtagcatgtttttcagctctatcaaatcagtttggctcttttttaaaatggctatttcatcttttagttcttgagtcattttactgaattccttcagttccttggactgtatctcaactgtctcctaaatatcgataatcttcattgccatccagattctgaattccatatctactatttcagccatttcagtttgattaggaactattgctgaggagctagtggactcatttggaggtaagagacactctggttttttgagttgccagagttctgtccctgtttctttctcatctgtgtgggctgatattcctttagtctttgaagtgtctgtttctttcatggggtttttggcttttattttgttttattctcttgaagattcaactggtataagttgggttcatctgactgggttttttttttttttttctggatgatttcaaggggccaaggctcagatcagcactcctgagctgggggcttgaaccttagtaggctgggaccaggcccatggctttgttctctggcccctctaggttaagcacctgctgtgctgcaggggccaacttgctactggttaactggcaacaacacaccgatgaggagtgctggcaaaagtactttctcagagcagtggcagtggggtccaaggtcattggtgagcagcagcagcagggcagtagtgctgcaggttctgtgcatgtgcattggtggtggcaggttgacagggtctgcacaggtatgtgtaccagcaaagcggtggtgagaggctgcaagcgagtgtgtgccagcaaaacagtggggagagggtgcattgagtgcacactggtgtgagcccatctgctgaagctctatgatggttaggtagggtatgtcagcaaagaagatatggtgatggctgctgggaagtgcttcagttaggcatctgacattgcactttaagtggatgcagccaggcagggaccatgagagaggctagcagactgggaggtgctcagaccatactggatctgtcccacaggcaagatagcccagttctatccaggaccaatagtcgacaaaagccaaggccatgtatctgggcatggcaagccttgggggatgggagttcctggttgtgctccactgcagccattcctgtgccaaatatctaggctccacactggccagagtcctgtccctaccaagtctccaagcagctctctttgccagctcaaacatctatgggagttgtggggtctcctaaagctaggatttcagaggtccatggcaagagtgggccacttcgcaccaatttacctcaccccttccccaggagctgctcaggattaggaatgagtcttggtgcttggcaacctgtgcaaggttcccagcttcctctcccttcagccttgggtctgcatccttccttcatcaactctcaatgccttccttctgaagtcctgcttggagtttatcagtcttctttacggtctggtctctcagtgggagaagctcttcctgactccatctacttagccatgatggttcttctcccacctgactgttattttcttccctctgtaaaacctcggtggaacagctaagcaggctaagaaggaggcagctgaaaaggaacaggagctgctaagacaaaaacagaaggaacagcagcaaatgatggaggctcaagagagaagtttccaggaaaacatagctcaactcaagaagaagatggagagggaaagggaaaactatatgagagaactgagaaagatgttgagtcacaagatgaaggtgagtctggatgaagcttggcagtgcttgaggcacaatgccagttcctcatttagggaagagccaaaattttaagctcagtcaagatttcagaaggaaacacaaaagatatatttcacttaaatttcaaatacatatgaattctactgaagcctgtaagtttacaagacttcagcactttctgtcatgttagactttggagagtacacatgacatcccccagggtgctgggctgctgtttgtggtgattataggatggtctcactgtgccccaattaattaggaccttagtccaccagcccttaggattcttggcacaaccatcaaaaggacccaaaatacatccatctggatgaaagtatcagatttggcttgatatgaaatgatactgaatgatctcaaattgctccatttgtttctgtatctgcctgactcatcctatacaactagagtaaaacatattccttgtcccaaactggagcttgacaaccagtgttttatacagggtcagcagtccccattatttgctagatgagcatggccttgctatatcggtggaaaggggaatcaattagaattaaatctgcattccctctcaaagggcattcattgtgctggaacaaaattcctccccacctccagtgagatggtgctgaggaaatgtcacaaaggtgtatatcatggatactccccttatttaggtccagtcatctggaaatgtcagaccaactcatcaaagattttctaagatgttagagaaatggacacatgtttaactaatgaaattgttaaatacaaacctcggtctcttaaaaattggggattttcaaaagtaggctcttttacttttataggtcctagaagaactgcttactgaaggatttaaagagatatttgagtcgttaaatgaagagattaatcgactgaaagaacaaattgaagcagctgaaaatgaagagccctcagtgttttcacagattcttgatgtggctggcagtatatttattgcagcactacctggggctgctaagctagttgatttaggaatgaaaattcttagctcattatgtaataggctgagaaatcctggtaagaaaattataagctgaggtttcttttgttaaaatggtataacgctgttgctcattttaaaagtatatgtgttattgcagtttcatttaagaaaagtttaaaattaaaaagcaaatttcaaagaatattatggcctgaagttcataaaaacaaacttaattttgactaaagtaataattaatagaaatggggaacaagttagaagataaaattattcctagaaaagatttaagtaaagcaaaaggacaaatggtaatataaagaaattattttcaattaatgttatagtcacagagataatttaagttataattagctcttgcaaatcagtgagaagagagtaacgccacatattttaaacaggcaaaaatatgataataaaaatgtttaattttactgacaataaaagttgtgcaaagaaaaactatgaggttcttgcttcaatttatcatgggcttgaaagaacagtttgacagggcactgagctggcaagggtttgaggatattgtcagtgtctcatatttgctagtgagagtgtgaactgttggaatcatatatgaaatatttaagtgcacatacctttgatctagcatttccacatttagaaatctatcatatagattgatttactcaaattgaaaatggtatatataaaatagtacttatgttgcagcattgttgtaatgccaaaagactgaaaaaaacattaaagcccctctttcaggtactgataagggaaatcttgggaaacactcataaaggaatactctacagccactaaaatgaagggagaagctctatttgaactaacaatgacaagtctccaagatgtatcataagtaaaaaaaaaaaatgatgcacgaagcatgtataattactaccactgaatttagaaaataataaatgtatgcatatattattatctccttctggaaaaatagaaaattatctagtatacatggtcacagcaggaatgaacctgaatagttgaggtgagaaattagaaaataactcatttcacatcatatattcttctgtgcctttttttaataaaaattgattacattaatgttatatttattatctttgttgagtgctttaggttaacaaatacagatttcctttagttcttactataaccttgaaaggcaaatgttattatctatggataataaaaggaagatagtgagattaatctatttgcccaagatcatccgttaggttgccaagttatgacctcaacttgtgtttcataactccaaatccactacatagactctattatcaaggactggaataatcagtcttaaagtgggttgtcagacatatcaaaagcaaaacaaagataagattgtcaagatgaacacaaatataatatacttagttgaaaaaaaggatacattaaaggattttaaactacttagaaagtcttactttcttgtattccatatagggagctccatttagttataaagaattgctgccacagcatggatttgatctttgatctgatttgttcaagattttgggaggccaagcagtgattgcaaattcttatgaaaatctcttgttctttcctcttccaaggcattatgaagccagaaggaagctcctctgatgtgtgcactccagaagtctttcactcttttgtcaatatggttttgtcacactctcttgagtctttctatgcatttgtcctcttcgcgcaggcagcattaaccagggtgacctcagcaccatagtaaattacattctattgtagcacctctaccagcaccgcaagcacatagcctccacctccatccagcctctcagggagccgaaagcagtttctatatactaatccaccaaaaaaaaaatcatacttcgtgatcttctgtgtctttaatattttatacgaacttattattgatatgtatttaaacatggacaaaaattattactaaaattaaaaaggaaataataatgaatggatgggagagttcccatgataggaagaaagtgattaataccactagaaatagcataagtcagctcaacaggaaaagcttgctcatcagaacaaggaactaaaaagggcacaagacatgcatcctaatttcgtttttattgtgacctttcaataaagatttcaaagtttattccaaagtatactttcagatacaaagtcccctgggatgttgcttggaatggtctctaaatgctgtcccatatttataagacgatgaagtagaaggaaattttttttttcaactcaacattttaggaatttgttttggctttctagttctcagtacttgaatgaactcgaatgaactccttataagtccataagctgggcatattctcttgactgagggcctttgcaaaaggggcaaagatttcttaaaaccctgcttcctcacactatatctgttatttctcagcccccgctcatccttaaagtgtcctacttcctaaatttccaaggctggatgagatgcccttcccagttttgccatggcaccatcttgtcactcctaccattgaagatgttatataattgtaacattgaaaatgcctatttacacccgtctaccacctttgatctcaggagctaggtcttcttcatcaacttaggtttagttccaagcacaaaacccaccacataagctcaggtgtgagctaagtacataagctaccctccagtatggccccaatttaccataacctcactgtattcccaatttctagagctctcaaaataaaggacacaagtttagaaactagtgcagaagggagtcactgaattagaaagaacatgcacacttgtctgaatttaccctgttctctctgagggactggacaccacatggcccctgtgttcatcaagtttctcacctatgataatcaccctggaatgaagttactgcctttggctcacagggcaattacaatgtttagcatagtgaaggaagggccagaaacttagaaaaaagggctcttttagctaataaacaagtattcatctttacccttaaactatacataattcacaaagattcagttgtccctggagctattttatggttccccgatataaacgatagattttattgttgagaagaaaaaaagcagctgatttcctagaattgcttctattttgaaataaccctgctctactttcactttcattgtcaccagtattcacacacacacacacacacacacgatcttactctcttctctcactgtttatttttttctctttcttttagagacagcgtggaacacagatataacgtgatattaattaaattgatttttcaagttagaatctcacataatgacttgctagtttgaagttgctcaatggttttagttaaacattacttaatctctttctctttttcctccttggacaaagggaataacaaacaccccatattttgaagcagtattgtgttgtttaaataatatatgtaaataatctggcctagaaagtaactgataaataagaaacgttattgttgttcactcaccaaacacagaggtattttagtcaagttgttgataatgacaggtgacagcgtgctggcagtcctcagagccctcgcttgctcttggcacctcctctgcctgggctcccactttggcggcatttgaggagcccttcagcccaccactgcactgtgggagcccctttctaggctggccaaggccagagccggctccctcagcttgcagggaggtgtggagggagaggcgccagcgggaaccgcggctgcgtgcggcgcttgcgggccagctggagttccgggtgggcgggcgtgggcttggcggcccagcactcggagcagccggccagccctgttggccctgggcaatgagggacttagcacccgggccagtggctgcggagagtgtactgggtcccccagcagtgccagcccaccggcgctgcgctctatttctcaccgagccttagctgcgttcccgcagggcagggctccggacctgcagcccgccatgcctgagcctcccacccactccatgggctcctgtgcggccccagcctccccgacaagcaccaccccctgctccatggcgcccagtcccatggaccacccaagggctgaggaatgcgagcgcacggcaggggactggcaggtagctccacctgcagcccctgtgcgggatccactaggtgaagccagttgggcttctgagtctagtggggacctggagagtctttatgtctagctcagggattgtaaatacaccaatcagcaccctgtgtttagctcaaggtttgtgagtgcaccaatggacactgtgtatctagctgctctggtggggccttggagaacctttatgtctagctcagggattgtaaacacaccaatcggcactctgtatctagctcagggattgtaaatacaccaatcggcactctgtatgtagctcaaggtttgtaaacacaccaatcagcaccctgtgtttagctcaaggtttgtgaatgcaccaatcgacactgtgtatctagctgctctggtggggccttggagaacctgtgtgtccaaactctgtatctaactaatgtgatggggaggtggagaacctttgtatcaagctcagggattgtaaacgcaccaatcagtgccctgacaaaacaggccactgggctctaccaatcagcaggatgtgggtggggctagataagagaataaaagcaggctgctggagccagcattggcaacccgctcgggtccctttccgcagtgtgggtgctttgttcttttgctctttgcaataaatcttgctactgctcactctgggtccacgctgcttttatgagctgtaacactcaccacgaagatctgcagtttcactcctgagcccagccagaccacgagcccactgggaggaacaaacaactccagatgcgcggccttaagagctgtaacactcaccgcgaaggtctgcagcttcactcctgagccagcaatactaccaacccaccaaaaggaagaaactccaaacacatccaaacatcagaagggacagaatccagacgcgccaccttaagagctgtaacactcaccgctagggtccgcggcttcattcttgaagtcagtgagaccgagaacccaccaattccggacacaataatatgggttttagaggaagacttgggttcaaaccttacttggtagctttgtaatattaacaagttgttaaatttcttggtaacattgtggtgaaattactgtagaatgcaagggggaagggtgcagtgattcaaacctgtaatcccagcactttgggaggacaaggcagaacaatcgcctgagaccaggagttggagaccagcctcacaacatagtaagacttcatatctcacacatacgcgcgcacacacacacacacacacacgctggtatgatgcctcatttgtagtcccacctattcagaaggctgaggcaaaaggataacttaagcccagaagtttgaggttagagtgaactatgattgtcattgcactccagcttggacaacagagcaagaacttgtctctaaaaaataaacaaatacaaaataagaatacaatggtatgatttatataaagaagttatcactgtgtctgtatcaagtgtgccataaatgagagttaccttcatcattatttattatttattaaatgttaagtgtcaggacctgggttaggtgctgataattcaaaagtatataagacatagatattccctcagggcacttaacagtgctcaagctaatattcaaggtaattggacctaagaaaatattatatgaggctttctcatccacatgcttctcaaactggcccacaaacatgagataaatagcactattttaaatgacccaatgaaggggtttttaaaacttaatatagcaagcagtctctaagatcttttccaatgataaagtggaaagttcctggttgagaaatcatgacaaaccctcttaccagcacagctgtcaacaattccttttatggtgaatgagtcactgctttagttgatactttgtttcatattagtgcatttctttgcagaggttacctctttttcttgtctctcgtcaggtctctgacattgacagagcctggacgttggaggaagccccaggacgttggaggggtaaagtaaaagtccacagttaccgtgagagaaaaaagagggagaaagcagtgcagccaaactcggaagaaaagagaggaggaaaaggactcgactttcacattggaacaaccttctttccagtgctaaaggatctctgatctgggtaagactggggcaggggtgggaaaatatttaccagggttcatcagttttatctaaattgaccattcccacaacaggccgcagctgagcctgctgtgggacacaagtccacatactatcctggccctatcaagtggctgcaggttccttagtgctctctgctcctgctgtgaactagtctccagcatagagagatgggaatgtttctaaattgttatttctttcttgacactatcttaaattaactttatcattattagtatctgcttaataaagttagggctccatcacattcattattgccacttgtagagctctaggtaaatgaaggtaggcaacttgggatctgcaaagagagggaacacgttattataattagggagcttatacagtctttgtgcagctacttttctgagtcagtcattgattgattcccattttaaggtggtttacatcatgctataaaatgaaacagaagtcttgccagaagtgtctgtgagccattgttgtaagagaaaatgggtcctgaccacagaaaaatagtttttttgccattgtcccctgaagggatgggaaacagataattagatataagccttcatcagagcaagtcagaagtaatcgactccatattataaacaaagcactctttattatagaagaaggaaagctgtaatgcttacagtctatgattgtttgttaaagaagttataaatgttatatcatgatcattttaagttacagggattgagacattcaaggcaaaaacacaaattaagatgttactacaggaaggcttcttgctcattttaaatttacaaaattatcaaattatcaaggcctggttaaacaggatatgcctacaattgtgtatatactgctctccatgaagcagaagtcagaaaaaaacaagccctggttcatcagagaatgtttcctgatgctggcttcattacctgaaataactgaaagcaatatgcaaactgatatacatgcaggtgataaagaatcagtcttaaaacacagagaggttaaaatctggtaacataattgagtaaaaaatcagcagattttctacatgtcagatttgagataccaagcttgagtgaataacaggtgaatgctgattcacagcaaatattaagaacaagtgatgtcctgtggtagctcaaagggcttcctgcatagtgataggaagaagccactgggtaacctgagtcccacagtctgaccagaccctgtccgtagaggggcttggaagaaatcaggaccaaggctgggttagaatggtatctatgtttcaaagtatggagatatgtatgacacaagattccccaggtaaaagttcctattactgtgtacatgagcttagtgagctcagctttgctcagtccaaatatctaaacgtgaatgtgaaaagtttccaaagaaaattttgtaattaagtcagaaaatgtgacatatctagaaaaaaaatccattttctgaacagtgagatacaagatgatctggtgggaattcaacctgatacatccttctggagaggaacttggcaatatccaacaaaataaaatgctcttaccttttgacctggcaatctcacttataggatgctatcctaaagttactcctatagcaatataaaaataaacactcacaaggttagcagaggttttcattgcagcattgtttgtaattgctaaatattagaaacaatctaaaagtctatacataaaagaacggttgaataaactgtgctatgtccacataaatggagtagatgcctgtcaaaagaattgagaaatcttcctacgaactgatagggaaagactcccatatttctaagtgatgtgatctttttgttggaaaatgtgaataagaaaatatacatgtatatgctcattaatgaaaaaaagtccaagaaaggtaaactagaaactaacaagattggatatctatggaggataagtgggcatgaagtggaaagaatagaaagacagatggaatgggaatgcagtgccaagatgaagggaaagtgacacttctctgactacagcttgttgtaaagctctgactttcagaactctgatatttcgcatactcaaaaataaatgcatacttaaaatcaaccaacaaatgaacctaactatattacaaataaataatttaactacaccaaagagaatggagaaggaaatagtagtctaagcaactttggaatacagtgttttgactgtatgtgtaagaccaaagacaagaacttttaactaatagtgcactctagttagcaaatttatctttcaaacacttatgagttagtaactttaaaacaaattatatgtactagaattgagcaaataactaaatttattatgtataatgacacactcagagaaaagattttaaaaacaaggggaaaacatgaataagttttgttttgttgaattggaattagaaatatcagaagaaacttaagcttatatatagaaacagatagacgagaaataaatgtagatgtgtgtattcatgtgctggtatataaacatagatttcttaactttccacctgagagggcctagaagtaatgactacacctagtgtgataatcttgttgtctatctaccattatccaatgaaagcaaccagagcccttgggagaaatggtcgattctaaggctgaagcagaaaaaatattagataagcctggcatatattgtaatgtcagaaggaaagacgcactgaaaatatgatggaagcacgtccatagtacctgggctacagcttgaaggagctctcagtgaactaatctgggacgagttgagcaatgagataaatagtgatagtaaagtgttacccatatgataaatctacactgatctactatagatctacactgatacaactaaatgattaaataagtaaataaaataaatagaggagaaagggcagttcttgctcacattagaactctaataaatgtagaaggaatgaaaatagaaaattacttttagtcaaacatcacagtaagttataagcaagaattatcaacagatgctaaaaatagtgactgaaaaaattatggaagtatgatgaatctttatttgcatagtcttcaaactgtctcttcaaatggtactttttagtgacaaaatggtacataacactttgtggtagagaaacctggcagagaacaccttaaccaagtgatcaaagttaaggtcacagcaccagaaaaagtcatgtcaacatcatgaatcccttaatacaagacactgaaaatggcagaacatcactttggtgacatttgcaaaaaaaaatgtataacttcaatctaataataaggaaacatcaaaaaacccaaattgagggatattctacaaaatcatagccagtcaacttctaaaatgtcaaagacatgaaagacaaggaaagaataaggaactatcaaagatgcaaggaaaatacagaaacataatgactaaatgcaatgaggaatcctggattgggtcatggagcagaaggacattagtgggaaactggtgaaatgtgaataaggagtgtaaattagttatcactctaccaatgttaaaatccttgttctatggttatggaaaattttaactttaggggaaatgatatatgggaactttccatacccattgtacatcttttctgtaagtgtatttcaaaataaagttatttttaaagaaagccagtgacccaatttgtaagacagccttaaagagaaaccaggctttaaaaaacgtatatgaaaaaatgttcaagcatagaaaacaaaaatttaacccatattgtaaagttcagcatagctaactacctaaaaactgctttccatttcatctttttccttgcacacaagggaacaacaccctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggtgagtgacaccagcaaagctctaagccccttctgtccgtacacacggcgaacatccagcttagggatgtgagcatagaaagagatgagaatgaatgttgaaagctaactttcagtccattaatgggctctttacattgactttggaggattacagtcaactgactcttcccactttacttttattttatactaagggtataaatgtgcctttctggaaggaacacaatgttaataaagaaaattaacttctataataatgacttataaaacatttattaaaatgttcatgtagtgacagcaagctttcaatgaactttaagaaaaatatgaatgtttcagtgtgtattaaatatctaattttcctgtttccaggattgtaattaagatttatgccagttgtattttcttttatctcttttaacttcaattatgttaacttttatctcaatttccagaaacacctactaagtaatttcttttcccttttatcctctccttctacaggcttctctctaggctccacagtgaagtctcacaccaagggaatctggatgtggtgtgtgcctcatcccaagaagccagaacacaccctagttctgctcgacactgagggcctgggagatatagagaaggtaaaaaaaataagtattttaaaaatttcacttaggtagattaaaatctacataaaccaggtcagatcgataaccatctttgcacaatcactcctactccttgatttagggctctagttaattatattaatatattatttcttaaaatttgtgtggtataagcattcagagtacacaataagttcaattgattaattatgggtaaacctatgaaataatggctaatgatgttttcagttatttctctttcatattatagtaaaatgttttggtgaggctgctgaaggtgcttataaacttcagtagacgttttacaaacatgtctgactttttacagtgggatcccacaaaggtagtaaaaatgttcacatccacaccagcaccagtagaaagagaagcaaagtgtaaaatctaatgataacatctttgctcattaaggataatatattactactgttataaatcttagacatagaaagcttttattaaaggagcttattttaactactgtgtaaaaaatatcttactatgatgtgccatggaaatggaatagggtcataaactaagtttagggtaccagtttgaattttagtagctgatcaaaatagcttctcctaccaagtgctcatgtgtttcctgctgacatatatttatatataacaccttaaattatacatcataaatattataaatttgttctacaggtagaaaaaaatactgcataaggaagtgagttacctaagttttcagaactaatgagagacagagttggagttcagtcagtcttcagctatctgaattgattgtacattctgctagtcattcttctttgtggcttctacaatgacttacagggtgacaatgagaatgactcctggatctttgccttggccatcctcctgagcagcaccttcgtgtacaatagcatgggaaccatcaaccagcaggccatggaccaacttcagtatccttttttgtggtccagaacagcagtaaacctagaaaataacagcttcattttttcaccaagtacagaggcagacagacaggtactgaagaattcataagtcctctctttaataaatctcattatgctgaacatctcattctatctcaatctccatctgaacttcaagtcttcccagttacatgtctcgttagatactcagccacccaagactctgtatatcctctatctgacttaatctcctatgcctgtccaaaccttcaatgtcctctagaactcatgttctcacttctgcaactctctatattcttatcatctgctctaagtgttgccttctaaatgatacctagctatacactatagatactatttctcctacagacctctccagtggtcttatgtgatgactatttttaatcccataccttgcatatcataagtgtaagagatgagttaggtatcctccttgctccatattagagttctggacactttctcattcctttaccattaaaaagagaatcttctttaatatatatgccctcagactacaccactatttttgttgcaattatctagcaacgttccaataaatacatccttcattcattaaagattttagttcctagtgtctttttagagactagcaaccaatagacaattatttaacaccctggtgtctcagttccatcaccttattggaactctccacccttattgtcattctccactctcacacattacttaacctagttcattatcaatgacctcaccatttccattagcttagtttcaagcattatactgaattagatttcatcaagatcacccccatattcctatatgtaatgcacagttctcacctcatttgatcttccaatcttccataagccttttatttctctaggagcattacataaatttgatcccttccacctttctgaaatgcctgtttcacttggaattggttcctattagaataccacatttcctaattttccaccttccttattggtagactttttcagattactctatcctctttctccttttagcctctaaatattataacacttaagttcttgtgcctcttttctttttctgctttcagtccccagatgatcacatccagcttcaaggctttcagtagcaccaatatgtttatcaccatcaaatctgtattcccaagcatgagcaaattcaaacttttgtatccagcttctggtgcaacatctccattcagatgtgtaagagacatcttgagcctaaagtgtacagaacaaaacttaattttcctgtccaaaacaactccttcccagtctttctaatcacaataaattcccacatcattcatagaagtgctcagatcaaaaacttaggaatcatcttggatgattccattccttatgttttggaaattattaatcatcaaactccttcagctccactatcaaagttatttctctagactagccaattctcactacttgctccattgcctctcatcttggttatcttttcaactacctaattgctttttgtattagttttgtttgtttgtttgttttggcatacacacttgactcacagatgcaatgccagccagtatgatttaaaaaacaaaaaacgatactatatcctctcttcacttaatacccaccaatgacttcccattaactttctattaaatttcaaacttcttactttggtttacagagcttgcatatcccaacctctatttattttaaggcttctgccctaccacactggatttcttgatatatgttgtacacactcagtaatttcctatctaagggccttgaagggtctgtgatctctgtctgcaatgttcctccattggatttgtacatgactggtttcttcaattcattcagatcactgctcaactacaatgtcagagataatttacctggaaaactacatgaaccagcaccacatgcagatacacacaattattctctgctttccttattggtagatttgggagacaccagagtattagatgaatgtctattggttgctagtttctaaaaatacattaggagctagttgcccagttcgttttccttcaagacaattgttatcaatacctgataatttatttttgtttacctgttcattgtttgtctccatcattagaatgtaagctctatagtggtagcattgtctcattcattacagcgttcttagtccctagggcagtgcttggttcatagtaggtgctcaataaatgtttgtgagtgaatgaattctgtaaataaatgtttgtgaatgaatgaatgagctaataaaaagaaaccaaattattttaggtaagcattaggataaaatgtagtataaagagtggcattttctgtagttttcttaatttagcatctcagctatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggttactgggtctgatgcttggttgggtaataaatagagagcaaataatatcaaaataaccatttctgtgcagtgctaaaaattataatttttaactgtatttttctgactgttctgctagaggaaatggaaacattgcttgactatatcagttggaaccaattttaaattgcattacctacctcttcttggagactttcctttctctacccctttaattttttatttcttcttcctaataaatttcctccttacatgggctttgtgaaaattataaaattgaaagatcatatttgaagtaattaatttgaagttttactacttctaattttcattcctgtaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattccagtcaatgggcctcgtgagtcactctctctacccacttcctacctggactttctccttctgcccattgtagaggataaaatggaaagcataagggtcacttctgacaaatgcatagtctattgatggcaaggaaaatacaacatgaaaatcatattataaattttacatgaaaactaaagctatagtatcatctcatattccttgcaaggagaataaaaaaagaaaagaactagaattgaattctattatggtaaacttctccaccaacttctcagctccctctttatcaaataaacatccaggatatatatactgagcaacaaagaaaaaagcaaatactatatgtaagtgagactttgccactaactaactgcagtacaattctcttgttcagcaattctaaaatatttagggaatgcctataatgtaatgtaccaaccactgagtataatgatggataaaagaaatgtgacttttatcctcattccagcataataggagcaaaagatacttctgtaaaaagtaaaaaaaaaaaaaagtataatgataaatagtggttaacacaatgcataaaaataataggctgctatgaaagagtaaagggagaggcagggagatataatttagagtgtgagagaatgcttgtctgtgaaagtcacctgtaagatgagaacttaaaaatgattgagttggctgggcacggtggctaatgcctataatcccagaactttggggggctgaggtgggtgaatcactttgagctcaggagtttgagaccagcctgggcaacatggggaaacccttcctctactaaaaacacaaaaattaatcaggcatggtggctaacacctgtaatcccagctactcagctggctgagtctgaaggatcacttgagcctgggaggcagaggttgcagtgagcggagactgcaccaccgcactccagcctgggagacagagtgagaccctgtctccaatatatatatatattaaataaatggttaagagctaaccaaagcatatagaggaatagctttatagcaaataatgtaatgtggaaatgcatagggcaggatagaactttgcaacttcaagaaaatagaacacaggaggctaatgcctgtaatcccagcattttgggaggccaaggtgggagaattccttgagcccaggagtttaagtttaagaccagcctgggaaaagtagcaagacctcatcattatgaaaaaattaaaaatcagccaagtgcagtggtgcttgcccagagtcctagctactcaggaggctgaggcaggaggacccagcatgagcacaggagttcaaggctatggtgagctatgatcatgccctgcacttcagcttgggtgacagaccagaattccatctcaattttttaaacgaaaatagaagaaagacaggcgattggaacaagagaagactgaataagagtggtgtcataattggaggggtataaaggggtcaggtcttgaaaggactggcagaggactttgaggagattagagtttgtctaagctctagagaagatcttgaagaatttttggcagtgaggtaaggttatctaatttatgtttatacatatctttctgaatattttgtagataatttgttggagtagtgaaagggagggaatgagaggatggatgctatttgcagtggttgagccataaatgggcattgggttagtctcagattatgacagtgaaaatggtgaaaatggacaagatccgaacatactttggatattaaatctaaaaggcctgttgatagagggaatatggatttatgaagggaataagaaggaaatgccaagcctgtctccagcgtttcgagtttagcaattgcttgaatggctgtgttatttaatgagatagtagcatcaagaggagaaatagtttttcagagtggatgaagttttgatatttagattatttaatattgagattcttctgatttatgcagtaaggaatataagataggcattaaaaataaggtgcaaaacttatttttaatccaaagcttaaaagaaatgtcaaagcaggaaacaaaatacaccagccatccatacagatggtacttaaaaccgcagagagatgagaaggtccaggattgagtcaaaaagaatcatcttttgttgtgtgatcaaccactccagtttgcctaagatgaggttttcctggcatgtgagactttcagtgctacacccagcaaagccctggcaaactcgatgagttgattatcctatctgtagttctgatgagagaatatctaagaagacatatttacctaagccagacaccagactagtgactagtggtctgcaccactaaaattaataaaaataaaaaggctaagttttctcattgacttttttcataaattagtagtgaagagagaaagggaatagagggagaggtgagagaaaagaaaggtaagaaaacacattgacctagtatctcagccccaaaatatcctaacctattcatttcaatatcttccttttgggtgaaggaaataggaaagagccacttcaatttcctctgtgattagaggttaacaaattattccattactattctttatccaaaacttatttaaaagtattatttgtgacactcacttgaaaagcacacaaaatattctgtcccaccaactgatagtcacatttttttaaaaattcccttttgcaggtctagagagcctggtgctgacctacgtcaatgccatcagcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggtatatttggtgttctacgtcatgagaggcagaaaaatatgggcccttcatgggaaaataattctttctagaccccaaaatagttacactcagttatgtgtacatatttgaaataatcattaaaagactagaatgtgcatagccttagacctttaaaaaaagacacctaattttttactaaaatttgcttttgttagtttttcctctctgggtcccatattttaagaaagtaagtagatggtacaactgcattgttaaagactattttaacttattttgtccttttaaattaaaaaatacattgtttttatgttccctggtaattatcagtggggactaaattatttttaaataaccctaataatttttttaaatgtgagccaatggtaaaatattcagaaggccaagaaagagaaattaattatataaattttattagagaatgtttttaatgtctgcctcattccaagtgaacaaagtatttttgcatgcagaatgaccacttgacaaatgaaagtcctttccctagctaggaaggcaggatcttataaatgatacgttgctacagtcagaggttctggtgaagctagatagccgatgtcagcaattgtcacccttccaacctaaggaggaaagagaaagcttcatagttaagttatcttgagtgatttaatgtagataaatgtgctgttctatgagactttccaaatactgaaaatacctatggcacaatcttcattactttcattagccctatgctgagaaaatacacaaaaatattcttatgttaaagaatgtactaaataatcatgtactccttactgagcacttctaaaaagtccccgggcttaatactttacatcacctcatataaccctgcagagaaatctgtgagataggtattgttcctctgctgcacagacaaggaatcctcagttcacaaagactgagtgtcacaagccacagtgtagtgtatccgggaactccaggcaggctgcctgactccagtgtttgtgctcagaactattcctgaaatgagagacttggaaagataaaagtttcgtatgaaatagtgtatgtgctttgagaatcattctctgaaacaggaaaactgggagaaaggagctttaggaaatcacaaacagagaagtagataaatttctgcaataagcacaacttagggatattctaggatctaacagcaatgtgaggagcatggccctatttagagggccacaatttctgaaggagaagcattttccagtctccacatagttaacatcctcctcatggctttactgaaacatctgtgctgttttgtcacttcacaggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggtaaactacacggtgggtaccatttcttgggactcgctgaggggatgcttttaaagcccactgggaagaaggtaaatggcactgcaactggtgcctagggcctctgcctttcatttttccatttactgattcattcaataagagagcccaccataacaggaattcctcctcagaagcacagatgtagccctcaaaaagaggtttatcgaattgactcatttatttattcatctagtcattcaacaattatttattttgacctaactgtataccaggaacttgtcaagttgctggggatacggcagttaaaaaaaaaagttcaagctctgtcaaagtacacacaggcaattagcaaatgatagcttatgaacaaataataataacagttaacatttatgttgcacttactgtgttccaggaactgggctgagagcgttattcatttaatactcagagcaattctataaaatatgtattactaatatccgaaatttgtaatttttttatttttttacttttgtgggtacatatggtacatagtaggtgtatatacttatggggtacatgagatgttttgatataagtatgaaatgcacaataatcacatcattgaaaatggggtatttgtcgactcaggtatttatcctttgtgttacaaacaatccaattacacttttttagttatcttaaagtgtacaattaaattattattgactatagtcacccttttgtgccatcaagttttatgctctcaagtatgttgtgctatacttgattttattcattctttctagttgtttttacccattaaccatccccacctccctccccccaccaccccattaccccctcagcctctgacaaccatccttctactctctatcttcatgaattcaattgttttgattttcaaatcccacaaataagtgagaacatgcaatggttttctttctgtgcctggcttatttcatttagcatgatgacctcaagttccacgttcttgcaaataacagatcttatttttgtttatcagttctaatagtttttttggtgtggaatctttagatttttccaaatataagatcataccatctgcaataaaggagagtttgtcttcttcatttccaacttggatgccctttatttctttctctttactgattgctctcgctagtatttccaatagtatggcaaataacagtggtaaatgtaggcatatttgttgtattccagatgtcagaggaaagtatttttgttgttcttcccattcagtatgataatagctgtgagtctgtcatacatggattttattatgttggggtatgttccacctatacccagtttttttaatgttttattaatgaagggatattgaattttatcaaatgttttttcagcttgaattgaaatgatcatatggtttttgtccattctgttgatagaatttatcacattgattgatttgcatatgttgagccgtccttgcatcccagggatgaatcccacttggtcatgatgagtgatccttttaatgtattgttgaatttggtttgctagtactttattgaggacttttgcatcaattttcattagagatattgtagagtttttaaaattatttcatttcatataggttttggggggagcaggtggtgtttggttacatgaataagttctttagtggtgatttctgagattttggtgtacactgtacccagtgtgtagtcttttatcccttgccccctctcctttcccacaagtcctcaaagtccactgtatcattcttatgcctttgtggcctcatataatagcttatctccaatttatgtgtgagaacataggatgtttggttttccattcctgagttacttcacttagaataatagtctgcagttccatccaggttgctatggatgccattgtctttttcctttttatggctgagtagtattccatggtgtgtgtgggggggtattatatgttttacatatatatgaaacaattttttatccactcattaattgatgggcatttgggctcattccatatttttacaattgcgaattgtgctgctataaacatgcgtatgcaagtatcttttttgtgtaatgacttattttcctctgggtagatacccagtggtgggattgctggatctaacccacaatcactctttcttcattctacctttctctgtataaccaggccaaagaggtgctgaaaaaatatttggagtccaaggaggatgtggctgatgcacttctacagactgatcagtcactctcagaaaaggaaaaagcgattgaaggtgagaacagctgaaaacactctacatggtcggaaagctctcaaaatgttagttagcaatattggtccacctggaattattattgtagagaaagaatggcaagtatcattcatagttctatgagagttttcttaactaatctgtatgatcattggttttctggttacccaaggcaaaattacaagaagttttctcaatgatgtaaggataagacaaacaaaaacgagggaaaggaaaagggaacacctacaattgaatattcatatctttttctgcttatttttcttccacagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcaggtattcaattgcatcatctcaattttctcttccagtgccccatatcgaaaatgaagtataaggttgagaacctaatgcctcccaaaaaaactttctagcccagacactactacatttttccttccctaactatttttatgccagtcatctctggttagtaaagactgtttacttgcaggatacaatcacatggaattctttattatgctatcactaataaacattgctaggcactgcacaagtattttacattatgtgatcaaattttcctttaatggtagaggaactattagtttctcatttgctaaatgaagtaattataatctcatgagcagtaagtaacttttctgcatcagactacctagagaaatatctagccagtctttcctactgagagggatccatggggattttgtttctgttatgcctgctaagactttatgtctggaagcactgttatgagtagaaagattccctaaccaggccaggtgcagtggctcacacctgtaatcctagcactttgggaggccgacgggggcggatcacctcaggtcgggagttcaagaccagcctgaccaacatggagaaaccccgtctctatcaaaaatacaaaattagctgggcatagtgacgcatgcctgtaatcccagctatgcaggaggctgaggcaggagaatcgcttgaacctgggaggcgggggttgcagtgagccaagatggcgccattgcactccagcctgggcaacaagagtcaaattccatctcaaaaaaaaaaaaagaaagattccctaaccatctacccacttaagcacactggttaagtgcccatggtgccaatactttcttgttctctgggctcttttccacatttacgtttgcccagaaatagcctatgggccactgtaagccctgatctcctcaatttatttctgttacctccgaattttggagacctgtactaaattccctgatcaaacacttgccctagtcttgagttatatagtaacctaccaattggaaatcatctatctttcataccttcctagatatatatttaagagtccattctatatagatcagaaatgaacaacaacaacaaaaagaacaagagaaagttatggtttttccagaaagactgtgttgcatgagtgcaaatggtgaagggaccaaggaataaaacgctgggtcactaatattttagaaactgtagaacaacaacatttttgaagctaaaaaaatcatagaaaaattattggcaggtataggagactcagaagagagtgatagtcaaaaattcttgaaggatcaatataagtaccaaaaggggaactaatctggtggaaatgtgttaagctggataggcttagtctccactttcccttttaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatcatgatgcatgcatttttgttgaaccataaagtttgcaaagtaaaggttaagtatgaggtcaatgttttacctacagagcaattcaactcatgcttatttatagtactaacttttaatatgatctttaactaaatcctatatttgaaatcatacacaaggactcaagagagatattgtgtaactaggatgcattttccaatgagatatcttgcagtttctgttctgggtagatttttttctctcatatgcaccacccttactgtatattcagtcctatactcttattcagggatttaactatggtcgtagcatagggctgaagtgttgtgaatatgatgaaaatgtgatgagaccaaacaaaccatggggcacagtagagcatcactcctgccaagtggtctttgtatggcatgctggctgcaaataaaggagatctgggacacttaactaggcttttaaagtacagacagtgcacagttctcatttgggtggaggctgcatgatctgtgggcactagcagagaaagtggttgcctctgtgcagaatgcatttatgagtagaggctccaccttctctgtccatgtaaaccctctaggtaattactgccccattcccaggccacctagatctctcttctctagtctcccttagtcttttctctttcctgaagtttagaaaataacttctacaatcacagaaaggaaagctttaactcaaactcaaattactttccattcttctgaggaccaggactataatcctataaagcctaaaacttgactgcatttttctctctgctcctctgctatgacattatatcctcaaagctactcagggtaaatgacttactaaaaaaaaaaaaatgacagattgaaaaatcaagaataattcattaatacaaaacattatcctactacaattgtttcaggatgtgtattattcagagttcttcatggcaaataacaatctgctcagcaatttaagtaaaaagtaatttactttttaataccattaggttgcacaccgatgctccagaattgtgagggagccatactctacagctattccaccgaggataatactaccattgtaaaggcatctcacgggaaaacaacacagctaccatgaaccagcaccatgatctctggatgaaatgctggaagcttctgcagtgtcagctatgagtaaatggatgccaccaccttcacattttcagtaaacaaatactcccctaccccatgaaaagttgcatctttgagctgctcacatctccagctaagcctcacaaaagtcaatctgcagggaagaatctaaatcatatgcctacccatgggaaagtctgagaattagagtatttttgtcttctacttttggaggaagaaactaataacgtgggaaattttcctgtatgtttagtcaaccagtttttccatgcagatgtatggagataaatcttatagtaggaataacctaagacttgagttagtatttttgtgtacatcagatacaacactcttctcatcttttttgtcattatttttcaatgttgttttaatctttccactgttgtttcatgtcatgcactttgttaatattctttaagttattcttagtttttaacaatgatacttaagaaagacttaataggactatagaataggtactccctattccccaaccctgggaacacaatttaacatattagttcatttgtatttaagatctatcttgtttatgcctcagtttagttattgctcttacctttcaaacagttagtattttgtatctagttctgtgaaagcaaaaagcaactttattctttcttacaattccccttttacttaatcggaacatttctttcctgtttgttcattagtcactctcagataaatgaatagtctctttttc

SEQ ID NO: 36243 - DNA, 9671 bp, Homo sapiens
ccggacgccgcacggctcctgttccggtgtcagagggcccgccctccccgctcctcagtctttgcggacaagaaaggggctgtgtgagacgcagggaaggaggcacacccgggggtggcgcagtgaggagggggcgcgacggccaggaggctggtggagcgacacccaggcaggagagggggaagaactctctccctttctgaacccccttttccttgagagacgagttgggggagtcctccacgcattacccactcgggccgcaaaaactcccttctttagccctctgcccccgcccttgcttataagcctttgagaccgcagaagggaccttgttgtggaacgggacggccaaggtacgctgcccctttaagttccagacgccccgcgtacttcccctacttcttcttcttgagatagccccgcccatctacccgaagccggagccaattggctccctctggaaaaatctgtgggcagggtaaaggtgagcgggcgcaggcgtagtgaaattctcagagccctttaggccccgcccattccctccgagtcggtgaggaggggaaaagaaggcgcaggcgcaactgccctcccaggaccccagcggaacccacgccctcccctaagtcttaaagggccagaggcagcacttactgcccgggcccttcctcacttttggggggcgggggtgcgcaagcgcagtgggggagctctggggtgggggtagcggtcgagtatcaagttgctttctgtcccggcagaggaagccagatcgctgagggtccggtctccagtttgcctcctgctatatccattggaagagaaaagtttgtgacttgggcccccaagttttgagagaactgggctttcggcgcggggggacagaggaggctcgtggggaggtgagtggacctcctggatcgatttaggaggctcgggtgggactgggaccaatcgcacctttgttgagccgtcactcattatggggagcccctcccaacaaccatagcgaatatttattgagctccacgcttagcagatcccccgataagctatgtacagacataattcgttgtaggtctcatttccacattttgtcgtggaggaaactgaggctcaaaggttaagtcacgtgcccaagttctcacggcctataaattgagggattcgaacccagacagctgaccccagagccccggcttttttttcctttcttttttttttttttttttttttttgagacagagtcttgctctgtcgccccagctacagtgcagtggtgcgatctctgctcaccgcaacctccacctcccgagttcaagcaattctgcctcagcctcccgagtagctgggatcacaggcgcccgccaccgcgcttggctaatttttgtatttttagtacagatggggtttcaccatggtggccagcctggtctcgaactcctgacctcatgatccaccctcctcggcctcccaaagtgctgggattacagccgtgagccactgtgccctgccagagcccaggctcttaaacattgcacattgtaggtgctttggtggtggggaatggtagacctcgaaagcagttggactctggttttcatttccctggctctggtaattaacctggacctcagtttacccaccctcacagtgcaaggctaggtatgcagtcggtgcctactttattataactgttgataattattgtcatctctccccttctgacacctccgccagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacagggtaggatacctcctctgggattagccctctgggattccatgatgatggaatgtcaggcctcacatggaacctgtgtcttgctttcgtttttgttttgttttgttttgttgttttttgagatggagttttgctcttgttgcccatgctggagtgcaatggcgtgatctcagctcactgcaacctctgcctcctgggttcaactgattctcctgtctcagcctcctgagtagctgggattacaggcttccgccactacgcccagctaattttttgggtatttttagtagagacggggtttcaccatgttggccaggctggtcttgaactcctgacctcaggtgatccgcccacctcggcctcccaaagtgctgggattacaggcatgagccactgtgcccggcctgtttttgttttttgatacagggtctcgctctgttactaaggctggagtgcagtgatgcaatcatagttcactgcagcctcaacttcctgggctgaagccatcactcagcctccctaggagctgggactataggcatgcaaccacacctggctaattttttttttttttttgggaggctggtctccacctcctgggctcaagtgatctgcaggcctccacttccgaaagtgctgggattacaggtgtgagccacagtgcccggcccttcacacctgtttttaactctttgagggtagatagctaggagtgaaattactgggtcagatggtcatcctgttttacttactgaggaactgaggatttatttttgattggagtccaagaatatgcctaatttagttccctcccacgacctttgttgctgccactcctgtctggaatgctcttcctacacttcttcctatagctgactcccctcccctccctcccttcccgcctccgttttttttttctttctttctttctttttttgagatggagtctcgctctgtcgcccaggctggagtgcatggagtgcagtggcgcaatcttggctcactgcaagctccacctcccgtgttcacgccattctcctgcttcagcctcccgagtagctgggactacagtccgtttttttttttttttttaaatggaggtttgcttttgttgcccaggctccctcccctcccctcgcctcccctcccctcctttcccctctccccactctcgagacgcctcctggatcccctctcttcttgagacagaatcttgctctgttgtccagggtggagtgcagtggcactatcttgactcactgcaactccctctcctgggttaaggtgattctcctgcctcagcctcccaagtagctggcatgcaccaccacatccagctaatttttgtgtttttagtagagatggagttttgccatgttgcccaggctggtctcgaactcctgacctcaggtgattgcccgcctcggcctcccaaagtgctgggattacaggcgtgagccaccgcgcccagtccctgtagcggatttctttgacttcctaagatctcggtggtgtcaccttggggaggccctcctgttaccaccttgtctaagaaggacttattccttgtgctccgttcttttcatcctcttctacctgcttttaaatttttttttttttttttttttttgagatggagtctcactcttgttgcccaggctggagtgcagtggcgtgatctctctcactgcaacctccacctcctggattcaagcgattctcctgcctcagcctcccgagtagctgggattacaggcatctgccaccatgcatggctaattttgtgtttttagtagaggtggaatttcaccatgttagtcaggctggtctcaaactcctgacctcaggtgatccacccacctcagcctcccaaagtgctgggattacaggcatgagccactgtgcccggccttaagttcttttgaacacttatttcaacttgaagttttttattatttctctatgtctgatgcacctacttgacccccgactccctagagggcaaaaactatgtcttgtttgctcagaacattgccaggcagggaggagaaagatgcaccctgggtattcaagagagtagagtgagtgaatggtggagtcccaggcactgcctttggtagctccaagaccccagggagataccgaaggcagtagcatggtagctcatgcctgtaatcccagcactttgggaggccacggcaggagaattgcttgagcccaggagtttgagaccagcctgggcgacagagcaagactccatctctaccaatatatatatatttttaatttgctgggtatggtggcacctgtagtttcagctgctcaggaggctgaggtgggaggttggcttgagcccaggaggttgaggctgaagtgaactgtgatcacaccaccgcactccagcctggacaacagagcaagactctgtctcaaaaaaaaaaaaaaccccaatagctgggtgtggtggctcatgcctataatcccagcactttgggaggctgaggcaggtggatgatttgaggtcaggagtttgaaattagcctggccaacatagcgaaaccccgtctctacttaaaatacaaaaattagccaggtgtggtggtgggcgcctatgatcccagctactcgggaggctgaggcacaagaatcgcttgaacccaggaggcagaggttgcagtgagccgagatcacgccactgtactccagcctgggggacagacggagactccatctcaaacaacaacagcaacaaaaaaaaacagatgggcttctgtcctgaagcctcagagacatctactgaggggaaactgacgcctgttgtctgtttcccagcaggcagctccctgaagcactccaccactctcaccaaccggcagcgagggaacgaggtgtcagctctgccggccaccctagactgtgagtgggcccacggtccccaacaaggagaggagtaggagggtgggagggcctgtgaggagcaatcgtggacagagggtaaactgaggcacagagaagcaaggggatgagtgaggactctgcctctgtcctgccccagccctgtccatccaccagctcgcagcacagggggagctggaccagctgaaggagcatttgcggaaaggtgcgtgtccacacacatgtgctggcatgtctgcacctggctggtgtgtgcatatgggtgtccatacccactcatgacgtgacctgtgagtgtccacgtgtatgattgtatctaactgtgtgtgtgaccgtgttcatgtatgtccatcaacatacgctccccctcattcccctgtctaaccccagccccccacctcgtccccatttggcagcactggggatagggggcaggggtgcagcctggtggtattgcccgcctcctcctgccaggtgacaacctcgtcaacaagccagacgagcgcggcttcacccccctcatctgggcctccgcctttggagagattgagaccgttcgcttcctgctggagtgggtgcgtcccagcccagctgggcagctggggggttcccgggggccttagggtgggctggggttttggctgtgtctgctggcgccttgtctttgagatgcggctgctggctgggtgcagtggctcatgcctgtaatcccagcactttgggaggccgaggcgggtggatcacttgaggtcaggagttcaagaccagcccggccaacatgggtgaaaccctgtctctactaaaaaaatacaaaaattagccaggcgtcgtggtgggtgcctgtaatcccaggtactctggaggctgaggtgggagaactgtgtgaacctgggaggcggaggtagcagtgagccgagattgcgccactgcactccagcctgggcaacagagcaagactctatctccaaaaaaaaaaaaaaagatgcggctgctgtgggtaccccaggattcctggttatgccccaatccatcctaccactgtcccttcttctccctgcagggtgccgacccccacatcctggcaaaagagcgagagagcgccctgtcgctggccagcacaggcggctacacagacattgtggggctgctgctggagcgtgacgtggacatcaacatctatgattgggtgagggactgcccatccccaggacctctcagcctcctggccttcattcctgcctcaaatgttcacagagtacttgaaaggtgcaggcctgctctaggtgccgagaacacgagacagccccattcccagcctcacagagcagagctccccatgcagggaaggcagacatggaaacaggcagctgagatgcagtgaactgcgctgcgatggcagatgcacaggtggctacaagagccccatgtgggcaagggaaatcagagaggtcttcctggaggaaggtgtctaagcttgagaccccagaaagtgagatgggcccagtgatgagcaggaggaaccacgttcaactggaggccagagagtacaaggcattttgagaatgaggaagaggtaaacctttggtttctcctgcccctacccacgacagaatggagggacgccactgctgtacgctgtgcgcgggaaccacgtgaaatgcgttgaggccttgctgggtgagtgggagtcgggagtggccctgggggccccagcactccagcgggccctgcgggaatcctgagggcagggagacgcccaagtgttgcttgaagagttcttggagcaggtagtccctgcctgctcttctcggaggatggatcagaggggaggaggtggtaggaccacacgggagtcggggtctgggtttaggatctggccaagaggctaagcacctccatcctccatggttcagagacccttcagccacgttcttcagtggagaccaagatagcagaggttggacccttgtcaaaggccacatgggcaacgggcagacccacggctgcattgtggggaatgaggggtgccatgggatctcccaggtccccagaccccattctggactcccaggccccaccctccagcgccctcccctctcctttgcagcccgaggcgctgacctcaccaccgaagccgactctggctacaccccgatggaccttgccgtggccctgggataccggaaaggtcagcctgagacacacagagcaggggtggggtcccttccataggcagggtgaccataaaggggtacatgggacaccccttcagtggtcatacgccggcagcgagagtgtgttgacaggtgttgagcactgctgtgtatcccgcctgggaacatcccagtcctggctcctggggctccacatgtgctggggtagggaggacaatgggtgtcagtggctgtggccatgatgggggacacataggcatgagaggccgaaagaggggcctctcatcaaagagccccaaagtggccaacagaagtcagagaggcttcctggaggaaggtgtcttaaggttgagaccccgagaagtgaggtgggcccagccctgggatggggaggtcagggaaggattctgggggacctgaagggagggagaatggcatccaggtgggaggagtggcccctgcggaggcctggcagtgaggacaccaaggggtaggcgaccaggccatagtgcacagagccacagaggccatccctctccgtggcgggcagtgggtttgaacaggggccataggcagaccccagtttgactccattttctctgtcacaatgggaccccaacttccccatccataaaatggggagatcccaattgaaccgaccccctggggtcatggtagagatggggtgcttaggaaatatccccctccttccttcagagttttactgtgtttgggacagaaatcattcctcttccctcctcatgttttcggggggtttgtttttttgttcgaggcagaaagtcttgctctatcacccaggctggaatgaagtggtgcaggcacagcttactgcagcctcgatctcccaggctcaagtgatcctcccaccacagcctcccgagtagctgggaccacaggcattcgtcaccatgcctggctaattttttgttgttgctttttttttttttttttttggacatggagtctcgcgctgtcacccaggctggagtgcaatggcgccatctcggctcactgcaacttccacctcccaggttcaagcgattctcctgcctcagcctcctgagtagctgggaccacaggtgcacaccatgacgcccggctaatttttatatttttagtagagacggggtttcaccatgttggtcaggctggtcttgaactcctgaccttgtgatccgcctgtgttggcctcccaaagtgctgggattacaggtgtgagccaccacgcctggctgtgttgttgtttttttagaagagacagggtctcgctatgttgcccaggctggtctcaaactcctgggctcaagtgatccttcttccccagcctcctgagtagctgggactacaggcatgtaccactctacccagctaatttttaaaatcttttttatttattttttgagacagagtctcgctctgtcacccaggctggagtgcagtggcacaatctcggctcactgcaacctctgcctcccaggcaaacaattctcctgcctcagcctcctgaatagctgggattacaagtgcctgccaccacacctggctaatttttttttttttttttttttttttttgagatggagtttcgctcttgttgcccaggctggagtgctatggcgtgatctcggctcactgcaacttccgcctcccaggttcaagcaattctcctgcctcagcctcccaagtagctgggattacaggcatgcaccaccatgcccaactaattttttgcatttttagtagagtcagggtttctccatgttggtcaggtgatctcaaactcccgacctcaggtgatccacccgcctcagcttcccaaagtgctgggattacaggcatgagccaccacacccggctgcacctggctaatttttgtagttttagtagagatggggtttcatcatgttggtcaggctggcctttcctgacttcaagtgatccacctaccttggcctcccaaagtgctaggattacaggtgtgagccaccaagcccagcctaatttttaaatttttttggtagagacagcgttttgctctgttgcccaagctggcctcaaattcctgagctcaagcagtcctccccactggacctcccaaagtgctgggattataggtgtgagccaccatgcccaggctcatcttttcatgaaagtcacaattcacacattttgcttggtaggaaatatttttatattaattctgaaaagctacaaaagtgcatttttacaaacttaggggaagttgaggttcctggggtgagtcctcggttctcccagctttgctctgtaatgcaggtctctgcaagggtccctgtttgtcccctaaggggagagcgcaggttggcctgtgcctccaccccactcccgattcaagctcacagcccaccttttccctgccccatctcagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaatga

SEQ ID NO: 36244 - DNA, 392213 bp, Homo sapiens
ccagaggctgagcccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggatggcagaggcggaattgcacaaggaaaggctgcaagccatagcagtaagtccactttcattttattttcttgctctattgtctggggtggaagggggcccccgagggtttcggggcaagcggcatgccagcacagtagccgcaggtcatatgttccaggggctaaaactctgtcagggctcagctaggctgccttttcttttctatgtctatagatggagacccccaagggcgcgctttggactgaggatttgaatgtggaagattggcttaaaaaaagatgcttgctgctgggctttggggaaggactaaacagaggcttggggtggggggacgactccaggaatattatgaccgaatgctcaggcatacgttggcttcatagcctggagaaccaagagaagggtgacctgaacggtggctgccatcctctctgcggaagctgtcctcctgttaagtggaaaaccaggagtcagcgactcagccagccacgcggtagaacctcctcccagaaaccgggaatgttagttttcccttctctgtttgatattgacaagggcactggcacaagccaccaccctggaggtctggggacttcatacaactgggtcctggttataatattccatgagagcctccttcttatggtgtggagtatctgaaaacctattttcagcctacaaaggagtagtcagttttggcaaagttcgtaggcactttcagaaaagtgtacccatgtgcatcttgggtttaaaaaagaactctctgagactgcctagatttgagcaatcttaacacagtgttgccaatgatccacagatgtggtatttttactggagccaccacagctggattatatatttccttcgaggatgagggaatgattactgctgccgtatgaaatagtaacaattaaaaaagaaggtccgttaacatattggcataaaagaatctccagacattcttccacctaaatacatttgtgtttttcagttcggaagttctctggaaacacatataaatttgttggagaaatagtgtgtaatgttttggaaccaaagtatattaaagcgttttccaaaacctttttggacagattcttcattgggaaaatgcacacagacccttccttttttagaagcatttgacatggtctccaaggctctgagaccctctttctcaaacgcctcaaatctgaaatgtcttggagacttcaccactgaagtgagagagatgtttgctggcaatattgaaatgccatggtttgcctattaggtaatctttgaacgtggtgctctgaactcagaaaggttgtttttttcttctttctctttccccctgtgcatgtgtattttgatggtttgtgaagttatttgtggtttctaaagttggtggcaaggcagcatggccagtgtgtcatgaacttgataagaatggtgatattgagttaatggtgccatgtagctggtgggtgttttgtgtgaactggataataggctgctttaactgttgatgcagtggctgttcccattggctgctgctgaaggcttccaacagttgtcacattttctgcctttgcacaaccagctttactggatgcctgaggaacagctgaactccatgaaaggacttgctttccaaacatggagccagtagctgctaacactggggtacccttttccaagtgcggttgagtaatcccagcagaggccaagtcgattttccaagaaagatctaggcaaatctttgggaattctcttgagcatataagaatacacacaaatactcacttgtgcctcttcagttattgaagaattgagtttgtcctgtgtatctggggagctgttgattattctcatgaatgtgcacctaatacagtctgccctccctattcatgggttccatatccacgccttcagtcaatcttggattgaaactattggaaaaaataatagatagctgagtctgtactgaacatgtacagactttttcttgtcaccattccctaaataatacagtataatcaactgtttacgtcgcatttacagtgtattaggtattataaataatctgaaaatgattaatgtatgtgggaggatgtgagtaggttatatgcaaataccatgctattttatagggacttgagcatcctttgattttggtatccaagggggtcctgaaaccaattctctgaggatactgagggatgactgtatgatgttgtcaggacagatttgctaacagcgtgtgtttgtttgtgtgtgtgtgtgtgtgtgtgtgtgtgtgtgtatgtgtgtgtgagagagagagccaattaagagacagagggagttgggtggggggacttatggccacatcggtaaatggttttatgctatgctttggtctagtgcctactcttctgaattctgcaaaccctgactctctcatcactttcctggagttctcaggggaccctgaggagatcacaagcctgcccccagaacctagcactcctgaagtctctctggagatgtgagggaagaagacaataggtcctcacatcttcacttacttgggcttctctctcagaggcagagaatcgactgggattccagtctgcagggccttgggcagtctttagtctgggtctcagctccttcatctgtagaatgggttcatgagttctacctcctgggctggttgtaaggtttagttaggatggaggtgaagcacctggcaggtagctgtcattggatggtgttgagcagagcccttagcttttgtctgtattgctgtcttgtcctgtggggggtcagaagcaacatctctgaagtggaatgtgtattaatgacttttttttttttttagacagagtctcactctgtcacccaggctggagtgctgccatgacagctcgctgcatcctgaaaccatcctcccacctcagcctccccagtagctgggattacaggcatgtgccaccatgcccagctaatttttaaattttttgtagagatggggtttcgccatgttgcccaggctggtctggaactcctgacctcatgtgatcctcccacctctgcctcccaaagcactgagtttagagacatgagccactatacttggtctgaacagctcttttttaatcccttccttcaactgactgaaagtcagggccctgcccagcatcactttctctaactgctttagacagaggcagagatatgacttgaggattcattcatccatttgttcagtaggtatttacagattgcctcctctgggaaggtattggcaacactgaaaagttggtgtccccaggtttcagctgcctgaggctgaaacctttatttcaccttttgcacataatttcttgaaggacagatgtcctgatacctaagatgcttgtcacatgaacatctgtggaatatccgcccccaccaacaaaactgaattaaatacttagaaactacagtgctttaatggaatcttccatttggatccaggaactaatcaatgagaaaagatgactcttatcctaatttctgccaaaagaagagcaagtccatctttgacaatgatctctacactcacatgctcctttcttctgtagggatactccccaaactttacatttagaacatggtaaaaagcctctgaaacagcatgagtgagaatggtaatcccagggactaataacaacaattgccatttattgaatattgttcattcagaaaggcacggtgtgaaatactttttgtttttcacctaacgttatttatagtctaatggaagaaatagaaaagcacataagcagttactatccaggagtactatgaaaatgagcatccaggaggaacatgtaaaccaatctcagagttgtgaaacaattccccaaaaagaagacattagagtaagtcctgaaaattgggtaaaataaaatataaaataacatcataaccttcccaattaccaggaggcatttgtttattcgttatttgattattatttattcaggacatttagtgtgagaaagggaaaggcaaaagcatgaagaagttaagtcagtagctaaagacacaaactcagagtgaacactgaaatgcttttcagcatgtattatctcattgaatcctaataagaagcttatgaggtaggcactacagtattactcatattttataggtgaggaggttctagaactggtctaacattaaactgatagtatcaaagccaggatttgaatgctgcccgcagcaggccattggagcctttgctttgactgctgccctgagctgccacccaagatggcggcagcgtctcgcacttttcccatgagcacactgtgcaggtggtctcagcagcctgagtgtgagccacagactgattccattgcaatgggaaagcttgagacaagccaggaggcctacctccttttgagagtctttcaagcctggattcagtgcatagaaatacccaacataaaatttaatggaacgagtaacattcccatggggaagaagctgttgtgtctcagtggaaactaaccttgtgggagggtgctgttatgtctgcacattggagaggaagatagttttctttgggcatgagtgaaaataagtaaatgttatataaattgtcttgggtgaaactcctaagagccacgtggacaaggctcaggctacaccagggaccagcatgagtatgtttatatatgtgcggaaataggaaatgctaatctaacctatgctgttctttagggaattttgtcatttaattagaacccactctgtgaagtaataaaaatgatctttgcatttgtgcagtactttataatttatgaaaaccttgtatatgctaccttcttcctgaggtgtgtagagcaaatcttatacgctttacaggtgagtattcagagctatccaagcttacacagatagaggtggaagagttgtagtaaatcccagcctctcctgactcccaattcttgtattagtccgttttcaccgtgctgataaagacatacccgagactgggtaatttataaggaaaaagaggtttaatggacttatagttccacgtggctggggaggcctcacaatcatggcagaaggtgaaaggcacatctcacatggcaacagactggaaatgagagcttgtgcagggaaactcccctttataaaaccatcagatctcgtgagactgattcactatcacaagaacagcatgggaaagacatgtccccgtgattcaattacctcctaccatgtccctcccacaacacgtgggaattcaagatgagatttgggtggggacacagcaaaaccgtatcacttgtgttagtggtacatccagccttggaagggtgctttgatacgggctgaaactgcaactaagatcctgctggactaaaatcttctggctgggaggagaggagtgagcttggatgtgtctctatggaatatgcccttgttaggatttcactttcggcctctttcattcttgaaattctcaccaaggggtcagctagtgagtttatggctttcatctgattctattctcagtcctgcatagacctgggtatacgctgttggcctaggctggctgtgccgtgggcttacagagaagtgctcattggcttttcgttggattcgcctctccatgccttttcttgcctgggagcattacagccttgagtaccaggcttggagtgtggggccagtggccaaggaggccaccaccctgcttttggtccaggccttttaggccgacctgcacagcatgggcaaaaagtccttgcaatgatttacatactatccagtccagcttcccaaggatccctcagaggggttagagactcaaacccaagccctgtagaaacaggcactgtgattcatgtggggaccatccccatccatgttccttgtggacttgtgttattggtatgcagctgtcagagaactggagaatttaagatcctggtcattcatctgttatcttatatctcagagatgcagatgacaccctgcttctaaaattccatgttaaggcctaaaaaatcatttgcgtggtatattggtgctgaggaagggttcaacttggctgagtctgtgaagctgcccactggataggtgacactttgggcccatgcagggtcattgctgtgtctgggagtgccaaggcaggccttacccagcatgcataagggtcacacacctccctgctacttatttgtacctctgagtatttcagtcttcagcttattgggacaaagagcagctactctgacaaactttaaaatgctctgagaaatagagcagttatcatggaaaaaaaaagtcatcatagaaaaagctaagtgaggggggttgtgggttatagtttgtcaatatttaaaggaaaaccagggcccagtagaattgtttctatatttctttgggggctactcaatgctttggggtcactgctggcccctttgaactctccacatttcaccactgatcccatttgggaatgttgatgaacttgcttggcagtaagagttggtcattctgtggcatgaaattgactgagacagcagatggacattgatgcacagagacggtggtcccaagggctgtcattgtggtggggtagttaccagcatggattttggtgtcaggaagacctggcgcaagtcctggcctttccgttggtatctgtatgatgtcactgtaccttggtttcctcacctgtaagatggggctaatgatcatacccacttcagtgtcttgttgtgatggttcttttagaggtttcttgggaaatgctcagagacagcatgcattaagcactcacaaactttcctatttataataagcaaaccaacaaatcataacttatgcatctttaaacagaaagtgaacacaaagagtgaaaggagaattttgttagccacagcatttttgtcaaactaggaaattagataaatactaggaaatcagataaatgttgtaactcctgagttttcaatgcatgaagatagtattaataataaaaaatggattatttgtagtaagcaggagtagtaaactcaacaggtcagggggccagcatgcaatgtaaatgagggacacagattgagtcgaaagtattggtccctagagagcagatgccacctctcagttaagatgcagttaatttatgccttgtgagaacgtgggtcttatgttgttacatcaactcattttcaagagaagccagaaatctgatttttaacatgtgagatctcccacttaaaaaagaacagtattaactagtttaaaaactttaaaaagattggcagtcacaacacaattccttttgatcaagaggccgacattttgtgacctttagatatagacagagctttgaactttacaggatgctttccttatgcattgatttatttggatttcataaggatactgtgaagtaagcctatcagcacccctgagatatttcataatgttgtaatatcgggttgcattttcaccagagctttgtgagtttggtgtccagatgtttggatcattggataaatggtgcttatttgcgatatcttttgacattaaatgagcccttgcaaatcactgacattattgaaactcagaatactcacatctagataggtaattgctctctaactcaaccaaaacaaatctaaaccacatcaagtcagcaccttaatttgggaaattcctcttattagaaaagaatctttaagaacctatactcaaggtatgcaaatctgaaatgcaaacctgatatgaagcccaagcctaactcatgtcagtcaggatgtttgagttgatcctgatttattattagcctcaagtaatggacattgtagggagattctgctgggctcaggactcatagtagcagcaactgccatttgaccgatgtttttgtcatatatggtatagaacagtaattctcaaacgttagtgcattaggatcacctggagggttccttaaaacacagattgcaagagcacactcccagagtgtctaattctgtaggtctagggtgatgtggcctgagaatttgtatttctaagaagttcccagctgcaactgctattctggggaacacactttgaaaacgactggtgaagtgtaggagatcaatagtaaaggaagattatgacctgggtcctgatgtgcatcacatgcccattgtgatatgcccaggagtttgtgtggtgtgtatattctgaagaggtgaaatagaataaaaggccaaatttagtcttgattaatgagagccttaaacatagcccagtttggaagtcatgcaagccgggtgcggtggcgcactcccatagtcccagctacttgggaggctgaggtgggaagatcgcttaagcccaggagttcaaggctgcagtgagctatgatcactgccactgcactccagactgggcaagagtgacaccctgtgtaactgtgtccttctcacattacactggctaatcaagaagaggtctttgcttatctcgggaacttgctttaatctatttaaataaagtgagatatctgttggttacttgacaacaccggtttggaaggtttgcccaggattggctgggcaggttgagagagtttgcctgggattgactgactgaaactatgggctacaaaattcccttggggaggccttagaggacacctcagtgagataagaagtcatgcagtagagaagatatccagcaacaccatgacagccccattgagagaggcttgccatacatatgatggtgtatagatgaagacatcaaatagcagatcagcccatcaagcctggtggccccttctccagcctgcaggtgctaattcgcgatgtgattgcttctcacgtgggcaactccaataggatgccaggagaagcagcaactgatgttcatttacttaatgatggttaatattttatgaagccagtctgtgtatatgcaagtatgacttgttattggcatatcaaggacaagtttattcttccaaggatgtcatgcaggcttccctcacttgtctttgtaccatgcattttttgagctaacccttcatttttggaaggattctgcctcaccggatctcttgtatatcttaaaacacaaagcacagaggctgcactgtacaggatgaggcctaagagaacgtggagactgtaggggatgggccacacagcatggcggagtttgtagaggaaaggttgctcataagtgctctgggtttgggagaagaccacacagctgagatctatttctgacaggaaatgccggcaggagcagagggtggtgtggggcagtgcgtgttggagctacagtgcccttggttaattattatctcagtatttctcattagtctcttgttgaattaaaatgctcaaaaggagattattaaatacacacagaaagggagacagactgacagacacagagacaagactacaccctatttacataatgcttgaacatatattaaaaatactttggattactctttgaccctagtatcactgtttctataggatcatataagtttagctagaagaaaagaatagagaatctgtacctttcttttgcataagatcgaaggggaaagaaaagccatgtgaggcccaagataaaagccccagctgtagatgaaaaagctgtgggccagacgtcggaacacatcttcctgtccatcatttcccttgtggaagcctatttcattaccctgcaggcttttaggctctagacagctttgcaataccaaatatcttgaaggcatttgtaaaacctactcttacttttttcctggaaaaaaaaaattatactggtttacttactattctaggtgggtgggatttttcccccctctgctaaattataaccagtcatctaagtattcactttatttttaaattcagggctgaaacttaaaaccttgagggttaccaaaaaatgttattcttaagagaaaaacatgcttgaaaacttaacccctttggtggcaggcaggggattttctttgtctgtgtttgagtgctaatgtcgacaactttgaggccaataaataccaaatggggctctaggatttgggcaactgtgatagtgtgtgtgtcctgcatgtcacatgagaaagagagaggccgggatttaagaaaggtgcctcttggctgggtggcatgaactcagtcagctggctttccccaggcacctgattggccttaaacactgagtttttgtggtgtgacttgacatacatcttgggctgatatcacgtgctgtttctactggggtgggaagtgctttgaaaatgtccttgctccagtggaactgtgagacatatctaaaaagcttaaggctaatatgagtgatgctaaaaggaagtcctgcttatccaggtaagcaaaagcatactctaggatagcagtgctcctgtaacctgcatggcctatttttcttttccaggtggtatgcaggcagtcttgttcatgaacattgatgtctgagcatgtgtgttcaaaattcagtgttgttaatcaaataaaactcaccacaaaacccgaaggatatttaacaatagatgagataggtttggcggagatgggtcagaagacagaggaggtcctggaggcagcagtagaatgtactttccaatcttactggtgactagagataagacactagtagcctgtttactccccatccttatttacactggagtgagaatgatatatgtcagatcagtattggatgcgatgagggagaatgaagagaaaatattgactctgaaaaatacagacaagaggaggcaaagttgaaagtaatgtaaactgcttaatcacctgcctttctctctttccaccgtcatctctttctacttgacatgttcctgcttttgcctctggatggttctatctctcatcccctctcagcctgggtccacagagaaaagcaggaagcagcctggcatggcagtggagggagccttttccagccttcctccagcagaagtgcgccctctcccctatagggagatagggcaccccaggcttcagaaagcaagggaaagatggtacttcatcatgtagcttttcttaaggggttggagggaagggctcccagttccggagagggtccatgtgccagccaccctgctgaatgccttatgttaggggggtgagatctcagatgtgcacaggtaccaggttgacttggctgagcttttgggactgtggtagccaagagagggcagactcctgaggggacagagagtgctcaactccaactgatgggcactgtgtgggaatttgagcccagggtctcctgcttttccaagagaacctggaaatccaattttgaaggaagtctgttgatgtttaaatgctcacaacagtttaaatactgtatgggccaaaccaaacataacacagattttaacacagtgtaggctggatttgttccctgtctcaatgaccctccccctctacccccagcctgggccaccagttttccacgtctgcatgtcacaacctattttatttaattacaaaaccaatagtatgtgggaatgggggctggggggttggtacagtataaagctatgtgagttgtagatacacttatgtatgttgggcaccttggtgggatccataccctataagaaaaccatagtcttgggtcagagtcagggctgctacttaaatcagttccttatccagcatgctggatgaactcatcagttctctgtaagaagtaaaaactacaagcactctttaaaaaaaatgaaaatgaatgaagagaaaaatagacttattaaattctttaatttggaagactgggtctcgctatgttgctcaggttggtcctgaactcttgggctcaagcgatccttccacctcagcttcctaagtagctgggattataggcatgtgccattgctcccagcactaaaattgactttcttgatgtacagctctctcaatttgaacacatgcgtagatttgtgcaatcactggtatactcaggcaacagaacagttccatcacccccaaaagtctcccaggaaggctgattttaaaactctaactggaatctaagtcattctgcttggggctaccttataccctgactttgaagaccctaaaaatcagttgagggtgggagggttgaccagaacatgaaacttgggttcccagccattggtggggaactgtttcataatgagcaccctaccatacctatataacaagtttttgcttcttcctaatacataccttctgctccagcctgggtcgtcttttcactatcccctactagggttgttccatttagcaactaaatgtataggatgcccagtgattccatggggacatatttatattaaaatattatttgttgttgatctgaaattcacatttaacaggacattccatattttatctggcaagcccatcctcttcacattcatgccacattctcatgtaagttcaaaacctactttctctgtgtttcaccaaagggtgaaaatactctttgaaaatactctttgattttattacacttaatcttagccaaaggccaagaagcgattgtatgctttgattttaaatagtagcatgtttatagggagatagggcaagtgttggaaggataagagtgctttctatacacataaatggattttcaagaaatgttttgtgaccaactggttttatcctttccagagaacaagaaatgatctaatatgtgctcaaggaaggaggacaactggatttcagaaattggttcatgttacagcccctcctctaccctttttctctggcctgacctttgaataatataagtctgaaaagactaaacaaagagattgctcaaactggatgagtttaaaaataacattggaatgctagccttcagcaagccatatatcttatactgcactgagcaggacagtgccctgtggtgggtagaagatgagtcacacagtgatcacaaccagatccttcccagcctggatactttggtggagagtggtgtgatggctgatttatttgtcttgtttgtttgttgtttcatttttccattttactagtgtgatttcagaatcacaaggaggcaaggaggaaaattgattttagatagcagcttcagaatgaaaaatgagtggaaattccacttttcggtctagaccagggaccagcaaacaatagcccgtgggccaaattcagcctgcagcctcttttcataaggcctatgagcagtgcctggtttttatatttttacaaatttgaaaaaattcaaaaaaggatcttttatgactcatgagatttgtatgaaattcaaatgtcagcatccataaataaacttttaccagagcataaccatgcccattcatgtatgtgttgtctatggctaagtttgtgctataatggcagaggtgaataattaaaacagagactctatggcctgtaaagccaaaaatatttactatctgaccatttggagaaaaactttgccaacccctgctttctacatggcgtatttcaatggctgtatttgcgatgaaggctccaggagccttttatctaaagaaatcactattgcctcattgcttacagtccagaacaataaagcatctcagacatccttttcactgttttctgggcttaccatgatgagaggttttgtttaccgaagctggcatgtgagttttgccgctgtggaattttctcattatatcctttgctatctaagccaactgcatgttgttgttgttgttgttgttgttttttgaaaaccagaaaatctgatctcttagggttaacagtttggcccatctgaaataagtccatacaattaaaaacatttctttctattgacagggactgagggttgagggaaagcactgcagattttccaggtgtatttttttttttttttgctccctggattttgcctgaaccctcacttttctctttcagggaactttaagcacacttagtgaaagactaaaggtcagagagcacaccagccacattccctgagtccaagcagggagccagagaggagtggtttctggccagccttccctgttcagttacctcatggaacccttgggaccagggccttgatttacaaatagagtggccactaggtaaaagttgcccatggccagtggtagcaggatcgaccctagtgtctctgaatcattaagtacttcctttctgccctcttccatttcttactcaaaaacaccagctacaattttgagtctggtctgcctggaaatttccaaagggactttggtgccttaataaatattttcaaattgctcaaggttttggaagatagcagagccataattgtgaaatcgggttaaagaatgattgctgcagtacttgcgtcggccctgtggccatgctgaagtggacagggttgtggacactcacaattgctcactgcagatggacagcctttgcttttctggtcatacatatgcttgatcctgaaattctctagatgggctacttctgagcagctgcttggagaatgggaagccaaccctatagtgtaaggtttcttaactgaagtaccattaacactttgggatagataattttctgctgtctgtggggccgatcttttgcattataggatgttagtggcatccttggtctctatccattaaatgctagtagcacaccccactcttcattgtgacaatcaagaaggtctccagacattgccaaatatcctttggggaaaaaaataacccctttgaaaatcactgatgtagtataacataaaggttacctgaccaaatgtacttcccattcttttaccattagggatttatccctttaagtcttcactctcatcattagggattaatttctttaaatgtcaaagtcttttttattttctagaatccctcacgacaatattgatttaactaacctgcacgttgtgcacgtgtaccctaaaacttaaagtataataaaaaataaaattaaaaaaatggtaaatccttaagcttgggatggcagatggttttcagctcctatgtgaactctaactgatagaaagtgtccatctatagtgccgccgtgggaagatctttgaagctgcattttaggtgttggagaaaggacattaagacagattagagctgtcttccatgggcaagagatgagggagttggcatacacgtgtaaggaaccttcttacctaacatttctgcggagattcactatagtcaggccttaggctggtgctgtagttcagccttactgctgagccctgtgccagggcactgttcacacaaggtccctgtagccttgtgtatttgttagggcaattttccagcaggttttgaggaaagggcaccttttctagatcacagagtgccatatgggcgagcagaggtgctgtactctgttgatgggaatagaagtcagggaacaaaaagagaggggcaaagaatataacttcctgtctgtctctcctgcctgactgtaaacttcttgaggccaatgactatgtcatattcaccattatctactctccgcctgtcacaacacattttgcatagtgtcaaagcaagtttagtgacttttagcagagttcttgttctgtatcttggactccttagcagtcttgtggaacctatgggtcgcttttcagaatagtgcttaaatgcacaaaataaaatatttaggattaaaaatataaccaatgaaatttatatatagtcagcaaaatattagaaaactgtgatagataatgtgctttgattgattgatgtacagtcagcaaaatattagaaaactgtgatagataacatgggatttgattgatgtacagtcagcaaaatattagaaaagttaaagataacatgcttttttattaagtaaaatctagtggcagttctaatacttactctaattgcaaattattggtgaatgtaagtgatattttgagctgtctccaacaactgtaatgttatataaaaagtctgtgattcctactcctaataaagtcatggtatattagtccaatctcacactgctataaataacttcccctgagactgggtaatttgtaaagggaagaggtttaattgattcacagttctgcatgtctggggaggcctcaggaaacttacaatcatggtggaaggggaagcaggcacatcttacgtggcaacaggtgagagagatcatgtgtgtaggagtaactgtcaaacacttataaaaccatcagatttcatgggaacacactcactatcatgagaacagcatgggagaaactgcccccatgatccaatcacctcccaccaggttctgcccctgacacatggggattatgaggattacaattcaagatgagatgtgggtggggacacagagccaaaccatatcatataggtactaatgatctacctggggcttgtgcttacattcataactgaaggcggtgctaaatgttagctagggggtggtaaaaataacctttagctgggtaccctaaattctgtcttatccccaaacgccctgaattctcacttctttcttttgtaactgggcccctgctctgatggtttcctcctttcctttgcctgatgctacctcttttaccttcttggggttcttccccagcaaatttttctaggttctttcttctgcattcactttccatctctctcagctgggttgtgtcctttggccgctatctaagttctcactccgcttagcatgggaagggaagcttctaggcccagcttggggttaccctgagcttcagaggagagagggaggttggcacatcacagatactcactgaatgctttttgaatggaaacagttgctttgccaacttcaccttttttatcaggggctcttcttggattcttggactgtgtttgagatcagttcactcttgatatctcccctccgcatggaaagcatccacaaatttccagctagagcatgaacttgcaatttggtttgcctagatcctggaagtctacagagttagaatctttcctggttctgaactcagaagcagcagtgagcagtgggactgctgggacctttaccagcaatcacccaccacatgcaccagcttcaagcagctctgcagaagccgtccgtcaccctccccgttgcacaccttggctgtgaaccgccagggcaggggcatgtgtgggaagcaggcggcctgcagattcattattgctacaagtgaatttcataataaacaaacaaaaatgagccatctctagtttagttccctttgagcatataggccatcaggtcccaaaatgttcagagttgggttagtatctgtggctttcaccaggtaaacacatcagtgttcttcctaatttggactgttgtggcttccctagttcttttttcccctagattgttataaaggttctgtattagttttccagggctgttataataaagtgccacaaattgggtggcttaaacaacaacaattttatcatctcatagttctggaggctagaagtctgaaatcaagatgtccagctagattggtttcttctgagggttgtgaggaaggatctgttccaggcctctctcctggacttggggatggccagcttctccctatgtctcttcacatcatcttctttctacatatgtctgccggtgtgtccaaatttccccttttcataaggacaccaatcatgttggaatagggcctaccctaatgacataagttgatgacttctgaaaggaccctgactcagaaatatcctgaggtactgggggttaggacttcaatatatctttctggggacagggtccttgcatgctgtcagatgatacctgcatctcgcagtgatggtcaagcgtaccctactctgcttctggctatggcagtagaaattgtgtcccaggggaatggctaaggggcctgtaaacaatgggtgccatatgccattaatggctcaaacctctgccttgtctacacactcatgtatcccataaccctctgtctcctgtcaaagccttttatcaggaaaggcatagaaccacatttcacgctaaggcatgagtgttaaacataccctcacctagccagttaaaaacattgggcaaagctgtaaactacatcacaggagttcaaaatgtcaacagagctgcccccagtcctgtctgtgtttttgcttaggacccagtgttgtgtcactactccccattgataataaacaaaacatgcctcatatgttcacagttatttagagtttacagaattctctccttctatcaatttgtttgtgcctgaaggagcaggaaaggtattattttctgcattttatttcagagaaaacagaagctcagctgagtaatttgttcaagatcatccaggctgtggccggagcccacatcatccatgtctctatgtcagctgtctttccactgctccaagccacctgccctgctgccctccgtttcccctccaggtcactgttgtgcggaccatgcaacccgagtctcaaagactcacggatccccttgctgtgctctaggacccagtcctagcacctcctaacctccccaagagggcaaaaagcagcctaggtctggtgagggtggccaaggccagaggattctgttagtatgcagatcaaaggaggagcatgggcaaagtgacaaggtttgtgatggagcagaacagtgtcaggaagtgatgtgaagctcagcgtggctcgtggatgttgagaagtgaggttgatgggcagggggtgctggaccacagaagaccaggtgttccaagtggggcaaagatgtggtctgtgagaggctgagagccactgaagacctgtggtttatcagagactgctgtggtggcagagtggaggcaggatgaggcagggagctgctccaggttcctgactgccggtccctgccagtgctggtacattcctcaaggcttctcagtggctttccattatttccatagaggggtcacctttagttttggggagtttatttttgagatggggtctcactctgttgcccaggctggagtgcagtggcacgaccattactcactgcagtcttgaccacctgcgctcaagtgatcctctcacttcatcctctcatgtagctgagactgtaggcatgcaacacgatgcctggttaatttttttgtattttttgtagagatggggtttcaccatgttcccaggcttgtctcgaactcctgggctcaaacagtccacctgcctcagattcccaaagtgttgggattacaggcatgaaccaccgcgtcggccaccattaggtttttaactgtttaaggcattctttttatactgaaacccagaagaagcatcctccccagcttcagtggaaagccttagagctgatggaaaaccagtttcgagttggaatgtggaggctatttctggcctttgtgacatcctgttcaactttcagaggagcctgggaagaaaggggtgactcagactataagcttatttttagggaaagctaagaattcagtcagagccactcggattccctattgcctgccatacagaatgtgctgttggtggagagattgatgggcagaaatcctatgtttatcacctgattgttacccagcacctcccatgtgccagtataaggtttactgatttgaaaagaggatggagatcaacacaaacacacttttaaatcagaggagcatatttcaaggcatttatatttaagaactaattttagggccaaagaactaatattgtaagagcttctgtgattaggtacttaatatatactactgttatggtaagtgtttagcaaatactaccgcatttaatggaaacaataatactctgttagaggaattcttatcactgttttaacagaagaggaactgttaacttgaggaggtttaacgttagcccaagaccgggtagctgagtccagattcaaactcagatctgtctggctccaaacccatgcaaatgacccctccgggtttggcaattaaacgactcacatgttgccaccctttgttcctatgtatcactaattgatcatggaattatttcttgctcagctcagatttgacctcaggatcctttcaacacaatgctacaggtagccactgctcccaactgagcaatggtagtacttgaagtagcgtctacctgtcatcttagctttatctttctctgtatttactcaaaatagaatctttaaatctacaggggtttgttgttgtttatttctacagatgtatttgtaaccttttattgattaaacaattgtaagaaatggagtattcaatacaatttccttttatagtcactggaaactctgcgtgctttaatagaggatcctaactgccttggagggaagaatgacgtcttaggactcaaagccttgatacaggcaactggcttatgtgtcagtgtggtagtgatgagtgggagatggggaatcagcctgaagaactcaagctgtatagcagtaaaactttcaattagcccagtctggttaattacaactggatggtgagttggggttgggggatgtggtgggaaggctaaagaagcaagataacagggtagatttgggggttgcatacatacacaccttcagttgccgtgaaacatttcagctcagcagacagacctgttgtcctaaaagtatagcaccatgtggggctgtgggtccctccagggagaaaggagttccttaaaagcaaactcagacaagagaatggggaagatacccccagggatagtggtgaagggagaacctagaacccagccttgcaggaggatgaggtagaaattggtccaggaggaagtctatggacaatatctaaaactggagcatcaagaaatagtaatagaaatatgttgcttagaaaggtggattccagatgattgagctgaaatggagttggacagtcacaatgtatggaaggtagtgcaggtgcatcaccaacacagattcattcgataaaattaaaatgtttttgttttactttcaaaaaaataaatagcaaaaaagcaagctcaggccagtggtggctggtggcctgtcagcatggagcatggaccttagccacaggccagggctttaaagccaggactccaggacctgggatgggtcattctgaaagctgattatcagaatgctcaggccagagctgggccagctgcccaggtgttgatatgtgtgtgtgtgtgtgtgtgtttgtgtgtgtgtgtgaagggctgagaactgcatctactaacatactccttgtgtgatgttagggttagtgaattgacctacagtggtacttggcctgcaggaaggggataaaaatgggcatcatggtaagaagttgggccagcaagcagctctagtctcacaaagccttttcctggactaatgagagggaccatggggaggggtgatccccccaaaatcaaccagatcaagttcctgatgaatgggcaatttatgactgaccagctggacacaaaatgccattgaacaacccaaatgaacaacacttctcagtcaaaatgctgctttggagagtctgtgtatgcaaatatacctcatatattcttctcactgtgggatggagcaagaaggccctgagcgtgtttctctaaaaatgcatagcaataatcctagtcttaattttagcctcttctgggcatctgaaatggggttgctacagttaaaataatgctgtataactaacatgatattgggtattgaggtcagagcagggctggcttcatcagcacgtgatttctgtagtcacataggttccccactttgttaaatgctccatagccatattgaaattcttaataacttttggaccaggagccctgcattttcattttgccctgggccctacaaattatgtagccagcagtgggttgtcataccccagagtcccagacaccagccagacatttgctgtgttgaaattatataggggaaaaatataatttagagcataaataaacccccatactttcagcaatttaacagtctaatgcaggtattccttgccagtggacagctttcctccatgtggtttctactatttctgactctgctatctcccagggcctcagaatcctttgcctccagcctgtcaaatgagagaggatgaagaggcacactcacttcttaactgcctttgtctggaagtgacccacatcattcttctcatagtctggagaactagtcatatgaccacacctaggtgcaaagaaagctagaaaacatggtacctggctgggtggttactttccagggctgcctccatcctatgggaggaagagcgtaaatttagatggatcattagccttctctgccacatagattgttcatgaaggaatgctgatgcaaaagcaggtatctcagtgcagactactgtgatggatcaggaaaggtaggaatccgggtctttttaacacagatgccagtctcttagcctcatcagttcattattattaagatgcttgctagttccagaataggaagaaactagaatcagaatagtctgtgtttgtttgcttgcttgcttatttatttatttccaagaacaggtttttggggaaaaaaaaagaaacactaacacattaaaatgtacacattaactgtaagatgcattgctatttcagtaacattataatgcgagaggaaacacaatagcatatcttagaattgacgaaatctagtaattgtcactgtgaattattggtttagtaatttttcacaaatccttttgctagcttcataaagtcctttaatagtgctcataggggatagccatgtgttggcacttggatctggtaggttctgcctgaccattttaatcaaaatgctgttaaccagggtaggcaccgcctgttgaatagcacaccttcttggtgaatttgtctcatggagcctcatttctggatgtgtcttaggcaaactaggagccctcaagatcatctagacccacgctggaaagaggtctaccttggagatgcatttatattcccccctgagatgctggtgattttgcaagtagtaataatcagagacctggaaaacttcaagagttctgtaggaaatatgtcctggtcagttctcatcagctcaacaaactgatgtggctcttgagggaaccagctgcaggaggcaggaaagcaagttagcatcaacacaagtgggccagcaccatagtcccaattctcctctttcatctgcttctcctccaccctagtagacaccttgggaagacaaggtagagacagtggcttgaaattcctagtgtcttcctttgatgggtatgtgctcctgcagagttaagggagtagatgaggttaactgtcatctaaacaaaggcagtggctgtaaatatattccttggagcttgggagccccatggctatgttccaggccagagagtccaaagaaaatcaaagactgccacctaacagcttttttggccatcctgaaagtccccaccttctcccaggtagctccagagaaagacaactcccagccaggctctgacagctgaatcgaatggcccagtggtggcacattccccagagggcttcaggttcaggatgcagccaagtttcctgctttatcctgagttaagcagagatcatcacctgcctggatgttgttttgtctgtgtcacctcatcactggagaaaacagattaccatctcctgcagtttttttcacaaaacagagcatggcatggaggaaataagatagtcagcatggcatcttggtgggtcaaaaataatatcatctgtatactttgattacattttaaattcagtttgcacacaattggggttcatttaattaactctaagctgtaatctcagtctgggtttgaatggatctgaattttaatagctttttcctccaaaatattatttctatggcaaataagcagcccttccttataatgctgaaatcatagaagttagttgttttcccctcattttttgacaatcattctttttgcggtagtaacgaaatcaagcagttttcatttggctttttggtagttgaagttaatttgtcaatttcctgctagtcttctattacgtacacatttttctggttagctgacaaatcagaatgctaatgatggtggggaaaagaagactggcaaattttacttctgtgggttttaccaaaatcataattggttgatttttcctttagaccttccaggataaaggattttttatttttaataatattttcttcattctaaataagaaagtgaaatgtacaaaacagtggaaagaataaaataacttaaatgtgcctgtcatggggccttacactcaatcagtatgttaacatttttaaagaaaaataaatgcccataatctcatcaccaaacacatgtagggaatttttttggcaaagattttatatatttgtagttatgctctctataaattttgcatcaagcttttttcatttcacattttcataaataatttctcatgccgttataaactcttcataaacataattttaattggctacgtaattgttttttaggagtacatttggctgcaagtgcctgaaaacctgggaagaaacagcttaagggtttttgtttgtttttttcatggaagaagacattgagacaaggggataaggggtcattgagaccatcagagaacctcctcctgcagctctgtttttcttagtgatggtggctgcaagccaagcacagggctctcccagagaaaacagggaatcactcccatctgcagactaagccatgtgatcaccctagctcaaaaatatctgggaaggtgggctgataactttccagcctttgtagtggaggaatatgggtttcttaaaataaaatgacctgaattagaattactgtgtcaaagagcagttgatttttttccccgaaattccagtctgattgcttatttggtgaaaagcaggatttaaaaacctgtgctccatttactaccatctcatttggcactggaaacacaaatgtacaactagttataaaagtaggatcaagtccaaaacctgtggctatcagtttcggggaggcagctgtcaatgcaagataaggaaaaaattcctcaatatttagagctgccccagtttggaattaactacttcatgggatggtgagcaacctttcccaagatgcagcgactgaatagatacttggtatataggcagaagaggtaatttacgcatttggtaaagtagaccgggtgacctgtaccacctaggcatctccatgattttaaaattaggatacatttgctaaaatatttccccaagcacccaggatatcctttgcatggtggaaccttgttctgatgttgcttcagatcaaacatagtagcctgaaatgtggctgtagtagagtagttgcctgagatgggaagaattcacctcccaggctcctgactccagggccatggaaaagctctatcttgggtttgagaccagccattacctgggtcaggcccacataccagccccatccaaggttacatatctgatttcctcactgcctgttaacatgactttattatttttcctgatgccatggatttcttcttttgtatcaacaaaatgtgcatgttccttatgtaaaaggtggtataagttctatctttgacattacccaattataaaatgcagtaaacataaaaacaattttctttttgatttatttacaaaagtggtctttccaaaacagttttactagtttaactcattttatctgaactccagcttaaagctatgaagtcatgtgtgataaataaacatgcatctgagtttatgtaattcagccaagaaatattttttgaacattttctatgttatagatatatttgtggatgctgagaatgttcatggtaaatacaagacagtctctgccctcacggagcttgcattctggtgggagactagggaagaataatttatgaataaactattgaatatatactatgtttgtatagtttgtagtacagagacttggttgtgctggggagggggataccttcatagaatgttcaagaaaaaccttactaataagctagtgttggagctgtgataaaaaacaaagagtgagccatgtggatatctgggggaaacacacttctggtggaaggaacagcaagtgctggcctgagctgagatcatacttagtgtgttcaaaaagcaaaaggaaagcctagtgtggcaggtggggagtgggtgaaggagagtggtaggtgatgtgaccaaagaggtggtggctggggctggattatgaaggcatctatataccgtggtaaggatgttggcctttacttgacatgagatcagaatccagtggaagatttggagcacaagaattgcacaatctgacctattttttaaaaagattactctggctgatgtggtgagctgagttagtaaggaagtgggcaagcgtggaagcagggagactagttgggaggatattgtggtaattcagagggaaaagagatacatgtgggccaagctagcagcagaggagatggggaatcctggattgatgttgatagtatagttcaggggatttttctcatccagtagatctaagtggaatgtgagagagagaaaaaaaagtccagaatgtgccaaaggttttgaggtaagcaactagaaggatggagtttcactggaatgaaatggggatcaccatgggaaggcctgctgtgaagggaaaataggaattcaattctggacatgttaagttcaatttttggagatgttggtctgatacctaggtggaagtgttgagtggtcagtgtcttagcctgttagtgctgctgtaacaaaatgccatagactgggtggcttatatacaacagaaacttatttctcatagttttggaggcttggaagtccaagaccaaggcattagtaggtttggtgtctggcaagggcctgtttcctggttcatagatggaaccttctatatatatatgttcacatggtggaaggggcaaggcagctctctgggaccttttttttttttttgtctgaaagaattccaatattatgagcatgtaatataaacaaaggtagtgctttaatctattgggaaaaggatgaattatttaatcactagcaatgacatggagggagaaaatcaatatgaaccaatggagcctcttttataaaggcactaattcaccccctgatatggtttagctatgtcccgacccaaatctcatcttgaattgtagttcccataatccccacatattgtgggaaggactatgtgggagatgactgaatcatgggggtggttacccctgtgctgctgttctcattatagtgagtgagttctcacaagatctgatgattttataaggggctttttcctgttttgctgggcactcctccttcctgccaccatatgaagaaggacatgtttgcttgcccttctgccatgattgtgaggcctccgcagccatatggaactgtgattcaattaaatgtctttcctttataaattacccagtctcaggtacgtctttattagcagtgtgtgaacaaactaatacagtaaattggtactggtagagtgaggtgctactgtaaagatacctgaaaatgtggaagcaactttggaactggtgaacagggagaggctggaacagtttggagtgctcagaagaagtcaggaagatgtgggaaagtttggaacttcctagagacttgttgaatggctttgaccaaaatgctgatagtgatatggacaataaagtccaggctgacgtggtctcagagggagatgaggagcaaaggagactcttgttatgttttagcaaagagactggtggcattttgctcctgccctagagatttgtggaactttgaacttgagagagacgattttggggcatctggcagaagaactttctaagcagcaaagtgttaaagaggtgacttgggtgctgttaaatgcattcagttttatatattcacaaatatatggtttggaattataacttatctttaaaagggaagcagagcataaaagttcaaaaaatttaaagcctgatgttgcgatagaaaagaaaatctcattttctgaagagaaattcaagccagctgcagaaatttgcataagtaacaagaaagccaaatgttaatcaccaaaacaatggggaaaatatctccacggcatgtcagaggtcttcatggcagcccctccaatcacaggcccagagggcctatgaggaaaaggtgtttttttgggctgggcccagggccttgctgctttgtgcagtcttgagacttggtgccctgtgtcccagccatggctaaaagaggccaatgtagagttcaggccattgcttcagagggtgcaagccccaagccttggaggcttccacatggtgttgagcctgcaggtgcacagaagtcaagaattgaggtttgggaacctccccctggatttcagagtatgtatggaaatgcctggatgtgcaggtagaggtgtgctgcaggggtggggccctcatggagaacctctgctagggcagtgtggaaaggaaatgtgggattgtagcctccacacagtgtccccactagggcactgcctagtggagctgtgagaagaaggccattgctctccagactccagaatggtagatctactgacagctttcatcgtgcaactagaaatgccacagactttcaatgctagtccatgaaagcaactgggaggggagctttaccctgcaaagccaaaggagcagagctgcccaaggccatgggaacccacctcttgcatcagcgtgacctggatgtgagacatggagatcaaggagataattttggaactttaaggtttaatgactgtccactagattttggacttgcatggagcctgtagccccttggttttggccaatttctcccatttggaatgggtatatttacctaatgcctgtacccccattgtatctaggaaataactaacttgcttttgattttacaggttcataggtggaagggacttgccttgtctcagatgagactttggactgtggacttttgagttaatgctgaaatgagttaagactttgggggactattgggaaggcatgtttgtgctttgacatgtgaggacctgagatttgggagaggccaggagtggactgatatggtttggctgtgtccccacctaaatctcatcttgaattgtagttcccataatccctgtgtgggatcatgtgggagatgactgaatcacaggggtggttaccccatgttgctgttctcattatagtgagtgagttggttttataaggggcttgtcctctttttgctgggcacttcttcctgccgccatatgaagaaggacatgtttgcttccccttctgccaggattgtgaggcctccccagccatgtggaactgtgagtcaattaaacctctttcctttttaaattacccagtcagctatgtctttatcagcagtgggagaatgaactaatacacccccgaaggccctacctaatataatcacattgataattaggttttcaacatataaatttggctggtggtggtggggaggtcataaacattcagtccatagcatgcagataaatttaggagtctagaattcaaaagagacgtctgggctggctgtataaagatgggaatcatcaatgtttagatggtacttcaagctaggaggttggatgaaatcaccatgggagttaaggtaggtagagaagaggtctgagaatagagctctggactgttacaggagatggtgaggcactaggaaatgaaaataagaagggctggccagtgaattaggagaggactaagagaactagggacctagaatttaagaaagtatttctagaaaggggcagtgaccatccttatgaaaagctgctgatatgccacgaaatctgaggccagaggattgtccactggatttagtagcaaggaggttactggtgccctgaactggagctgtttagatggagaggtggaggtgaacactgggaggtctggatttaagtgagaatgagatgaggcagcaggagtgttgactccttcaaggagttttgctgtaaagaggaatagaaaatggagtagtagatgagggagattgtgggcttggaaggggatacttttagagatatgacagtatgtttgagggctgcagagaatgatctagagcctgagaaacattgatgagggaggagagagatgagacaactgctagaaggaagcacttgagttgggaaatgaggaaggcatcgagtgcacaaatagagaggctgttcttgtgcaggagtgatagcagagcccacagaatgagtgcaggtgtgcgggagcctgtggtggcttggtctgtggatgaaccttctgactgcttccgttttctcagtgaaatgggaagcaaggtcatcagctggcagggaggaagggggaagaggtgttggaaatttgaggagagaagagaaggtgtgaaataatcctctcagacagttcaggagtaattgatctaaggcaatgcagtcagatttctggatacctccaacggctcccctgtgattagggatcttgaatttaaataagagcagacagtagaaatcaggtcttgggtgtgtctccagtgttttcaactcaataggtgcaagtacaggtaggcaaagtattggatttaatctgagttgggcttttgccagctgagtatgacagagagagaggggtgcaagggaattgagggtgtggactgtgggtatgatgatggttattgatcatagaatctgaaagctggtcagagagggacatgaggtgggtgcggggcagtgaaggggtggtagaaagagtgctatgctttatttgacttaacaaactggactccttattataaattcaatcacatttctaatgcatggtggaaagttagtatgttaaaaaaaatagtacatttttatatgttaaatatcctatataatagtaataattatctgctgtgttgctgtttttattatattctttttctttatgtttttagagatggagtcttgctctgttgtccaggctggaatgcagtaccatgatcatagctcactgcagccttgaagtcctgggctcaagcaatcctcctgcctcagccaactaagtagctgtgactacaggtgtgtgccaccatgcctggctaattaaaaaaaattattttagagacggtggcttgctatgttgctgaagctggtctcaaactcctggcctcaagccatcctcctacctcagcctcccaaatagctgagattataggcatgagccactgtacccaggtatattgtattttcttaaagcaagtcatggtatacctgaaagaaaccaaatataaggcactgtagatgaatcccagtgctgttggcagaagggacagggaggccacatgtgaaccaggggtcactggccctgccccaaaggctggacttgaatatgcagctggtgccactggctaacagagccacagtctcggtcacaataatagaactgttgacccatgaggtttctggtcataggggcagaaactgccaacagggagagggcagctggccatctgaagccaggatctgtcccatccaggaaaggagaattggcaggagttggggacatcttgccatgggtgaatactcctctgagaagggagaagggaggaggcagcttacagacagaaccatgagggagggacaacatggagcccaaagccctgctcctgagttgctgggtctggatctcggggtcagggttgtttgtgagattggagaggcagcagaagtagcccagatgaaagggaagaacctgggttggtctctttgctgggcaaactctttgcaccacagtctgggctggctcaggcattggataggagtgagcctgagggtgggggtactgacccatccagcggcacaatttgggaaaggaaggggcagaagaagcaaggcgcggctgatgaggaacatctgctctcttcccacagtgcagatggaaggcctaaatgccagcacaccgtttatttcactttggcaaaatccatgtttatttcatccctcacctcattgtctagacttaacataaatcaggacagtgcaaatggaaaccacaggtccttctcttggccttgccagctttattcttccctagggcaggtgcgcatgttgcattagtgtcataaggtggcatgagactgtaccaggccattagtcctgattctgatccagcagcatcactgccttgctccgtgatcttcccatgtttgagtcacctcatccttgatatggaaggggcagtacctgttctctcagtagcataagataagaggtagggaagtgcttgggaaaatgcaataaaagacactgctggaagccttcagcagtaggttgggttacagaggtcttggccttgcaaaatgaagtgaggtcagcacagattaagcagaccaaatcaaatctttgatggttgagtgatttttaaaaatgattgcaggtctgcacaatttaacaagactgcccatagcagctgaaaacatttccagagcagatcagataaagccaagttagaaattggtcattgctgtaaatcaagtggcagactatcaatgacctagattaccccagttttcccacaggaagtgaaaggaaaaccactgtgtggctgctgaggcttgatttgtcaagagctgagagagctacacaacattaaaagattgcccatttctcagcttgccctaatgaattgggactcatttaattcagaagctgatgagatgtctaaatcacatctatagaataagtggtcagatttaaactccagttgccaacaatctgtaacggcctctggttgcgttgttcatctcttagttaataaatgcttggctttttgctgaagctgccgctttttaatgtctaacaccatgacgtcagcatttttcccattttctgccctccctttaaggaggtagggatgagaaatggtaagaagatagggcttgttatgggtcttgacttggaagacccagagcatgggtcttgaagtagaaccttgatggctcttttctgtctgtgctgcaggtttaggggcctgcatttagactggcccataactatgggagctgctcccagccatcctagacttctcaagaagcccataactcttaggaagaactaagagcctaactcgtgttgtcctggacttttcaagaagccgataactcctaggtagaaccaggaacccaactctactcgtctgtcctacgtagggtctacaaggcagtgtaacacaccacgccctgcaccctaactgatcatagtcagccgtggtgaccacaggatggttcatccttcttgctggttcccagcatccttcttgctggttcgcatgtgctcttttggcacttatcactcccacattctggactcctggccctgcagttgactttgaccctacctttggccctttgaatttgtgcaaataccactgctgagctgacttgactcattctccagctcccactaccgtttgcagtgaaggtttgtaatgcccttgatgagaatgaagctcccagtttcacattgggacacagtgggtaagcaaatgccacacaaaagaaggcacatagtgcacacttgtaccatcatctaacgtctgcatggttctattgcagggctatactttcttatcggtagatacatggaaatggaaatgcacctgcttttaaatatatacttaatgcacaagtgtcaatgatatagttttcacctgaagaaaatctagagccatcaaagtacagggcgagacatactatatgagcctgaacgattgtggcaggattctaagaatctggatgatgaatctgaagaactctgtaacaaacagatgcaaagatgccatatttagacctcagaggaagtgagcctcctgtcactgggagaatccattcattctcctgattcactcatatgcagaataagtgttgatggccttctgtgtgctagggattcaaggacagtgcagtggaaaagatgggctagtacggaggatttagaaggtggtgtgggacaataagtactctgatagagaagcatgtggtgctctcagaagtaacttgtccatgatcacaaaccagtaagtggcaatttaattttgaacacatgtatatctgacaccaagactcatctatcaaccattaagctatatcattgcataagcagttccctgtaactggattggaaggtttgagataatggtgagaatggtgagaaagaatgatggagagatggactgtcttgtatgccattttaggtagagtttggattttatcctgtgggtcatgggaatctctcaggaagtgatctagttggatatgcatttttgagagagtactccactgtagtatatgaagtaatttgaattgggagggatggggagtgggcagtaagaccactcagaggtggctatcttgatactgatccaagaatgaaatagggatagactgacatgagagagtggctgtggagatggtgaagaaggcatggatttgatagttatgtggttgaattgctggaacttggtactgattgagtaaagggtgagaggtatggagaaataaagttgatagccatgtttccagcatagacaaggggatggttgatgttgaacatggaaagagggacatattttggggaaaagtgatgagtttattttggacatgttgagatcataataccttcggaatatacatgtgagatgcctgataggaaataacatgtaggtatggaattcaggaaggagatctggttttggggacttcagtaaatctgcatcaaatagtaactttagccatggatgtgaatgaggctatccagggaaagaatgcaaaatataaggtcaacctggtgactcactgtgctgagggaagccagggaagcagaaggggagtcagggtagacagaaacaggggggtaggtgaagatgaaagaactttccaggaaggagggagtgatgcatggtgccaaatgccactgacaggcaatggtacacattctaaaaagtgtccattgaacataccaactagaaggtaactggtggccctcacaagaatggaaaagcaggttcagtgaggttgtggagtgtggagttcagctgagaggaagttggggattaaatgaagtctttgtctccctaagtggtgtggctgtgaaggaaagaagagaagtaagtcttagctagagagggcataggatttgcatggattgttttaagaagaggaagtctaaattcttaggtgaaggagttaggagaaaatagtgaaagaggtgaaatgcaggtgagtggaggataaatgatggtatggggtccctgagaggtcagggcatgatggaattcaaggtactggttattagcctttttatgtacaaacaaaaaagatattgatgttctatttatgctaagtatgggcttgtcctggggagaaagtatctttaactgaagctagagagttgacaaggaacatgtacaaagatccctggacagtgttgagagctcagataaggttggagaccacagatttgtagtgtcgttctcctacactccagggcaccttatgtaggtgtttgatcttgggaaatgagactgtgcttagctctcatttgggatttttgccagatacctggatgtagccaaaggacgaggaggcaagattgttgaggatataggaagacagtgcagtgattggaatggattgttcacatgatcttaggcgaaaagacataaaaatgaagacaggagggctatgatggactgggataagatagaggaagctggagattagaagatttgaaaagacccaagagcagaggtgtgaggacaagccagtgagagacagggaaagaggcgaggctgtggttggagtctgggccgctgcacctaaacagttccacatttagtgatgaggccagatttcagccctgagtgcagatcgttgaggagagtgaagatcaaggtcatcagagttgaggttttcaggaaactgtgggaatagggttgaatgagtcatgaacacaaacactgaagtcaccccggatgatggtgggatttcatatagctcctgtgagccaaggaatgaagtcatcagtggatgtacggaagtgaccagaagatcagctggggacagagttaaggagagagggaacaagggaacagatgagactttttccatgagggcagaggagtcatggtctggaaatgacatgaaggagaaagaaaagtgccaaacccacttcctgatcctaatgccatctggcttaagagcccatattcattgagtctgaaatgcaacggacaactaccagtttgtctggaggcggtacaaatactcttctaatatttttttaaaaactataggatgtagtctattttcaactttattcaaccagatttatttacccctaccgagttttctaaatcagtgaatcagtattttaaggaataaatcttaggcacataaaatgataggaataaaatatgtattataaagcttctttaatcaatacaagctattcttataagtctattggttaatgtctagattgccgtgcccacttaaaatgggaaaacattccagttggcactttgtggatgttgagttgctacttggacacagttactggccttttggtctgatcagaggccaattttgagctaggagtttcccatgcatatgcatgatgtcctactatctgtgatacatgctgggcatctgagcctgcctggtatgctaatgatcagaccagggaaatgcacatcactgtgagtcacaagggtagcacgtctaatctaaaaaattcaaacccctataattagagttcagatgtcttcatagctctattcctcagatttttttgatctgaaaaacaaaagcaaacaacaaacaattgtgtaaaaatagacagtctaggcttgtgtaaatttgcagtggaaatctgcctctctgatgagccatacagtgtctatgggttgaaaaacgaaattcagaaagcaaatagttggtcaccttagagcccagagggatgctcagaattccctaacctcacagcggtgactactgaaagtttcattctgttttatgacttgacttgcagcgaggaaggtagcacagctgtaaaccagctgtattttatttacgcttggaaacagggcccctttgttccaaatgttcctggccccctccctcaatttcatggatttaggttgttagtggaaaagtagttgttgaaatatcagttcactcttggaacctgccactcaccaggacttctggcaaccagtgagcctttttgtgatatgcagcaaggtaaagaagtcgttaagtggatctcccacatgttcctctgtgacttcattcatagaaatgcgctgataactgagttacattaagcgcagtcttcccagctgtctgaggacataagggatgtagcgcctcctagtggagggaatttcttagcatgtgttcaaccccgcacatatttttggaatgaggcaaggtatttaaaaatagtgtacgctaatgaatgtatttattatatctgggtagcagcgaaacagaaaaggtataaataagcctttcgaaaaatgtacttgctacacaatctctttttttttgacaagtcagcccttgaatacaaataatcttttaatggtgaaaaaaatgactgaatcatagcatcttataaacataggagctatgggtatcaataacatggaaactgaagctgtggttatttttgagtggaagaagagggattaaaattggcgtggggcacatggagaggcttctggaagtggctagcaatttctatttatttttaactgggtggtgattacaaaggtgtttgccttataaaaattcatttagctaaacattggttttatgatgcttctgtatctgtattgataagaaggtaaaaaacataaaaacttttcattaaacatactacctgctaaatttgctttttaaggaaaaacctcaaaaatgctaagccatgtatactttttatttttagagatggagtctcactgtgttgcccaggctgaactcaaactcctgggattaagggtttctcttgagtagttgggactacgggcgtgcctggcatggttttgacactttatttcactgtactttcgaaataagacttaggtaccagtgaacacctacattgacaggcctggtaatatcattaaaacttgagcttttatgttgtctgtggcacagactctcttctttctagttcttcagagaactccaaattcagtatttcacttggaacatccagttgccatagaaatgaccatgtaggttacaagttcatttttgtaaccagtcaaaaggagaaactaagaatgacacgaaggcatctttccattggaaaaaaatcctttgcagagtcccaatttgagaaaaaatacattttgctttagaagtgagaggcgaacagatgaattagtaatgctgaaatatttgactccttcccccacaggtgaaaactcctgcagagcatcttataagaaaaattattttagagcaatataggtgatggcaaattgacattgggttgtaatattctatccaacatagtttaattctgagttattcaatcataactaaatttattcaagacatagaatacatttaaaaattcatcttaaaggaaatttcacaaaggcttttacattcgtgtaatccagatgagaaatgaagatagggggcgagcaacaaagttgaaagacccaaattgattccggaaggacttgccaagtttctataatgcctcattagctgcttatgtggcagggagacctgggaagagcaataactcttttctaggttctcaggttagggaatgagattttgacgtggccaatatgatcttatatgtccatttatgtcttttaccttatcattttcttttaccttatcatggacagagtggccccccagaagcacaggatgcaagacaacacacatttcagtggctgctccttctgcatacatcattgagctctgccaagggtttgaacacacacacacgtaaataaaggcctaattatgtgtgtgtgtgtatgtgtgtgtgtgtgtgtgtgtgtgtgtgtattatatgtattaagctctttttcctttctccatagcactgcatatacaaagatcagccaccctgagttgaaataaactgtcatgatctgtttggcattgtgagatcaccactcatcataaaataagctttttaaaatgttaaaattgaagtgagagcatgagcacaaagaaacaaggaccagaaggtgtttataatcatgaaaaattgggaacaattcaataggaaaacaggaaaatggttaaatatgatatgttcggagtatggaatatgatgcagcagttacaagtagtaaaatagatcagtatgtactgacatgaagaaaatagacttacacataccttatgtaaaggaggtgaggaaaaggaacaatggtcttttctgtattattagaatttgaatatcaaaattggattcatatattacttatataattaaaaaattaagttagtcagacttagaactctttgaaatctaatttttgaaagttaatttatgccatctggaggcaaacatgccaatgtgattgaagtttcagtggtaacctgaatcctcagtctcgttgcacatttactctgaagacattctcaaaagagaattggagaggaaatccacccagtgtgtcccctcatgtatgtctgtctgggatgctccagtggtgagatgccgtcacctcagtccattgtgttagtttattgcaatgttctagggttcagtctcagccccattcctgccaactgttagcttaaggcccttgggcaaaggagataaaattgttcagggccaacagatctcagagtttcttggaaccttaaaaggagatgacccaaacatttcttattcaagatgccaccagctccagtcactcacagtgacttgccacaggggctggtgatgttagctgcttccttggcgtctgagttctggcttgtgagcagatcttatgcccaatacatcagaaactccatgtctccttcagttgtagtcgttgggagaatccatgggttgactggagcctaaggaaagcaccaaaaagtcactagaggcactggagtggatatgaccttttcctttgaacagcagtttgcacaacatataccggtggctttgtagatctggttttcattaccatttctgtcctggggcagccatggaagccacctggatatttcaattagtgcagcaagctggaattcatttactttagagtctactgcctgaagcttctcccagctgggcacccaactacgcccaggaacttctagatataacacagcatcctgatttcagtctaataagtagatctattttagtcttctcaatttccagtcattttgaaagtgctcccctgtccccataccaggcatgggttccattcccaacttctatcactgtcagtggaggtggcagccttgtgagctgccaggtgggaccaggtgcaacccacagcaaggccacttgatgtctcagtctgtagagtaggtgcttaataattgtctttgacgagttaatgggtgcagcacaccaacatggcgcatgtatacatatgtaacaaacctgcacattgtacacatgtaccctagaactgaaattataatgaaacaacaacaacaacaacaacaaaataataataataattgtctttgaatggctgactgaaagcacattcatattatctagtcaaatgaatgtccaccctccactatagagcctttgtaactgagctactggggtctacctcatttcagaatccctcagagtccatggtgtatccattcatgcattcattgagcaaatattatgtacctgttctgtgttagagaatatttgaagtggtgggaatatagtggtgagaaaggcatgtttctgccttcaagacatcaccatatgaaagatactctgggatggatggagggtgttaatagaaccccagcaaattgacaaggtggctccccctgtgtcctctggctagtaagggactggtggctccatgaaacagggagctgccctgtgctgcccaaggctccagccctgcttcctcctcatctcccccctggacgtgactctgcctcatggggagcccattctcttagggatctttgtaaactgatcttcttgtgtcaaaaacatcaaatgcctcagattccattgcttataataagcactttgggaccaaaggaattttttgtaatgaaaaaaacagtttttcataagttaatgtttttcctttgagacctggatgcccttctcttattcatccactgcccatgcagctaatcagatttgaagggtaaaataataccagacttatcattgcatgttacatgagaaatgtattagttaggagtctggggttctaaggcatagagacagcatgagctagctcaaggaaaaaggggagggaattgttataagggcacaggggtgccccacagaatcgaaaacagaaatgtgactaggcctaaggaaagcgtcaaaaagtcactagattttttttctctctttcatctctcttcccatcttccccatccatctatccatccatccatccatccatccatccatccatccatctatccatccatctctctttccttctctccttcccagctcctgcctctgtatttcttcctccttttttcttccaactttcatttcaggttcaaggggtatatgtgtgcatttcttatatgggtaaattgcatgtcacggggggttggtgtacagattactttgtcacccaggtaataagcatagtacctgaaggtactttttggacctcacccttttcccaccttctaccctcaagtaagccctggtgtctgttgttcccttctttttgtccatggtatactcagtgtttagctcccacttataaatgagaacatgttgtgttggtttttggttcctgtgttagttcacttaggacaacagcctccagctctatctatgttgctgcaaaggacatgatctcattattttttatggctgtgttgtattccacggtgtatatgtaccacattgatgtccaccattgatgggcatttgggttgattccatgtctttgctgttgtgaacagtgctgtgatgaacatatgtgtgcatgtgtctttatggtagaatgatgtatattcctttgggtagatacccagaaatgggattgctgggtcgaatggtagctctgttttaagttctttgagaaatctccaaactgcttgccatagtccgcctctgtatttcttcctccacctagcttcctctgctttctggtccatgaggtcaatcaaatagggttgccccatagtgtctaagttttcatgtcaccagcccagccacatcagagagactctcgtcagatcagctatggccagaggtcatattgttccatagtggttcctggatgcagattaacttccagcgaaaagggacacattttgagcaggacagacatggccaaagctatctaatatgcccaagtctacacacacagacacatgcccaaatccctctcatggctacacatccaaccagagatggtcaaatggaccctgccctgaacccacatgggaggatatggttctgacttgagctgcaggatcccagggcttgtgttgaggtgggaacagccctggacctgagccagaatactggggctccagtcatggcttcaccattaaacaactctagagtcttaaacaagttcttagcctgtctgagtctttattttctgtataaactgggagtcacagaggcagctttcaattatttaaaggaccactttatgggagggggataggtgtgttacctgtctagtgttggaaggtgaaaccacagtggagaccacagagtggcaatttgtggctggagatacagaagaaccttctcccaatcaggctgccccaccatgttcaacctgcctgccttgcagagagttggctctccctgttactgtgggaaatccaaggggtctcagaaaacatctacagaatggagatactggcccatttcctagcaggattatctgtgtttgtctgggggtgaggggagtaaatagaagtttgagtgctacatacaaatgtgtattttttgcattgtaatcttaacaaacagaaagaagtattttgctccagtttgtatattctttcaaagcctttgaaccacactttatttttttagacaggatctcactctggcgcccaggctggggtgcggtgttgtgatcatggctcactacagcctcaacctcccccagctcaggtgatcctcctgcctcagactcccaagtatctgggactacaggcacataccactatgcctggctgatttttgtatttttgtagagacagggtctcactgtgttgcccaggctggtctcaaactcctaggctcaagtgatcctcccatctctgcctcccaaagccctaggattacaggtgtgagccactgtgcccagctgaagcacactttttagtgtgtctgccacaagggtttccaaggccactagctggcagaaggataaggtggaaatgtaaatgacatgcccctctcttcatgaaaacaatgtcagttgttcctctcagtccccaccataacagtttctgaaattctttctcacctccttcacttatttatcctttctgctccctgctagactgctaggggtggggacaggagtgatgtctgatcaccactgcctctgtgaccataacctctgatactgtcatttcttctttccaaagtcttggctatcatttgaggagctgagacaataggatagttctgctttcacagagcatattagcaaataccctgtgtgaggccctaatgacatatttggccctttccatctttggggctgtaatattccctacagatggaccctttggttaagtctccttatgttgcttttagttttcatcaatctctggttggtttttagaactactaaatggagccattaggtcattcaaaaacaggcagatgtatgtatgtttgtgagccatgatagggatccagaaatatttacataattttcatctattaagagatttaacagctgtgtctgccatgtagttactttaaaatataaaatgcaaggtcagatctcttggggatactgttttgtttttcttttcttatgattgctgttaacgatgtcatgtttaagtaaggaaagaaggttttgatattcctctaagagttaccagcctgtggaggagttgtgctccaagaggatcgaaggcttagaattcaaatgtaaaagtgtttaccttcttaggccagtcatctgatcaacacgtaatgtagctgaattagtacacatttccaaagaatttacgaaacaagacaccttgcaaaactagcagtcaaataaaacagaactctaaaattgaatttaaagtacagttttgtctggctagccatatgtagaaagctgaaactggatcccctccttacaccttatacaaaaattaattcaagatggattaaagacttaaatgttagacctaaaaccataaaaaccctagaagaaaacctaggcaatatctcattcaggacataggcatgggcaaggacttcatgtctaaaacaccaaaagcaatggcaacaaaagccaaaattgacaaatgggatctaattaaactaaagagcttctgcacagcaaaagaaactactatcagagtgaacaggcagcttacagaatgggagaaaatttttgcagcctactcatctgacgaagggctaatatccagaatctacaaagaactcaaacaaatttacaagaaaataacaaacaacccaatcaacaagtgggcgaaggatatgaacagacacttctcaaaagaagacatttatgctgccaaaagacacatgaaaaaatgctcatcatcactggccatcagagaaatgcaaatcaaaaccacaatgagataccatctcacaccagttagaatggcagtcattaaaaagtcagggaacaacaggtgctggagaggatgtgaagaaataggaacacttttacactgttggtgggactgtaaattagttcaaccattgtggaagacagtgtggcgattcctcagggatctagaactagaaataccatttgacccagccatcccattactgggtatatacacaaaggtttataaatcatgctgctataaagacacatgcacacgtatgtttattgtgacactattcacaataggaaagacttggaaccaacccaaatgtccaacaatgatagactggattaagaaaatgtggcacatatgcacaatggaatactatgcagccataaaaaaggatgggttcatgtcctttgtagggacatggatgaagctggaagccatcattctcagcaaactatcgcaaggacaaaaaaccaaacaccacatgttctcactcataggtgggaattgaacaatgagaacacagggacacaggaaggggaacatcacacaccggggcctgttgtgggggtgggggtaggggggagggatagcattaggagatatacctaatgtaaatgatgagttactgggtgcagcacaccaacatggcacatgtatacatatgtaacaaacctgcacgttgtgcacatgtaccctaaaacttaaagtataataaaaataaataaataaataaataaaatacagttttgttttgtatcatgaatattgttgctacttgggaaaaacatgtttaatcaggcactaaaggggcagctgaagtgtttgatggtgattctcaaagggattcttggacccctcaagagttttagaagatagtgatgctagtattttattatgtataattatactgtaaaatacatttttgatacattataattacttctgtttatgacttaggtagtttttgccttgcaaaagggagatagggaaagaaagtttacttaaataattggaagcaaagggggaatgaggagaaagctaatgaagatgtgaatatttgtgaggaaaattgcctgtaagtgtgaatagggtgtgaatggagagtggatgtgtctggcagcacctcttcttattcttatcatcttactggggtgattgaagttgcaaacacatggcccttcacttcttttgtaaacggacataattgatccaacacagcatgattgctttctagtgcagcaattttcagaatactgccttctcaaagatatggttctcctgattgattatgaaatgagataaaaatataagtccttggtttaataagtgatgaacaagcccataaaatactaggtttttacttttgctagagtaatctactaagtgagttattaagggcctttctgaactcaagttagtgtgtcaccatagactctaattagtctgaggactctaattagttctgctaaaaagtctcactgctattcggtgacaaagctcctataatgtggcatgcatgtaggcagttgtagtttccaaaaaagaaagaagtaggtggagcataggatgctcaaagtagacaatgatcaaagacttttgagagtcatcagtctaggaaagttattctcaaccctggctgggtatcagaattgtctgtagtgcttctaagaattatgagttatggccagacgcggtggctcatgactgtaatcccagcactttgggaggccaaggcgggtggattacaaggagtttgagagcagcctccccaatatggtgaaaccccttccctactcaaaatacaaaaattagccaggcatggtggggtatgcctgtagtcccagctactcaggaggctgaggcagaaaaatcgcttgaacctgggaggcagaggttgcagtgagccgggatcgcaccactgcactccagcctgggcgacagagtgagactccgtctaaaaaaagaaaaaaaattatgagttgctggactgcatgatgatctactgaatgagaatccattctccccccagtaaacttttcctttatctcctttatctcattggcaggcactcattcacaggtccactcaagacagtcacggacaaaaggaaacaggattgtgaggatttagccccatggggctagagcactgctactgaaaaaaaaccaccctaactatatttgcagctttacggtgtgtaaaacttcagtttaaaaacaaaagggaaaaaaggtctctgccttcaaagattataagctattcattcaaaaagaccaaacattgtaagaaataactggataattaatccataaagggcaagagaagtagagccagcttttattgagtacctgcctacctgtgtgctgtgtgctgtgtgctgggtgagtactttatatatgtcacttcctttaatcctcattttaatcttcagaggtcagtagtgtcactggcattctacagattaaaatactgtagttgagggaatttaggggatttgaattgcatttcctctctagaatggggtgagacagaagtggtgtccttctttcaggcatctaggtttgtttctttggggtgtgtatgtgtgtatgtttccatgtgtgtggcagcttaccaggctatgtcccaattaataaggagatgtatcatcctcattccagtttttcaaatgtgacttgaccaaaatgcattctattcctattctttgagtttatatgccagaaatggagtgggcatgtgtgtcttctcaggactaatccatgcatgaagctctttgaatcagcacaatattgtacagcctagttgcgttctgttcatcaagcatcggtcgatgatttattgacaatgcaaacaagtggtctgttcatgtgagttcatgatgatttgtgagtgcttcctgcccatctgctctctcattttaagtgtgctctgtaatataaaaatgatagtcatacaataattctattggggtagatctgtaccactacccagagatatttgtttgacttttactattattttacaaaatgggaatttctttcacaaagaagatgagttcattgtactttggctttttgtaagagaaagtgaatgttgtgacactgacatgaataaatgaattcatgttttctgatcccgtggaaaggaaagaatagaataatatcagcacgtggatctcataatgaaaggggagtaaagtgagtcttcagaaacagacttaaaataagctcaattcattgtaattagaaaatggatcttgaaagggccttgccaaaaggcgatgatgtgatgttggggtgtagaagttttttgacagtggactcttttatcacagaatgtgaggtgaggcagaggaaatatgattcatgttatagtgctttagttattgattacataggagtttgctttctccagctcttgttcatagctgctaactggcatacagaggaaatattgtttacttatttaaataatttttaagatagtgaaaattctgtatgtttggttaaattatacttggttgtttgcataggctgtctctccctgagacgctcacctcacttctctatgggtcagcgaaacacataccctgtgtaatcacctcccctataaaaccccatggcaacctcttccaacaattcatcctttgcattccatccaagtatgtcttgttatatccatagcatttagtgcatttattatttcctctcctgctttcctctactagattttgagagccttaaggactagagagtgactgattcatccttgtttccccagcaccctggagcaaagagcccagcacatagtagttgcttgtggtgaatgtaattcagggtgtcttaggactatcctgctcattatgaatagaggataaaaacagatttctaagttctccatctgccataaaattctgggaagaaaaaatatgaagtattcctttctgcacacacagaagtcttccattttgcaattttctatctagtctgctgtcctttctctctcttctttatcagggctacacatcctctctcctggccagagcgtcatttgaggcgtgcttatgcagttctcattgtcttcaattaaggtttgggactgagattaccagcttggcttggtaaccctgttcacttattaaaaaatcagtcgatccttcatttttatgaaaagatgcaatgcaaaataaccttgatttagaatttaatgaggctgacatttaacctgagttcagttaggaagacaaacaaaaaacacagacaaagttgagagaaggaaaataattacctacttgaatagtgtgggcaattctccatccatatgccccaggagaatatgaggtgggagatgcatgaattacctgaaatttcttttagcctctgtttatgattttagtctttcaagatgcaggtatgtttttcaggccttgtggtccccaaacacaaggaaactttctttatctgatggtcaaaagaagtgacgacctagtccttagtaggagaaaaatgtgcctgcatggactctttgtgagacagtgttgttggatactttatgaacattttaagggattctcatgagtaattttgattatagacgatttttactttatgcattgactaggaaccaaatgcaactttcttagagagacacaaaattcattgtccaaatagaccatagggtcagcaggctttgtaaacatgttttgtatgtgcctaggggttgagagcaggggcgggagaggttctggtccgttcatcaaaccaggggctggtgttaatgtttgatcaacaaaacacatgtaggcctaggctctgatctaggtccaactgccaacatagccttttcatgcctgcctttcctacttcaggtagagagaggagaaaaaacctattgaggaaaaaagaaagaataatattagcccaagcagtggttctactcacttaaggagaatggagtatgtttatttaattttaactgaaaagtcctggccaatatttctaagcctggcttgggataacagaatgaatggccttgggggagagggaggagaaagaagatgactgattttagtgtctgctttatggtgtgtgctgtttaatcctcatgacaatcctaagtggaaggaagaactccccatgttaccagtgacgcagcggaagcccaggtgctactgaaggtcacgcagtcagcattgacgaagtctacactagaatccaggcctgacacaacccaaagtctgtattttttccctctgcagtctcttaaaattggcaaaaggtaaaccttcatgcgaccctagatttgattggaacagcagatttaggggtcatgcaacaggagaatgagtggattataagtttttgagtccccagatctttggggagaaaacccaattctgttgaagtaggagctgttcaattggaggtgagatttttagtagggatttctaatgcattcttttttcccattgatggttgttaatacttcccctacacacacacacacacacacacacacacacacacacacacaagcataaatagggcacacgtattctcccatgtaagggctgctgtcccttctccctcccacttatagcgatgtgtgcctctctgtagctgaaggttgccttgtattaggacactgactgatgagtactccccaccagggtccggagagtgtgcttcattcacctttcagcctctcacagttctggcacaggggagataaagatgttgatggtttgaggtgctttttggtaaataacataggcaaacacttgacacccctaggctaccacctgtcctgttgtgtggatacctattcagtgaagccagataacttttacaaatcacaatgaatacatcctcagcagagccagttgcctgagggaggttactgaatcttctgggagtcgtttgcaggcctttagacactgggctcctttctggaccatgcccaaactagtgacagatgcagtcagagtagcagaataaggaagtctaaagtcacccaagcctcttagttcttgataattgacatgtccagcatttcttgaccatcagtagaaaatactaaactttacagtacataaaataatcaattcattcctctgatggggcaactatttaagtcagtatggaactctatctttctgattgctgcattagtccctttttttttgtttattttgcttcttagtagaaaagaaaaatctaaaagattctcattttaagtgacttgagctatcagttaaattttaaaagccaattattttgaagcagtagagccttacgaattctaaagtcacacactggaagccaaactatctagagtataaatatttccttttgagggggatactgacagattcttctattttatcccaattccagttcctgacctccactcacagacagggaggcaaggggaaggctcactaattggcaaggctggacaagcataaaggattcagtgcataaagaatcaagcttctgatcctctcaagaggtcacacgcagagtgtctatgtgctggacagctttggctgtacacaccagaagtgttccaggcgtaaggtttttggcaagtctcgttgcctacgttcaagtcctctctgagtcgcttactagtgtgtaaacatagctgagatatataatgtttctaagcctcagtttcactgtctgtaaaatggcaatgacaataactgtacccacctcacaaggatgctgtgttgtgaggtgtgaacgagccatttgtgtcagaacatagcacagtgctgggctcacactaagcattccattcatgtcagctactagctctttggaacttttcaactttggtccctagggctacattaaccctctttcctgccagacaataatctgaggttggttgctgctttcagaagaaacagtgtttgaaagctaagaaaaatgtacctagaaatctaatttctaatttcattgtcatgccttaacagaacacccagatgccttaaaagacttttacaaaatgcaaatttctgatccagaaaacttctcagccatagtgccaaagaacattatcagacccaattccctatatcccaacaaaaccactccccagtcacagattatccgacacaatttcattggggttctcaaatggcaagagtttgtttaaaatgcaaatctctgagccccaccctcagagaggccagcggggcagtggaatatgcactgaacacttcgggcactaactcgtgtgccaatggttgcacttggacatatactactctaggcctttgggctcctttcgtccctgcagcaccttctgtcctcaagacaggggctctcttgttttcctcatgcgagagctgttgcccagctagtccatcccactgaggacaaactctgactcaccttttaagatgtagttctctggctaggcacagtggctcacacctgtaatcccagcactttgggaggccgaggcaggtggatcacgaggtcaggagtttgagaccagcctgaccaacatggtgaaaccctgtctctactaaaaatacaaaaattatctgggtgtggtggcacacacctgtaatctcagctactcaggaggctgaggcaggagaattgcttgaacctgggaggcggaagttgcagtaagccgggatcacgccactgcactccagcctgggcgacagagtgagcctctttctcaaaaacaaaaaagaaaaaataaaacatgaagttcccaaccatgtgctgtgtagtgagcaccatggtggccctgcagtgtacaaaggtgaattggccatggtgtgtgttggcatggagctcccagtccagctaagaatacccttcagggccaagctgactccaccctgtttcctgaggcccagtcagcggtcccagcttctggtctgtgggctcacctagtttaaagacccccttgagcctcaaaggatgttcgaagcatgattcagttggggagttattggtcaacatggtgggacaattcttcactgtgtgggactgccctaaacagtacagggtacttagcatgtctgccctcccaatgctgagtaccagtggtgctccacagtcactgtgacaatcaagaaaagtaatgattgccacatgtttctgaatacccctgacctctggggaataatactgccccaagttgagagcctctgtccggtttaggtctttctcctcagtccatacctctgctacctccttaagggaccagttccctccaaggggcatgctttcttagaaaagtcatttgatggccgggcacagtggctcacgcctataaacccaggacttcgggaggccaaggcgggcagatcacctgaggtcagaagttcgagaccagtctgaccaacatggtgaaaccccgtctctactaaaaaaataaaaattagcaggacatagtggcatgcacctgtaatctcagctacttggcaggctgaaacacaggaatcgcttgaacctgggaggtggatgttgcagtgagccaagatcacaccactgcattccagcctgggtgacagagcgagactccatttcaaacaaaacaaaacaaaacagaaaagaatgtcatttgacagtgtacaaagtttatatattttaacatacaaatgaagttgacatggtatcaaccaaagggaaagaagggccattttgtaacaggcagaaaccagttgggatttaagaagcattttaattacccttactttttttctataaaggaaaatacttttatttctttcactgatgtgccggtgagagtcttagcaggcttgcctttgtaggtaaatatgatggcacttcccaatcatcatgtattgggatgtgaagttgtgtggagtctgaggctgacccctggtagtgtgaggaccttgggggattgccttggaaaatacagggtccagcccaaggctctggctttcagggtcgggggttgagatgaatttgtcacagctccgcctgagctcaccacactgggaagtcaaacagaggcaacagcttctgtttgctaagtgttaccacatgctaggcactgtgttgagtatggtgaaggacctcttaaatcttcagaacaaccgacgtttcagcattttacagctgcaaaaactgagtcttagcaaacatggtcttagagccacgagaatggacctgggacttaaatcccaagtctagagcctggacttgaccacagcagcatccagcttctcacccatctttcgctcaattcatccctttaatcatttattttaggattcagtttgattcccccaatctcaaaactttcaaggatgaacaatacttctcacacaaacacaccttctaccgaatgccaggaggggtctgcacttagattcctcagctgtcacagtgccattgagtctgaggctgcctgactgcttggttgtggttttttgacacctggcatttgtgtttaacagccccagtggttgagaagcagaggggacccacactggcagaggtggagggaaagaggagagggtgtagggaaagaggagagggtgtagggaaagaggggagggtgtagggaaagaggagagggtttagggaaagaggagagggtgtaagggaagaggagagggtggagaggtagaggggagggtgggggaaagaggggagggtggagagatggagaggagggtggagggatagaggaaagggtggagggatagaggggaaggtggagggaaagaagagagggtgggggcggttccaagatggccgaataggaacagctccagtctacagctcccagcgtgagcaacacagaagatgggtgatttctgcatttccaactgaggtactgggttcatctcattggggcttgtcggacagtgggtgcaggacagggggtgcagcacattgagcattagccaaagcagggcgaggcatcgcctcacccaggaagcgcaaggggtcagggaattccctttcctagccaagggaatctgtgacagacagcacctggaaaatcgggtcactcccaccctaatactacgcttttccaatggtcttagcaaaaggcacaccaggagattatatcctgcgcctggctcagagggtaccacgcccatggagccttgctcattgctagcacagcagtctgagatcaaactgcaaggcagcagcaaggcttggtgaggggtgcctgccattgctgaggcttgagtaggtaaacaaagtggccgggaagctcgaactgggtggagcccaccgcagctcaaggaggcctgcctgcctcagtagactccatctctgggggcagggcatagctgaacaaaaggcagcagaaacctctgcagacttaaatgtccctgtctgacagctttgaagagagtagtggttctcccagcatggagtttgagatctgagaacggtcagtctgcctcctcaagtgggtccctgatccccgagtagcctaactgggaggcatcccccagtaggggcagactgacacctcacatggccggatacccctctgagatgaagcttccagaggaatgatcaggcagcaacatttgctgttcagcagtattcactgttctgcagcctcggctgctgatacccaggcaaacagggtctggaatggacctccagcaaactccaacagacctgcagctgagggtcctgactgttaaaaggaaaactaacaaacagaaaggacatcgacaccaaaaccacatctgtacgtcaccatcatcaaagaccagaggtagataaaaccacaaagatggggaaaaaacagagcagaaaacctgaaaattctaaaaatcagagtgcccctcctccaccaaaggaatgcagctccttgccagcaatggaacaaagctggacagagaatgactttgatgagttgagagaagaaggcttcagatgatcaaacttctccgagctaaaggaggaagttcaaacccatcgcaaagaagctaaaacccttgaaaaaagattagacaaatggctaactagaataaccagtgtagagaagtccttaaatgacctgatggagctgaaaaccatggcatgagaactacgtggcgaatgcccaagcctcagtagctgattcgatcaactggaagaaagggtatcagtgatggaagatcgaatgaatgaaatgaagtgagaagagaagtttagagaaaaaagagtaaaaagaaatgaacaaagcctccaaggaatgtgcgactatgtgaaaaaaacaaatctacatctgattggtgtacctgaaagtgacggggagaatggaaccaaattggaaaacactctgcaggatattatccaggagaacttccccaacatagcaatgcaggccaacattcaaattcaggaaatacagagaacgccacaaagatactcctcgagaagagcaactccaagacacataattgtcagattcaccaaagttgaaatgaaggaaaaaatgttaagggcagccagagaaaaggtcaggttacccacaaagggaagcccatcagactaacagtggatctctctgcagaaactctacaagccagaagagagtgggggccaatattcaacattcttaaagaaaagaattttcaatgcagaatttcatatccagccaaactaagcttcattagtgaaggagaaataaaatcctttacagagaagcaaatgatgagagattttgtcaccaccaggcctgccctaaaagagctcctgaaggaagcactaaacatggaaaggaagaaccagtaccagccactgcaaaaacatgccaaattgtaaagaccatcgaggctagaaagaaactgcatcaactaacgagcaaaataaccagctaacatcataatgacaggatcaaattcacacatcataatattaaccttaaatgtaaatgggctaaatgctccaagtaaaagacacagactggcaaattagataaagagtcaagacctatcagtgtgctgtattcaggagacccatctcatatgcagagacacacataggctcaaaataaagggatgggggaagatctaccaaggaaatggaaaacaaaaaaaggcaggggttgcaatcctagcctctgataaaacagactttaaaccaacaaaaatcaaaagagacaaagaaggccattacataatggtaaagggatcaattcaacaagaagagctaactatcctaaatatatatgcacccaatacaggagcacccagattcataaaacaagtccttagagacctacgaagagacttagactcccacacaataataatgggagactttaacaccccactatcaacattagacagataacgagacagaaagttagcaaggatatccaggacttgaactcagctctgcaccaagcggacctaatagacatctacagaactctccaccccaaatcaacagaatataattattctcagcaccacatcacacttatttcaaacttgaccacttggttggaagtaaagcactcctcagcaaatgtaaaagaatagaaattataacaaactgtctctcagaccacagtgcaatcaaactagaactcaagattaagaaactcactcaaaactgcacaactacatggaaactgaacaacctgctcctgaatgactactgggtacataatgaaatgaaggcagaagtaaagatgttctttgaaaccaatgagaacaaagacacaacataccagaatctccgggacatatttaaagcagtgtgtagagggaaatttatagcactaaatgcccacaagagaaagcaggaaagatctcaaattgacaccctaacatcacaattaaaagaactagagaagcaagagcaaacacattcaaaagctagcagaaggcaagaaataactaagatcagagcagaactgaaggaaatggagacataaaaaacccttcaaaaaatcaatgaatccaggagctggttttttgaaaagatcaacaaaattgatagaccactagcaagactaataaagaagaaaagagagaagaatcaaatagacgcaacaaaattgataaaggggatgtcaccaccaatcccacagaaatacaaactaccatcagagaatactataaacacctctacacaaataaactagaaaatctagaagaaatggataaattcctaggcacatacacccttgcaagacacatacacccttccaggaagaagttgaatccctgaatagaccaataacaggctctgaaattaaggcaataattaatagcctaccaaccaaaaaaagtccaggaccagacggattcacagccaaattctaccagtggtacaaggaggagctggtaccattccttctgaaacgattccaatgaataggaaaagagggaatccttcctaactcattttatgaggccagcatcatcctgataccaaagcttggcagagacacaacaaaaaaagagaattttagaccaatatccctgatgaacatcgatgcaaaaatcctcaataaaataccggcaaactgaatccagcagcatatcaaaaagcttatccaccatgatcaagtgggcttcatccctgggattcaaggctggttcaacatatgtaaatcaataaacgtaatccagcatataaacagaaccaaagacaaaaaccacatgattatctcaatagatgcagaaaaggcctttgacaaaattcaacagcccttcatgcgaaaaacactaaataaattagatattgatgggacgtatctcaaaataataagggctatttatgacaaacccacagccaatatcatactgaatgggcaaaaactggaagcattccctttgaaaactggcacaagacagggatgccctctctcaccactcctattcaacatagtgttggaagttctggccagggcagtcaggcaggagaaagaaataaagggtattcaattaggaaaagaggaagtcaaattgtccctgtttgcagatgacatgattgtacatttagaaaaccccaaatctccttaagctgataagcaacttcagcaaagtctcaggatacaaaatcagtgtgcaaaattcacaagcattcttatacaccaataacagagagccaaatcatgagtgaactcccattcacaattgcttcaaagagaataaaatacctaagaatccaacttacaagggatgtgaaggacctcttcaaggagagctacaaaccactgctcaacgaaatagaagaggacacaaacaaatggaagaatattccatgctcatggataggaaaaatcaatatcgtgaaaatggtcatactacccaaagtaatttatagattcaatgccatccccatcaagctaccaatgactttcttcatagaattggaaaaaactattttaaagttcatatggaaccaaaaaagagcccgcattgccaagtcaatcttaagccaaaagaacaaaggtggaggcatcacgctacctgacttcaaactatactacaaggctatagtaaccaaaacagcaatggtactggtaccaaaacagagatatagaccaatggaacagaacagagccctcagaaataataccacacatatgcaaccatctgatctttgacaaacctgacaaaaacaagaaatggggaaaggattccctatttaataaatgatgctgggaaaactggctagccatatgtagaaagctgaaactggatcccttccttacaccttatacaaaaattaattcaagatggattaaagacgtaaatggtagacctaaaaccataaaaaaccctagaagaaaacctaggcagtaccattcagcacataggcatgggcaaggacttcatgtctaaaacaccaaaagcaatggcaacagaagccaaaattgacaaatgggatctaattaaactcaagagcttctgcacagcaaaagaaactaccatcagagtgaacaggcaacctacagaatgggagaacatttttgcaatctgctcatctgacaaagggctaatatccagaatctacaaagaactcaaataaatttacaagaaaaaaacaaacaacccaatcaacacgtgggcaaaggatatgaacagacacttctcaaaagaagacatttatgcagccaaaagacacatgaaaaaatgctcatcatcactggccatcagagaaatgcagatcaaaaccacaatgagataccatctcataccagttagaatggcgatcattaaaaagtcaggagacaacaggtgctggagaggatgtggagaaataggaacacttttacactgttggtgggatgtaaactagttcaaccattgtggaagacagtgtggcgatagctcagggatctagaactagaaataccatttgacccagccatcccattactgggtatatacccaaaggattataaattatgctgctacaaagacacatgcacaggtatgtttgttgtgacactattcacaatagcaaagacttggaaccaacccaaagtccatcaatgatagactggattaagaaaatgtggcagatatacaccatggaatactatgctgccataaaaaaggatgagttcatgtcctttttagggacatggatgaagctggaaaccatcattctcagcaaactatcgcagggacaaaaaaccaaacaccgcatgttctcactcataggtgggaattgaacaatgagaacacttggacacaggaaggggaacatcatacactggggcctgttgtggggtgggggtaggggggagggatagcattaggagatatacctaatgtaaatgatgagttaatgggtgcagcacaccaacatggcacatgtatacctatgtagcaaacctgcacgttgtgcacatgtaccctagaacttaaagtataataaaaaaaaaaaagaaaaagggtggagagatggaggggagggtggggggatggagaggagggtggagggaaagaagagagggtagggggaaagagggtagggtgggggggtggagggaaagaggagagggttgggggagagaggggagggtggggggatggaagggagggtggagggaagaggagaggatggaggggtagaggggagggtgaagggaaagaggggagggtgggggatggaggagagggtggagagaaaggagagggtgggggggtggaagggagggtggagggaaaggggagggtggaaagatagaggttagggtggagggaaagaggggagggtggggggatggaggggagggtagagagatagaggagaagttggaaggatagaggggagggtggaagggtagaggggagggtggaaggaaagaggggagggtgagggggatggaggggaagttggagggatagaggggaggtgggaaaaaaagaggcctggagctggtgttaggaggccagggtctaaaccccacttgaaaacctacctggtggatgacatgcacagactctctgggcctcagtttcccattcacatataagatggggaggcctttatccacttccctaagagggttgttgtgacaattcagagcagtgttagagtccaaagtcgggtgaatgcccctggggagtgtacaggaccatcctttatagtgtgagtagaaagtcttagcatttttattttttactcaacaagaaattaggctttacaaatatttgatgtatggatggaccatgacatccacaatcagctgcgtgttctgggcatgtcctcaaagaaagaagggactttgcaaacgggaaggggttgggagctctatcctcattcattcccttgcagcctttgtgatgtttgattgcaatttgccacttctggtgaggcgggtacgcagaatacattatccagcttaaactcaacaaaccctgtttcaacaaactgaagaagtggcttaaaaagttttcatgaattaaaagctaattaaaatctataatgaacaatatccacataaaccaaaaaatggcagagttaacacttcactgggaagaagtttttgttgtcgtcgttgttgaatcagccccagtaagatgtgaaaaaaaaaacagactaatgatatctgacaagaagtcggcccaagaagttcaaaattatcaaggtcaggtgcagtggctcatgcttgtaatcccagctctttgggaggccaaggtgggaggatcacttgaggccaggaatttgcaaccagcctgggcaatatagtgagattccatctctactaaaaatcaaacagttcggtggctcacgcctgtaatcccagcactttgggaggccaatgagggcggatcacctgaggtcgggagttcgagaccagaccgaccaacgtggagaaaccccatctctactaaaaatacaaaatttgccgggcgtggtggcgcatgcttgtaatcccagctactcaggaggctgaggcaggagactcgcttgaacccgggaggtggaggttgcggtgagccgagatcgcgccattgcactccagcctgggcaacaggaatgaaactcggtctcaaaaaaaaaaaaaaaaaaaatcgaacaattagctggatgcttgtagtctcagctactcaggaggctaaagaggatcacctgagcccaggactttggtgctgcagtgagctatgatggcactaccgcactctaacctgggccacagagtgagcccctgtctcaaaaaaaaaaaaaaaaaaaaaaagaagaagactttttgaattaaagaaagatttacatctcctctcattaatagcactattgatttttatttgatttaacacattatttcattgttattacaaattatgtgttttaaatgcctattttgatgtataattctataatgtacacttagttcagtagtacatgtgtattacttgtatttatcatgtgtgaatatatatatatacacacatggtatgtgctcaaaatattttacagattagagtatgtgaaaaaaatttgaagaccactctgcataataaatgtgcaggggctggcccatgagacatgttcagtaaatgcttgtttccatcctctttctccctggaaataaagtcgatagtgtgtgtgtggaccttgcttattaaaggaaagtggctgatttgatttctggaacaaggtgcatctcaaactagctggcagcactacctcggcctggccccatcccagctgttcacaccgagttccagacatttgtaggagcccggacgaggccagctggctgcctatcagtggccttcttctgtcagcactacacagttgtcacggctcacatccaaccgccagacagccaagaaggagacgccaagatttaaatctgcagttcctgacctccgcaaccacacccgattctttggttggtcctagacaaaaacaacggttttgcagatttgggttctctttctcaaactgccttttgatgatttatttgtgagatatgattgctcctcttgcaaatcagagctggttgcagtagctaactaacatttattgagcgagtagtatacccaggcttcagctaagtgctttctggaattatttaattttcacagcaaccatgtagagtaagttctgccactggcaccactttacagataagcgaatggagacttagaaaggttaagtaattttactagaggaacataaactaacagtgaaagtgagaaatctcagagtctcattggtctgacagctatgtaaggaactgaggggatgtaccattgcaaatcgtcaaaatggaaataccccaaatgcaatgcaggactctggatgcgattctggaacaaagaaagaacacttgtgggggaaaaaaaatagtgcaacccagagtctttatttaacagtattgtatcaatgttaatttcttagttttgacaaatgcatcctggttatgtaagatgttaggattatgggaagctgggtaatgaatagatggagagtttctgcactatgtctgtactgtttttgtaaatgtacaatgattccaaaataaaaggtgtatttaagaaacagaaatgccaagtgtatatgtgtgagtacacacgtgctctcacatgtgcatgtgtacagttgtgcatatgtaagtctttgtgcatatgtaagtgccccttgctgcacaccccctgctgttctgtgtgtgctgctccactcaagcccctgggacttacatggatgtcagcgagaaggaagcctacacaactcacatgtgacatgcccgccatgctctcgtcatacctcacctgtgctgtagaacccctgggtcacaggtggcagtcttgttcccccataacaaatgccagaaaatgatgtgtgtgtgtgtgtgtgtgtgtgtgtgcatgtgcacacacgcatgcacgcacacacgctctggtaggggggtttcaggaagtcattcgtgaagatgcagtgtagcatccagaataaaataaccaatttacaccttaaacactcttctccagtaaggccactacagctgcctctgcttactaagtgcatttgaagagtcctctgctttatccgtactctatcctcctgaaaagaggcactgacctgaaagggaagcccaggagcttctaggcccagacttttgctttgtttctcaccatgtgctgtgtcaaaactgagagaatattttgatcaccttttagctaagagctatctcctgggcagcagcttaaggctagagtaaggacatttcacagtttaagagagagcagtcactccgccaaatggctctgaggtggccacaaagtgcttgacttgcaaaaaattgctccattaactagattcagggattttcaggatttatgggctaggctgtgctaatattactgtggtgcttctcagtataattgctagaggcctccagtgagcagaggaattgtgtgttcagtctgtcctgggtgacccttactgcgtagtcctagggagacaaagaaaacccactcaatccaggaggctacagaaatgatgtttgtggagatctcagtgggtatctaatctgtaacctcagggggagaactctagctggtctcagtctttgctggaaacagaacttactggatgtgtgtgtttactcactcattcatttatttgtttatttatttactgtgacagggtcttgctatgttatccaggctattcttgaactcctgagctcaagtgatcctcccacctcatcttccaaagtagctgagattacaggtgcatgctaccacacccagccatcattcatttacttattgagtgtctaccatgcaccagatgcccaggttaagcataaaggatatagagcaggacaatcaaaaagtctcagattcagaaggaggagatggataaaaaccagcaagatctaaagtagataatttgattatgataagcacaaataagcagagaatacattgatgtgatacagagggccatgtggggggcagtgtgattcctttagattgggtgaatcagggtgatggcttttcagttgacattggaagaatgaggaggaaggaggaagaagtggcagccgggtaggacagcaggtcttctctgtcccccgagttcttctgatgtcctgcacagaaacctgaggggtagagtagcaaaggagaaatccaagctcaggctgggaaagaagctcatggcaccaaggttagggcttgtgataacagggacctgcttcaagagaaagggaggtgggtggcagattggtctcatggctgccacccacataattctaaaggtctcccaatgggagaacagccaccctggtaagtgtccagcatcatacaaggagtctctgcccattgtgactcttgcttgagcccccacacttagccctcaccaagctgtgtgatttaggattcaggtgttagaacggagaaggcaccaggcctactgcaccatatcaatgaagcctttgctttggggaaaacagagctgggtacaaataccagtgccacccattcttccctccatgctctggacattcaacccatctgagccttaatcccttcatctgcaaagtaaggaccatgcagtcttcctggtagtgttgtaaggctcagatagaataaccagacagttccaggtgcatatggcactcagtgagaatccacttgctttatcctccctcactcccttccttcctccaggaataaagagtacactagttgaagaatatttctttgccttccttctttagcagctccaatcccagcctaacagcacaatgagcatcagatgtgcttttttgatgtttgaaatttatagtctctgttgaatgttggccaggacagcacttcgtcatttgaacaatttccattttccacaagctctctgtgattgatgacctaaccaggcacatggcattccgttccaccagcaatgtggccagtggggagatggctatgtcagtaacacctgtttgtggtagaccaacaatggcgccctaaaagatatatccgcatcaaatccctgggacctatgtgtgtgaccttatttggaagaggggtttttttttgcagatgcaattaggaatcttgagatgcagagaacatcctgtgctatccaggtgggccttaaatgcaatgacaactgtcttcataagagacgtatagggagatctgacagatagaaggggagaaggcaatgcgatcaccactaggtagaggttagagggatgcacccctaagtcagggaatgccagcagctgccagaagcttaaagaggcaaaggatgaattgtcccctagagcctccaaagggagtgtggcactgcttatgccttggctttggacttctggcctccagaactgtgagagaataaatatctgttgttttcgatgggcgtgatggctcacgcctgtaatcccagcaccttgggaggccaaggtgggcagatcacaatgtcaggagatcgagaccatcctggcgaacacagtgaaaccccgtctctactaaaaatacaaaaaagtagctggccgtggtggcgggcgcctgtagtcccagccactcgggaggctgaggcaggagaatggcgtgaacccaggaggcagagcttgcagtgagccgagatcgcaccactgccctccagcctgggcaagagtgcaagactccatctcaaaaaaaaaaaaaaatctattgttttaagccaaccagttcgtggttatttgtgtagcagccctagaaatgaagacagcctgcgagcaccttgccccacctggctgtaggtgacttttggtgccaccatttttgactcttgtggataaagagcagactatattctttttataagtaagtccaccttttacagaaaaattaatagccaggatcatggttttagaactcatagaatacactcctctcatcctctcattctttcccccacccattggcttataaacttgttcctatgaaataagtcagctgagttgagtttgtaaatgcatcttgaataaatgtgttgggtggggtcacaaacatgcagacacctgctggtgagtgttactgacctgcactctgaaaggcccctatattgatgatacttcttaatctcctatggctcttcttcagccctgggagcaggggagtgcagacttttgttcaacccctttcacagatgtgcacactgaagtcccagtgtgtccagtgacttgctcaaggtcatcagcactgtctggtggagctgggactcgaacccagtcctcctgctctcagctgtgggaaatggagacagcagttgccctggaagatgtttcctgtgctgcgtgtttgtggttgtctcaggatttgtgagacttactgttttcttgtgtcccctgtccctgtgacttatctttgtgcccactcagccatcaccacttccaacacacacccacacctgtggagagaatgcagcctcctagagctcatgtcatggcaggactgagggaagtagtcagttcttggtgctctctaatagggctctgaattgcagcctgggccgtgcccattcatttatgtattgtctatagctgcttctgtgttacaagaattgacagagactgggtgtggtcgctcacacctgtaatcccagcactttgggaggctaagacagaaggatcgcttgagcccaggagtttgagatgaacctgggcaacatgatgataccccatctctacaaaaaaaaaaaaaaaattagttgggtgttgtgatggaggctgagatgggatgactgcctgagcccatggggtcgaggctgcaatgagctatgattgtgccactgtctcaaaaaaaaaaaaaaatgttgacagaacaagttgattcaattatagacttgagtagttgtaacggagactataaagcctaaaatatttatagtgttaactttgataggacaagtttgccagctcctgcactagaggataaagattaacaggattgactccacatagaggagaggagaggaaggggcaaggatggaagcaaggagggagaagggttagagagaaagaaagagggaggggggtcactcagagacttcacaaagtatgttatttcctaaaaactgtaatgcccagtatctagtgattacctgtggcactgtcagccttctgcctgggaacaggaatcttgcaaagatcaaatgcagggcccagagccccaggactctgcattggcattcgtcagtaagttttgaaggaggcagacatctcaaaaccatcctaagcataaggcacccagctggtgatttgaagatagccatcttccccattactagttggcctcactttaaaaaatgttgtttcttggatagcatttttctttcacaagttggtttgctttcacatgtcaaaaaacaaaaccagggctgggcgcggtagctcacacctgtaatcccagcactttgggaggcgaaggtgggtggatcatctggggtcaggggtttgacaccagcctggccaacatggtgaaactccgtctctactaaaaaaaagaaaatacaaaaattagccaggcatggtggcgtgcacctgtaatcccagctactcaggaggctgaggcaggagaatcacttgaacccgggaggcgaaggttgcagtgaaccaagattgtgccattgcactccagcctgggcaacaagtgtgaaactctgtctcaaaaaacaaaaaacaaaaagcaaaaacaaataaacggaaagagagagagaggagagagagagagaaacacataccatttgccatatttgtggtttctcattcttgcgctatttttttaaacctttcattacattaggcctttatcagatattagcactggttcttcagttttccccctgatcaggaacttccctgaaataaatgctggtaagatcgtggaaagttcccaggagaaggatagaacaggtgtaccccagggaggctgagccagtacagagagacctatgggtttcacgggccctcagtagaactgatttcctctccttgtctcaggttgtcatcagccactgagcaagaccgaataagggatctcgtgaggctttggagatggatgcaggatctgttgcctgcgattcaaagctggtggaggacttgcttaggtcatgttaattagtttttctcagctctcaccaggtgtcattcatggaggttgcataaaagaaactcatacccagggatgagctttttcttaaatattacctttctgaattttgaaatttagtgtagcattgagacatttaaacacatttttgaagcacaaaacttatttatcctagttcaaagccagatttggtttgacctgtcttggtggtgttttctgtggttctgagatccaacccccaacttcgtcccttttgacctagtttatcacccatgtccttgggttgaaaatagtagtgtaatcctaagagaaggggcctgaaaggaagggaagagaaatcagatgtcagctggtgaggatgagaaatactgcaacaagggagcagcattgacccttgagagctacatgctaggtagagtcaagctctacttgccctaagtcaaaaatatcattgacttgtggctaaagcccagactttgaagagcaaagaaagcaaggatttaactgcaaaaatagaaaagtggctgacccaatgctgaggcttttaacaaaatttaccaaatagtttatttcagactgagaaagaaagagctcaaacaagcttaagcagcagcaaatgctatcagcctggaccatgagattgcatgtgccctgcagtgatcttccaccttgactgacattaaaactacctggtagtggccgggcgtggtggctcacacctgtaatcccagcactttaggaggccgaggcgggcggatcacgaggtcaggagatcaagaccatcctggctaacacggtgaaaccccatctctactgaaaatacaaaaaattagccaggcatggtggcgggcacctgtagtcccagctgcttgggaggatgaggcaggagaatggcatgaacccgggaggcagagcttgcagtgagccgagatagcgccactgcactccagcctgggcaacagagggagactccgtctcaacaacaacaacaacaacaacaacaacaacaacaaaaaaaaaaaaacactacctggtagtgtttacagccttgagtgcccagaccaataagatcaaaatctctgaaggtgaggcctgggcttggtgctttttgatgatcctcaggtgatcttaatggtcttccagggttgagcactgtggggaaaattgaggccaagatgtggaggcatctaactggctcgtgcatgttaagaactggatgagatgggaagccagacattagaaataatggggtcagggcaccacttacatggtattaatagccagaggtcttgaatcttcctccagactacagtgaagagagatacacatgttatctacctggtgatagataccaaagggaagcaaagtaccacactgaagcaaagtaccatggaaggactgctccccacttttgatgcatgataaagaccaacctgcctgcatgaagatgatggtgcacttctcctgaacttcaccatcatgatcacagtcaaagccagtgatgatggagtataatcacaccagtaaatgaagttcccctgctgtcttctgactcacttctaagtggcctggaccctggtggttaagaaaagtaaacccccaaagcagtcagtcattgtcggtttgctaacttgagcatcctgaaattaaaggactaagtactttaactgggtcacctctattagtgggtaaaaagctgtgtggtctttgttcacttccttaaaatgctgctatacgtgatggcaagcaacagaactagccacgagaaagcaacatggaaaccactgaagtcaagacttaatcctacctggttccccatcaataggtaaaacaaagtggttctgagcacaaactctgaagccagatgatcagcttttaaaaaaaaaataattaaagaatatttatttatttatattttattttagattcaggtggtacatgtgcagatttgttacatgagtatattgtgtgatgctgaggtttaggcatctaataatcctgtcacccaagccatgaacatagtacctgataggtagtttttcaacccttgatcccatcccttcctccctccttttggaatgcccagtgtctgttgttcccacctttgtgtctgtgtgtacccaatgtttagctcccacttacaagtccatgttgctgcaaagaacatgatttcattcttttttatggctgtgtagtattccatggtgtatatgtaccacattttctttatccaatacactgttgatgggcacccggttgatttcatgtctttgttcctgtgaatagtgctgtgatgaacatacgagtacatgcccttttgatagtatgacttatcctttgggtatatatcagtaataggattgcagagtccagtggcaattctgttttcagttctttgagaaatctccaaactactttccacagggcctgaactaatttgcactcccaaaaacagagtataaatgttcccttttctctgcaacctcaccgacatctgttgttttttgacgttttaatagtagccattctgactggagtgagttggtatctcattgtggttttggtttgcatctctctgatgaatagtggtgtagagcattttttcatatgtttgttggctgcttgtatgtcttttgaaaagtgtctgttcatgtcccttgctcactttttaatggggttgttttttacttgtcaatttgtttcagttcctataggttctggatattagtcttttgtcagatgcatggtttgcagatattttctcccattctgtaggttgtctgtttactctgttggtagtttccttttgctgtgcaaaagccctttggtttaattaggtcccagttgccagacggacagctttgaattctggtcttaacacttcataactgggggatctaggggcaagttacctaacctctctcagcctcagtgtcctcatctgtaatggagggataatagaagcttccccccagggttatagtgagggttgatgaggtagttcatttaaagcactcagaactgcgcgtggcacctgtaaacactcccacccccagtaccttttcacaagtactattaggatgatgctgttagcagcaattatcagcacctctcatctcaagttatattgctagtgacaaaacctttggcatttcagtgtatagctttccaatcttttccataactgtattttttcttataaaagtgagattatactgagcatactctttgctttttaaactgactatattgagaatatctttctatttcatgtaatctacagcttcatttgcaatgactgcataatggtgcagatatatcatagattatttaaccaaacacctgtggtttaatacttaagtctctctcttttttaaaagcaatgctgcagtaaatatcattaagtaaaagcactgctcattggcataatttcccctttagaataaattcctagaagtgaaatgtgttgttcaaatcgcatataaacttgaaagtgtttgctattctatatgactgccaaattatcctctagaaagattctaccaccaccagcagggaataaaaagtcagtttcccctcactatacttgacactgggtattacagtttttaaactgtaatcttttgtatttgttcttgacctaaagctgagctctgctgtttggggcttggcttctctgaacttggtgctgattcttgctttaactggagcttcctactggagcatcctaggtgggctctcactggctcaaacaaccctatgaggctcttcttagtcttctaggactagagcagggctcagccaagcacatggtgctggcaggacacttggagctgtccctataccagcagcaatcttttgtcttgcttatttaattaccttatcctaaagtacgtctttactagaaatttgctgtcctcagtgagaagcagtacctttcccttgttccctgctgaaccaccagggtcactaccagcagatcagagccacttccctgtccctgggggcatcgtcttagactttggtcaccaccaaagaggagacataagaagaagggcaggaagaggtagcattgagcaagagctctggatttgccatcatcagctgaggattctgaattaggaaacatatctatttaggtttaaactacaaaatatgcaagggttcctattccgagcctctcagaaacatccctctggccacaggcaactgtcactggtgatggttattctctcagaagatgctgaggatcagggtgtctaaggagtagctttgctttaatctgagcttggtatattacattttccatgttagcctacctaatagggtgggttcacatagaaatactagaaaacacagaaggatataaagagcaaagatgaaagcattccaaatcctaccatctagatacaacctatgttgatatttagcatgtatgcagaggatagatgctatcctgtagcatgatcatttatatgcatgtgcgtacacatgcatttactttttataaaaatgatataatactgaacatgctattctgtagtcagtttttaaaagaatgtatctttttttttttttttttttttttttttagatggagtcttgctctatcatcaggctggagtgcagtggcacaatctcggctcactgcaacttctgcctcccaggttcaagtgattcccctacctcagcctcctgagtagctgggactacaggtgtgtgccaccacgcctggctaattttttgcattttagtagggacagggtttcacaggttggtaaggatggtcttcatctccagaccttgtgatctgcccgcctcggccccccaaagtactgggattacaggcgtgagccaccatgcctggtgcccccccctttttttggggtgggggaaacagggtctcactgtgtccccaggctggagtgcagtggcacaatctcagctcactgcaacctccgcttcccaggcttaagcaatccttccatttcagcctcctgagtagttgggattacaggcatgtgctaccatgactggctaatttttgcattttttgtagagatggggtttcaccatgttgcccaggctggtctcgaactcctgagctcaagcaatctgcccgtcttggcctcccaaagtactgggattacaggcatgagccactgctcccagccttaaaagaatttatctttaatggctgtgttttatttatacattttcagtcattcattatcaataaatactgattcaggcccagtatgtgttaggcatgattctaggcaagagagagaaaccatgaatgagagacatggtctctgcccttggggagggtgtaatgaagttcgtcagttttgtgctttgtggtttctttctatgcgttatgtttttaaagtcctcttccatcctaaagtcagacaatcactatattttctcatgttttcactttttacattgcctgagtccatctagaaattgttttggtggatgaaaaattttctacttttaaaccattggaggacagcaatgaccacaaaaggattaaatcctctttccttatagacaagtgggcacaacttggctatgcagtaattctaacatcagcagtgcaaagaagggaagtacagtgttgattcttcatgggagactgatggaattataatagacttctgttcttaaggtagaaaattatcatttttttaacctgaaaagatagagtaatagtctatgataaggacaaattaccccaatatgtttttaaaacattgcaattattaacaaagtggtagtttctttcatttaaaacccccttgggccctaaagatatagctaacaagaggaaaaactgtcaaaactcttattaggtggttgagtttattttctgctcacaattgtatcatttaaaaccctgagaaactgttttttggagagcaatttgtccctattagagttttatgtgttcaaatccttgacttagcagttctgctggtagaaatccaccctatgtatggaatcacaaaagtacgtctaagatgaacatagaggaagattcattgcagtcccgtctataattgcaaacaaagcactgagaaccacctaaattatctattagcagcagactgctaaagtaagttaagctacatctgtgaatcgccatgccgtagttgcaaagaatgtggtgggattccatgtgctgaatgaaatagtaaaatctctaagatacatcacgaagtgaagaaagtaagctgaagggcaggtcttttgtgttaagaataaaagaccccaacttatgttggtgtatccattttttcctgtaggatgcataaaggactaataggaattgttgcctgaaggaacaaagctggtagggatgaggtgaagagaaagtcaaatgttcattttattcctgtgtggatggtgtgaatttttctaccctgcatgtttattacttttatttatgttttgtaatgcttactccatttatctaggcagggagattatagacaattggtgtttccttctttatacttttctatattaaaaaatgaatatagatcagaaatgttcaccagatactggcatctaagaaacaaacaaaaacatgatttgtcaaagtcagaaaaggagtgtatgtctctgtttggaattatgctaatttcttggagtttgcgttcctttgttgtcatcagaatgctgcacattgtgttctctttctatttttgtgcacactatcttgttttgtatttccaaccacgacagctatgttcagttgtgccccatcccctcccctgttctgtggcctgcggtgctgagaactgcgagcagccaatgggactgctgcttactgtgaggtccatgcagtgtccacccccgcttcctgccctgagactgcctccaggcctggcacgtcttcctaagacaggcctatcaacccagtggatccttctgccccttcctcctcctgtcctccaactttagggagccatattctgatatccagagatcctggatttagagcatctcctccattcttggtaaattgagaaccttcccaactgctgcctcatctgcagtagttcctttcagatgaaaagttaaaatgggagagaaatattttgcatttgctcttttcattagactattcgatttctatgtaaatgtcttctacagggattgaaagaaatgaatatattggttcaccagacattgctgaaggttccaacacagccttgacctatttttgtttgaaattgagaaatgctcacaaatgtaagaggcctccttttttggagattggagggatttgacatcaagatgttttgcattttcaacagctcatttgccctggatggcttttggcagataaatgtggaggtggcagtgtaataggtttcatgtgtccagagtggaattcacccagagccaaacaaaagctagtagctctgaacatgtctcttttcatggtaaagtactctggagtgagactgtttaagtttcaacccctgtttggccacttcttagctcaagggcacttcccttacagtagctaagtttaggttgtttcatccataaaatggaagattttaaagtatctacctcaaagtgtgatgaggattaagtgaaaaactgcggggcaattcttactataatgcctgacatagcaaggcatcaataaactcagttgccattattattcttaccattatggtttataccactaccatcattgggattattaggttcaaccactacacaactgaattgttgttgcatgagtaaattgcagttgtttagacaaaatcctaagccaaaaacttcgtgctaggtagaaaggaagcaccttcatttattaagtccctgcactctaccaggtgatgtgttagttccatctttgctgtatctcatttcaatcctgcagtagcattttgcaggtagttctatttcagtatttcagacggagttccaattgtttgatgcttactagccatgtgaccctgtctctttatcttcctgtgcctcagttttctcctctgtaaaatggggataatgatagtacctaactcattaggttgttgtgaagattaaacatgttaaatcacacaaaacagtgcctggcacacagtgaccactatgtaaatgtttgctagcattactttataactcaggaagggcacatgtgacagtctggaacgtgtgaagtcgttgttctccttagcactgtggaatgttagtgatgctggaggaaacttagagctaagctggcccaacctactcatttcacaggctggggatccaaggcccagaaacaataagggacttgtctaagtcactcagggagttcgtggcagagcccctacctgatacgagatctcctgactctgctcacgagacttcatggtgggaataaggcaacacacggagagggatgagatggagatcacattcttcgggagagtttgattctgttattcctgccatttgggactttttcagagtcctctaccattctgcctacctgtacagaaagtgctggatttttccaccacaaggggcttatcaatgtggtgtcataaagcgggtcttactttctcatcagagcccatatcagaccacttcccttcttggtctttagaggaaaccaaagtgaagcactcctagcaaagaatttgatgttatgaccatcaaagcaaaagtatagctctatggttaaataattacttaaagggtcacaccgtgggcagaccttaaaaaacagacttaagatataacccatatgggctataaagtatctataaaggaccctaaatggaaactctgctgtgttgtgcatttgacttggcactaataggccagatatattaactgttgggtgaaattaatgataatattgcatctaaattctatgggatgtttcttaaggttttgggtgttaaattaccccttctaaaatccagtattgaggctcgaactaatcaatgtcttctttttcttttaaaaattctcttgaccatattgtttctattacaaatgaaacatgaaggtagaaagtagaataataagttacaagaagtggagaagggagtgtgtgtagtggaggatgagagaggttggttaatgggtacaattatacagttaggtagaaggaataagatctaaggttggatagcacagtaaggtgactttagttaacaacaatatattttagattttaacatagctggaagagaggactaaaaatgttcccaacacaaagaaatgataaatacacgagatggtggatgtcctgaacaccctggttattatacatcctatgcatgtaacaaaatattacaggtacccaacaaatgtgtacaaatatcatatgtcaataaaacaattaaaagtaaataactacagaaaacaatacaaagctggcagttccttcttttacagatagatggcaagctcaagtccaaataatcagttgaagaaaagagaagttatgtagatggaaatgctggtccaaactaagggatgaggaataaatagagttgtggaattatccacttcacctggtgatgttgcgggttaaatgggtacatggctaggcagaacaatgtagaaaacctaccttacttgttcttctgaccaagccttttaaggctgtcatttaaaatggctctgagttctgtttcttagttttgtaggatcagaaaatcacatgccaacttagctttcagctacttatctacaaacccaagtgtctatttatttttcagtggatggacactgcaggggtcttagcaagtaccatctctccatttagctaactacataggaagcctgaatagaaatcaggattatgattggtgatcttgaagacagagccaggagagtgagttttaatatctgatggtgttgagatgagataactgatctcgaacagggatgtgtctgctgagcaaactcagcattacttgttagctggacaggcgattggacaaagctgagtgagcacctcttcaattttttttatgcttgattactcaggttttcagtttttagacagactatttttcttttttttcccctcagatgtataaatagcattgaatctgcagtagtgttagaaaggtaattataacccaaccatgtctgagatgacattgtgatttcttaatagaaaaagcttgttgggtccccacttgcaagttgatttttcataatttaattctcaaaatgtcaccttatttcttggtgtaacccagataaaacctaggtatcctggcaatccagtttcagcatgaagttatattcaaaggaacacaggctagttggccaaagtaatttcagtatccttactggaatcttctggagaacatcagaggggattcattttataagccacagtaaaatatctcaagattctcttttcctgatttcctggccttaatatctcagccttttcattttaaactcttgaactttaaactgtctctgacccctttcagtgctttacttcttcatctcttctttccttttctcgatcatttttccccctaaatagcatccccacccattccctttccaagtgcaactatataaaacagtctgtttctcgcagtttttcagtactttacctctttctctgattcttcatttcaaaagcctaggaatcctctggcaaaaagtcacttaaaaggtttggggcaaggaaacaagattccctttagctcacatggaaggaagtcaaagctgaattatcttcatctagcaatagaaagaataaagattgcaacgtttacaatttaatatattttctttaccctcctcttgtctaaattctgtgatctcatgatggcaagagggccttgagtaggtcttctggtcccttcccactgctgtgccctggggcgcgaggtatcagcgcaagctagaatgggggttcagtggaggaaaggaaacaccctatttctgcttctgactaccttccctgcttagcctctttccctgtctccctgtttctcacacactcagttgggacacccaccttgtccacagccacagcctggcatctcctagtgctccagttgcagcacagtcagcaggagagaagagggagtctcaaggagcaaaaaggtggaaataggctttcctaacaacaggtgcttgccatgtctgtcttctcatcatatttattgaacagaatgtgcttcattctctacgggtgctctttaacaatagtttacgtgttatgttacgaacatgttatgattataacatgttctatcatgttataatccttccagaaaatacttgccaggaaaatatataatttatagaaagtgaatgaaagtggcttgttagccttcccagatagtggaggaatctggaagtctttctaatggattgagatcacgtcattccagatgtctcttgaggcacactgccccgaatggttgctactgtcagctcattatgcttttccctggaatttccacttcccccgcctttctccccagaataagctttccatgattctttcccagaattagccttttcaactctttcctcatatgcatagcaacagtaatttatttcatgtgggttaatgtctttagcattaggacacttctggttttatggactgatggccaatgtgtttttaataatgtattttgcttctattgaagtcatgagtacaaattcgtaattcatttgaatgagggatatggacaaacaggaacacaagtggaagagagaaaaaagaggatagtacactcagagatactcagtaagcataaattacatgtattcatcatacaatattctaggctttagagatgtgtcagccaagatccttgtcctcaaggagcccatagtttgttagagagagaagatgtgtaaatagttaagtgtataaagtgctacagtgcttgaggtctaatgtagaaaaatccacagcctgtggggagggaagagaaaggagggagtgatgcaatctatttggagggaacagaaaaatcttctgtatttgtcagtactctttgagttgtaagtggtagaaacatcactcaaactagcttaagaaaatgggagatttattagtgtatataatttaggaagcctggggatggttctggcttcatgcatgactagatctgggactcaaacaatgtagtaggacccttttttctctttcaactctgcctccctctgcatgttgactttattttcttcaatgtagatgcatttcttttatgtgacttggaaaaattgctactcagaagtacatcatctcagcttaatcctagtggtatgttttttcacttctctcctggtatccgtgtgtctgtccctagaaatgtctctaactggtgtttctcagttcacttagctatcccttggatcaatagctattgcaaagaaacgaggtagcatgattggcctaacctggctcacaaacaagtcctagtggcaggaatgagctaaccatgactggcatttccaccagagccatttacagtgagggtagatgtgtttccccaaaggaaagaagactaggcagatcaaaattgacagatgttcattaaagcttcatggatatttaaactgtgccatcatagatgaattgttttttgtcaaatgaagcagcagtgcacatcgattattgttagaggaagcaataagaacaaaactaagaggacatgaaccagccgggaagatcaggagactgcaagtagtctttgaggttggatcatggtagggggccatggcttgagatgaagctgtgaaatagacaggagcctcactggctatgctagggaacctgctctttgcactgtaggcaatggggagacatccttggttttaggcaagggtcggaggtggtcagatttccattttagaatatcactctggcagcagtgtggagattgagttggagaagccaagaatggatgcagggagactaataaggaaaccactacagtaatccagctggagataagttctgtaatgtgctaaagatgctaatatggaatagtctccatgtccaggtaggagatgaaggaaggagggttaaggcaatactcaaggttatagtggggaagcaaaagatgtggaaactggccagcagaatcaacatgacttggtctttcaagaaagtaagtgtctaggatgacttagatttctgacttaagtagtgtcatttgctgagatgaaacatagaagaaggaacaggtgtgaaggtagagggtgggggattgcttgagatggtgactgcatgtgtttgagtttgggggagtgactatgaatagttggcagttcagtatagggatctgcagctcaaaggagaggtagagttgtagagtggatgagaatgaaggcccgaagagttactggttttgtcctggttaagggaaggagaaatctggaaaccagtgggctatcccggtgaggagcacagctcagacctcagccatcaaacaagtatcagaaactgcaagtgagttccttaatggtgtcctatgcaaacttgttgtcgtttgactcatatctaattctgagcgtaggctggttgcctcttgtccacctagaagtgactttaagaccatcactatgggctgggttcggaggctaacacctataattccagcactttgggagactgaggtgggtggatcacctgaggtcaggaatttgagaccagcctggccaacatggcaaaaccccatctctagtaaaaatacaaatattagccaagcgtggtgacacacacctgtaatcccagctactcgggaggctgacacagggaaattgcttgaactcaggaagcagaggttgcagtgagctgagactgtgacaacagactgagactctgtctcaaaaaaaaaaaaaattcactgtgaaagggagctcagctagtcaaagaatcctgaaatagctgtggatgcacagtgggtccttgtcatggggccaggcccagggtcatcagttagaatgcagttgtaaacatgctaatgctgctgcctggttgtatgtgctaacaactgcttagttccaaattctaacccaataaggagtttcctcaggggaaatgtatgactacagcacaaatgggctcagccttactgctttcccactgttaccccttcctgcaccagcgctcttctggtccgtgtgactaaaagccaaaacaccactttgcctaaccccccagatcctattagttttgagtctcatcaattctgtttcttccatttgtccttctctttccattctgattggtacagctctaagctaggaggcttgttagttcatccatccttactgcacaaccaggtgaatggaacatcctcctaaggcacttaaatgatatttgaatccacaggtcagcaaactaggacccgtgggccaaatctggcccactacctgtgtttgcaaataaagttttattagaacacagccacactcattcatttaaatattgtccaggactgtttttgaactacaatggtagcattcagtagttgcgacagagactgtatgtcccacaaaatctaaaatatttacttttgttttataggaaaagtgtatcagcccctattaatccaccttatgtatgaatgccagattaatgttcctaaaatgccatttcaccatatcattctgtagcttagaaccctgcaatgacattgcattgtccatgcaataaaatctaaacttcatggccctccatggtatagtcctagccaatctgttgagtcattgatctctgttcctaaaggcaagccctacaaccagttagattttcctcctcattgtccctggaatatgcagtgcatttctacccttgttcacctagttccttttgcttggaatgtattgcccatttgtatctacctaaatcctactcattccttttttttttttttttttttgagacagagtctcactctgtcgcccaggctggagtgcagtggtgtgatcttggctcatggcaacctctacccactgggttcaagtgattctcctgccttagcctcccaagtatctgggattacaggcatgtaccaccacacctggccaatttttatatttttagtatagatggggtttcgccatgttggctaggctagtctcaaactcgtgacctcgggtgatccacccacctcagcctcccaaagtgctgggattacaggtatgagccactgtgtgcccggccctaaatcctacccattcttaaaggactaacatgaactctacatccttcatgaccatgtcagttacagtgatcaccaatgagcctgctgcttgagcatgtaaaggtccactgcccatactgcctggtaagttttcttctgctcagagaatggttcaccaatatgatgatgggcaactctggagtgaggactttctgatggaacaaagtcacagctgtgggaaagcctgggaatggtttggaaatgacaagacatgtaatgagaacacatgacactcaattaatatttgtggaaatcttgagtcatcagcctctcatatctatgacatacatcttggttctgtatttaaatgtaggacaactacatatcttgatagccagtgggaatgactgacaaagtccagtaagtctactcttgagagattctagaatgtagagatagcagctggaccaggaagccctagctttatcatgtgccatctctgagatggtggatgtgggctgttcccactgtgcctcacttttcccatccactgtcatatattttatggtcttgcacacactctgggattaagtaacatcaattatgcaccattgattggagttctttggtaaatggtactacattcctaaaatattcatgtgtcttactttgtcagggagattatatccgtgacttagatatcatattctagtggcttaagattatgagctaatattttgtaaggtctgggcattgcacagaaaaccttggttgtaatacacattattattacattgatttgaatagcaatggtacaatcatagccccggaaacatagcgactacataaaataaaagcttccgttaacactgagcacagcagccaggcttccgcattgttgttgtccctaggatttggctgttgtattgtcaaatgccattatgtcttatctaataagtttctccctgcatatgtgagtaaacgaaaatgctccagtatagtaaatgtctcagcaaaccactcctgtacgctttggaaacagaacattaacaaggaaactatcatgagagcagacctttctgttctcatgaatcacattcatatgatgtttattgtccacattggagaagtatagagaagaaaaatatgaagggtacactctaatggaaaggttatagtggaaatgcaaggaaaatatatccctttacaaccagcttctaggcattacctagaagtaaaattatgacaataagactaacagcaaataacattgagcacttactctgtgccaggtattgttctaggccttttacgttacatcatcttatttaatccactccacaactaagtggtttggatgcagttattatctccactttatgtacgagaagaccaagacccagggaggtagaagaacttgtcagaagtcagacaggtagtgagtggtagggctgggagttggacccggacagacagattccagatttcatatttatcgtaacctcagctgccccacccacatgaaatgctaccccaaggctagtggcagcaaatataacccatttcatttgcattgtttggtatgtccaactgggtgatttgtcctacaaaatttgaaacaacgtctgcttatttatgtctgtgattttgatcaaataaatctcacccagaatttcccactgtcttattctatggtatttgcagtttgtaagaacctctgtcttttggattgagacgtttttattctttgtgtccaaattaacactgcacagaacatggttctctgtgtgtgtgtgtgtgtgtgtgtgtgtgtgtgtgtgtgtgtctgtgtgtgtgtgtagaaaccgtcttttcttttggattaaattcttgcagcctggctgagtgaggagaatttctcccactcttcgagcctacagcagacatgttaggagaatgctgctgcttgcaacacacccagagacggtggggcaggtgacactgcgtgtgtgcccggtgtctctggaagtgtctatacagatgtgtgctgctgctgctgctgctttctgccttaaaatttctggagccaacacccacccactcttacagcctctgtctctttattttcaaggaaaaaagaaagaggcagactgaaatagaaggcaagcgacaacagcttgacgagcagatacttctgctgcagcattccaaggtaagcagctgatcccaggaacctattccattattagacatgcagatcacactccggagagctgggcagtgcctgccctgccgtgaaggcgctgccgccaaccaaaccagcctttttcattcaatcaggaaaccatctcttggcttttcttgtgaatttctcaaattcagggcattattacagcattccaatttctgcaagcataagattacagtgtgcatgtggacagggtggagggtttgtgcgtgtgaagtgtggtggctatatatagaaattggatgagaatacttcacagggtgggtgaggcagcatttcaggattgtttctcccatgcataggtgctgggtgtgtttgctcagagaccccaaaagatatatttcacggaacgttctttttattcacttaaaaatattagtatttcctttcttgatatggagaaaagggagattaaacgatgtgatctgataaaagaacaacactgtgtatttcagattattcatttattttatttgtactttaacaattttgaaagtgttctgtgagagcaagcagttggtcaaagatggctttgaaatgatttgactcagacgggtctccatggtaccatctaaaaagagagagagagagagacagcacacaagagctgtttattttttctttaaaacatgatgcacttaagcatcgtaattgattacagctcaggagaaagctctgtcactgtcacaaggaccccactggttgcagaatgttgcttttcacatgttcagagaataatgtgaccacattccaatggccagccgggagttgttgcttgcctttgactgctcctgggctttttggcaggaaaaccttctcctgcttacctcatgttgctgtgacattgcctgcacagagctgcattgctcagaggactgggtgggaaggtggtgctgactttcggggtgatgctcggtatgaattatctagatttttttcaacaagataaacctttatggctacttttcctgtccttttctagaaaacaggattgtgctaaatgaatacccaaaatgagaaccatcagcaagcgagttactgattgaaaatagcagcatgacctatatctgcttagcatgtttatcagtttttgccatttaccttaaccagagaaatgtgcttaaaaggaagaaaagcagcatgatactaaggatattgcctgtttctctctgttcatcatataaattcattgacagatctttctttgtaggagcttgctctgtatccccggtgctgttgctctttccccacaacattcctgagggaggatggagggctaaaattagtatcctcttctcacagagagggggccttaaaaacacctaatagaactgagtgaattgttcaaggtcaatctgcacagagctaggtctctggctcagagtacagtccattcagtacggtgcttgtaagagaccaacatgtactaaaacctcagtgaatttctggttaaaggtgaacttttaaataagaggaccgaatgaaaaaagagaggctgctttgggctagacagcctcactttaagctcaacgtagttctttgcttttgtattccctgaatccagtcagggaataaacatatgtcaaaacatcaagggattttttttctttggtctcccttctcatgatcctgggtgccaaataagataccaagggctcatttattgctgatgtccagtgcagtattagtatattctgttcatattacatctattcatttttttatttgtttgtttgtttgagatggagtctcgctctgtcgctcaggctggagttcagtggcatgatttcagctcactgcaagctccgcctcccaggttcacgccattctcctgcctcagcctcctgagtagctgggactacaaatgcccgccaccacgcccagctaatttttttttttttttggtatttttagtagagatggggtttcaccatgttagccaggatagtctcgatctcctgacattgtgatccacccgccttggcctcccaaagtgctgggattgcatattcatttttcgtctatgcatccattcatccatctttccatccatccatccatccatccaatcaacagaaacaacagtagaaattaacttggtcttgtatgcggaagcagtgaggtttttctcaaggacttggaaacaagggaatcagctagttctttatggctatcttggtaaaattctcacacagttgatgagattggctatctgaaggaacacccaacactcgcaccatggcaaccttgctattgcagggcaggaggtgggtgaggtggggaggactggaggtgatggtaacttactaagtggaggtgagtgcattgtatgtctctgggaaaggcttgtgtggacagaatgagggtgagttatttgccttgaatactgaaaaaggaaagctcagaggttccaaaggtggcagtggttgtctagtactatctgcagagagacccccagctttgggaggtcctgaatttctgtatgctggtgaggtggggtcagtggtaaggtgaggagggtcctcaggccacagtgaggcccaagtgaaacttccctcaggaccttgcctctctttgttctgaattcatcctccctataattattcagttattttgatatgaggaaagggttgcctgattgaaggatatgatcactttaggcactaggaaggaatatgtttcactttaaatcaataaactggtgactgaacttgaatagcatgggactttttccctgtaatcatccagtttgcagcctagtggcctcgcccctggatggaagtacattcgtggaggttatattttcttctctgtgagcctctccaaggagtcagccagttttctcctggtagcctgttagccaccgtcagtaacagtcaccatttttttgagtgcctaacacgtgcctggtactttaaacacataccctcaataatgaccacaagacagttattactctgtcttacagctatgggaacaaactcatgaggtcaagtgatttgcccaagaccatagagactataaatgagggagcctgagagaaactcctgggctgtctgctttcaaagaccgagctctttccaggccaccgttctctttgaaagaaatgtttcctttggaataattcatttagtgagatgccagttaccatcattgctgtctctcttactctaaatatattgtgatggactccagaaaatttagatcatgtggagacatgtcacagtgattattgaagttccttgaagtagagaatattaggaaatatgtcagtaatcaatatttgtttcactaatttgcaaaatcctagatattctctaagaaaaaaatattctccttgcattagagttagttgtcatgtttataagatataattttcatattctttatataattctcatattctatgtcttaagataaaattctcacatgtggcaattatcagatagcctgtggacacttattctcatgcaatgagatgaattatttagacagattcacctgtctgtggtcaaagcaaataaatagaatgcaagatagtagttttggcattcatatatatttttagaagacttacttattgcaatatttaggaacatatagtgagcaactctacaaaatggaatatcatcactttgtatatggacttcgagcaaattccacaatacagtaaaagactaaagtataaaatggtaaaatactaactgctacatcccagtgattaggaaacctcaagatactttgaactccaggccaaattaaactcagatgtatttttaaagcatccttagctatacgtagtgtggtgtaataatttctaagcattacaagtagaactagtaagcaatttttatagctatattatttttgatgattacaaaaggaaagaatgtataatcattgcaaaaactaaattaaaaagtacagcaaaatataaagaaaaaacatatgtactctatacttaccattcagatagaacccatgcagaggtaaatccttctatacttttttccccgatatatttctgtagattaagatatgtaaccatcattcacagggctcaccaacctgtgggtaaaatgaaattatattaacattagcattggaataacattaacctttacctcttttttatgtgggttctttttaatacccatacaaaaacttataatttttataaaatcccatggagcattcttttactttaggataactgactttgatgtcttccttgaaaagaatgtctccatctcaaactcttagctattatgtttcttatacttcaatagcattaattcatctagaatttatttacagacgaggtatgcagtaggaatataactttactttttactgatgctgagctgcttgtctcaatgtgatttattgattaattcatcctttccttcactgatttaaatgtcttctttatcacctacatatttctgacttacatttgagtctaccatttatggattatttttattccattaatctgcccattcctgtgccagtattgttctcatttaatccctatagctttttaatatattgtaatatttcataagacaagaactatcattattcttttgaaaaattgtcttggctttttatttcataggaacaattatttatttttattgtttttataatgagacttgtgatgatatggatttttttaaaataaatcagctactatatcatactagagcagaaggaatttaatatttccttctgtcccttggttgaattgccagagatttgtctattttattggtctgttcaaagtcccagcacagagtaggcactgagtacctactgcaacatgaattccttggagactgtcatatttacaaaggtttgcctgacagagttggccctgtcagaatcaaattgctaataccacgtcttcaatacataaactgcctttgaattacttattcatgagcggggaaccctcactagagttttcttctaatccaagctataaaaattgtcattatatttggaagaccacagccttttcttccaagaaagctgaatgaaaaaagatgaaaggctgaattgtgaccctgtgaaatatttgttgtcaacccactaaggtcatttgctgaagagcctgaaggtatcagaagacttgctacaaagatattacagtgtctttcccggttttgaacatttagcactaattttagactttttcttgttactgggatgtgtgaaagacttatttcaaattttaaaatattgaacagataggcacagtacacagtgtaaagtaaccttagatctcctcccttgtttccatacccagagcttgaatggaagttaaaacctgatttcttctatcagaagtcttgggtcggcttctccctgggtggactgaagcatataacaaaatctcaaaaccaaaccaagatcttatttattgagagtcaagaaagaggaaggaaagagtgggaaggataggggaagagaaagagggacaggacacagataaatgactgaaaacacaaacacagctattgcctcatgctgagtttaacccactttctgttagaaaactgaatttaggccaggcgcagtggctcatgcctgtaatcccaacactttgggaggccaaggcgggcagataacctgaggtcaggagttcgagaccagcctagccaacatggcaaaaccctgtctctactaaaaatacaaaaattagctgggctacttgggaggctgaggcaggagaatcacttgaacctgggaggtggaggtcgcagtgagccaagatcacaccactacactccagcctgagtgacacagtgagactccatctcaaattaaaaaataaaataaaataaaataaaataaaataaaataaaataaaataaaataaaattgaatttagccatattccaaccatcatccactagaatagccaatatcagcttcagccagattacaaatgaatgaaagatccagagtaaaaagtaaaatcatgaaagtacacaaaggaatcacaggtgaatatttttatagtgagggtaaggaagtcttatctatgtatgacatcaaagccagaatgtgcaagtaaaaaagattgccagttatgactttataaaaataacaaacatctgaccaggaaacaacaggagacttattacaagttctcattcacctcctacttccccaatctgccccacccagcctctccagacatgcctcactcttcaccggggtcacctcaaaaagtggtatctaggctgggcacagtggttcatgcctgtgatcccagtacttgggaggctgaggtgggaggatcatttgaacctaggaattcgagaccagcctgggcaacatagattccatctctacaaaaataaaataaaaaataaaggaaagtaagaaaagtgacttcattgcagttaccttagctgtagatgaaaaagattgggttagatgatctctgtgatctttttttagctttagtgatccaagattttatatttgctaaagtacagtgtatgtgcatgattttccaagaattcctcacatgtcagcctccgtggatgaataaaagatacagtcctgactgtgagaactcaggggcaagtgggggagagagagcatcaatatggaacccaccattagaggagctgaaaaatagttttccatgttatgaagtggatcagtggcacctgatgattttgtaaatcctatttgagcaaaaaagaaaaaaggattcttgggtgatcttacacagaggcaagatagtagagtgtacctcttggcttcaaatcccagatctacagctcactcggtgtgataccatggataagtcagttaatgttagcacctacctcatgggatgcttgtgaaagttaagtggatttacatgtaaagcacataaagcagtaagagttctataagaattatcattattgtcaccatcatcacccagtactatggctgcaaataccatttatgtatatatgactgccaaattgagaatcccagtcttccatgttcaactgcttttctgacatgtccgcttagatggatgtcactttcatttagaagcctctgaaacttaacatgcccaaaatgaaagattttattttctgcttttctatcatttgttctactcttccctgtctccagttgatgataccactattcaccctttcactcaaaccaaatatctatgcattgccctaatccttccctttttctcagcccacatctaatctgttacaagtcacactgattctacctccagaatgtaccaccatgccttttgattcttctgtctctcttctgtttcaagctaatattctctgtcacttgaaccatgcaataaactcccatcacttgtactttgtaatcctgccccttgcaatgtgttcttcctattgggcttagaagacacagcaaactccttaacaaggctacagaatcctacctaatctggcccctgccttcttctccatcttcagtttgttctgccctcccaccccaacctcacttattatggtccagccactcgggcatttgttccggtccacaaacacaccaaactctgtcctaccaccaggctggtacatttgccagtccctccacctggaacacccctccggatctcagatctcagcttgaatgttcaagtcatcagagagacctttcccactttaaatgtcctcccctggtccctctttgtcacattgtcctgtctacctcttcctaggcagcatcatagtctgagattatcttgcatccttgtttattgggatgaaggcttgagtgagagtagggacttgcctgtcttcctgagctgtgacttcagggactggcagagttcttggcacctaggaaagggataagagagccactgctcctgagttggggacacagaaggagaggatggggagttcttttagattatggtgtttgaccagccattgagaaagcttgtgtattcttcaagcatttggatagtcataggtcctcatgctgtgctactcaaatcgtggtcctcagtctggcattgccagtgacagcatcacctgggaggtcgttaaaattcaaattcccaggccttatgcgagacttagagaatctgcatctccatgggtgggtcctggaatctgtgtcttaggaagttctcctggtggtccttatgcatactgaagtttgggaaactcagttcttgctttttgttttccaaagctggccaggccagtagagccagaaacagatttactttgggagttccttctgtcctcctttcagaagcccctgtcaagtttccctttgtccagctgccagctccccacctgctccttccttgtattgacttgccatgatgacattcgtttgacaaatgtgaagtttgacagtccttagcaccttgggaggagtttgagaccagcctggccaacatggtgaaaccttatctctactaaagctatgatactatgttagctatgatacttttttttgatgtatgttatttagacaataaaggccacaaacagagaaaagttttttttaattttaatttttttatttctattgagctctgcttccgctaaattctgaaacactgaggcagccaatacaagctagcacagtataggggaccctgtgctttggatggtgcactcagtatacaccattccatttggagacatgttggagacaacataagggggatctggagtcagttaaggaagccttttgaattggtgatttcccctgaaagcatgactttggagccaagtagaaaatcaactatgctttttcggcttcttaaaaatgtctaaacacctttgtgaaacaggattctctgagaccaggcccactgccttttccagttttttttctttctttcttttttttgagacagagtcatgctctgttgcccaggttggagtgcagtggcgtgatcttcggctcactgcaacatctgcttcctgggttcaagcaattctcctgcctcagcctcctgagtagctgggattacaggtgctcgccaccacacccagctaatttttgtatttttagtagaaatggtgtttcaccattttggccaggctggtctcgaactcttgacctcaggtgatccacctgccttggcctcccaaagtgctgggattacaggcatgagccaccacacccagccccactactgcctttgtctgttggagcctctcttcctggctcctcctgttgggatgttcttaatgatgtcatgcctatatcaagaaaagagatggaagtagagggacatgcacctctgggtgaccagagtcaccaggctgctctggccagagctacctgctgatggtggcagctaagttggtgagaagtgaggggctagacccttcatgtgatggcaggaggcactgtgtgaagaacagcagagagaacattccaagagcagccatttacgttgcaagaagttgtggctgcagaacatccctgctggtgtggagacagccaggactgtccatggctgcttttccagaagggtccacaccaacgccaaggcttccaggatgtctatcccccagaatcctaaggtttttactatctgtggtttggacatctttagcacaggaagcaccctgaaagtgtggtccctacccctcccaaataattagagagaaggaaagttgagaatttcccagttcatccatttactcattcattatagggaattgggctacaattccattgactgaatgaataaatggatgaattgggaaattctaggtgacacagtgaatgtgaaggtggataaaggacagtcctagccttccaggaaccagcaggctacagggggaacagatgtaaaaagaaagaatttgaggatagtatgaaagggccatagagtgtgtctcagagccagtagaggtggaaggcttctctggtggtattttacttgttctttcttaggtaaataaagcagaggccaagggaacaggatggacaacaacaatagtaaacatttctatagtactaagtatgtgtgtggcccttttagcctataaactcctttaatcctcataacaaccctctgagctgggcactgctattttctccattttacagatgagaaaactgaggctcagtgaggcgaaggagcctgtccaagctcactcagctggtaaatggcagactggttccagagctcaggctgttagccactgttcagcatggcctcttgcagtctctaccctcttcctgagagtaaatttcagagccaagttatagttcaagaaaagcaaagcaataatcattcttctacttcagaattgctaccaatgaacaatttattttgtgcctacaacagattaagtatctgaataaaaatataaaaacatgaattgattaaaaaatggcctctcataatgtgcaaaacagggtctgtcggggaaattttgagaggtttttgtggagaacaatggttctgaatgttttgtagaaagagcaaccgatttgccccaccctttcccactttccaatggaaaagaatctctgataaagctttgataagcaaccaacgtaagcaaattgtactgccctcttttacacatgattttatactatcatacgatgccctataatgtaaaaactgtacattttaatacctaccctggtggtagatgcacactatttatacagagcacattcaacaggcagcatgtcaccagtgatgcatagctgtttacgcatattgaggtgtgggggtggatcctgtctataatcactgtaagagtatagttaggaataattctatgtgaacaaactcaagtctttaagcctaattattaaaaaattacaggtcaagtaccataaatttgcctatgtgctgcaagagtaatcaaagagatctctacaaacaatgatttgtaatgaaaaggcaagaataacatcaataaaaaccatggtcacctgaacccacactgatgatgtattgtcaacacagagtctctcctggaagtgcaggaattccaggttgattgaacttgctcctgggcatggagcagggtgtctacagcaccagatgacccctggacttctcaatagaatggtgaatcaggaccattagtgaagtctaacttactaatactaagtgttggtaatttttttttgagacggagtttcgctcttgttgcgcaggctggagtgcagtggcatgatctcagcccactgcaacctctgccccccaggttctagtgattcttctgtctcagcctcccaagtagctgggattacaggcgcatgccatcacacctggttaattttgtatttttagttgacatggggtttctctatgttggtcaggctagtcgcgaactcctgacctcaggtgatacgcctgccttggcctcccaaagtgttgggattacaggcgcgagccaccgtgcccagcccagtgttggttatttttaaagactcatcagttcataataaaatgcccttaatgccgcatacaaatgagagtctatggaattgtgcatccttcgctcataagagcttcagggagtgctccaagcctccattccctggctctcagtctttagaagagttctttcctttcacctcgctcaccctgcctgatgagatcaaacgaaattctggacagaggtgatgccagtgagccagggagccaaagagccaggtctttattctgtgttaggtggcttaatagtcattgctcctgctgttcctttcgttgcttactatttctgggaagaattgttcatgtgccctgcatcctcactgtggtcccctctggtgaccactgacctgcccatgggcatggtcactggtccttagccatgatgtacagggtcagtagctgctgccgtctgccatctagggaccatataagtggaacctgaatcaaaattatcctctcacatctacctctccttgctcttccttttagggaatttcaacatgcttttttctggaactgttttcatttcccttctcaaagcagtaattgctgcctccgaaccattgacctgaaacaaaagctttttattccactgtactgtatcgtagtacacttgcaaacatgggatgtatggtttttttttttttttttgacagggtctcgttctatcacccaggctggagtgcagtggcacggtcacagctcgctgcagccttgacctacctggctcaagcgatcctcccacctcagccttcccaagtagctgggactacaggcgtgcaccaccacacccagctaattgtttaattttttgtagagacaaggtctcactatgttgcccaagctggtctacaactcctggaatcaagcaatcctcctgcctcagcctcccaaagtgttgggattacagacatcagccacggtgcccatctaggggcatatgatttttataacatttggagattattactgaagatgattgggagtcattaaagaagggagtcattgaagaagagtcttgacaatctttttaaaacactttaatatggaccagatattaggtggtcttaggaagttttttaattaaattacagttgcatagaaaaatgttcttaatttttagagactcatactgacatattgttgggtaaaatatggttgttatttagtttaaaatcatttgatgagaaacatatgggaaaatatggcaaaatgttcataattgttaaatctagatgaggttacatggtcattcattatacagttctatttttaaatttttttaataatagaaaatgatatagagataaatctccttgggtgttgatctagagggaagtagggagccatgttagtgaggaggtgaaggcagcgattcaggcagcgctggtgaggggtggagctaaaacagcaccactgcagagggagaggacagtgtggactgaaaagtatcatcttgtctgttgtcttccctcacttccacagtccaaagtgcttcgggagaaatggctgctgcagggcatacccgctggaactgccgaagaggaggaagccaggaggcggcagtctgaagaggatgagttcagagtcaagcaacttgaagataacattcagaggtaggtggcttccagcccagggaacccatgctacagtttttcagtgcagtaaccactgctctcctctaggtggcctttctcaatactgttaccttctcctgtacttgagaattttcttcctaaacaaagcacattgatgttgtttaaacttttccagatgacccagagttatgacacagagtactaataattttttatttttatttttaacttttattttaagtttaggggtacaaatacaggtttgttacataggtaaacttgtatcgtggggatttgttgaacagattatttcaccacccaggtattaagcctagtacccgttagttatttttcctgattctctccctcctccctcccttcaccctccaaaaggccccagtgtgtgttgttcccttctacgtgtccgtgtgttccatcattagttctcacttataaatgagaacatgcagtatttggttttctgttcctgtgttagtttggtaaggataatggcctccacctctatccatgtccctacaaaggacatgatctcatccttttttgtggctgcaaagagtactaattattgcactgggctgtaatacagcacagtgatggcttcatgggcccacaaggtgttgtgagcagcttgccccttcactaggtgctccctttgagttcttatattagctttcatctttttcctccttcgggtcaggttgttagctgttattgctgctgtagtgagtctgttttcaaatttgctgtatttggtcaattcgaaatgtgaaaactgtagtcaacagtcttgggattgaaatgaagagtgtggaagtgctgagtgagagcacctctgtaggttatgtgcccgtgctctaaaaattaactttgtattgtctgctttcactgctcagagagtggtttctttatggttctcaaccaggatctgatcacttcaatctgggagataagcgacctgtctgtgggcaataactggccaggctcacacaagagcaataatgtaggtttttacttgggagctatagccactccaggtcccaggacacctagccagagagatatgagatagggatggaaggtggtaagcatagatgccttagaaccaaatctgtccctccaacccatcccaccaaattctacctgaaatctcaccacctggagcttcatctctgtcttctgagcttatgagctctttttttttttttttttttttttttttagatggagtctcgctctgtcactaggctggagtacagtggcacaatcttggctcactgcaacctccgcctcccgggttcaagcgattctcctgcctcagcctcccgagtagctgggactacaggcgtgcaccaaccacgcccagctaatttttgtatttttagtagagatggggtttcaccatgttggccaggatagtcttgatctcttgaccttgtgatccacccgccttggcctcccaaagtgctggaattacagacatgaaccaccgcacctggcatgagctcttttaaaataaagggtaatagctaagctgctaccagccatttataaccaacagcaaattaagactctgagggcacctgtaatagtgtcactaaagggaaaagcaagccaagtaaatcccaaaggcatacgtcagcctatgtccctactttgcttaggtcctcacatgtcttaaagagctttcagagcagcttggctaaacattgtgaaggaaactggccaagaaaaagtttggagggtttgtgtgtacatatacatatgtatactcacacacacccgtgtacatgcacatgctttttcttagaatacaaaggataaaggctaaactgttaccaaccatttatatcatatacatatatatatagagagagagtaggtgttattatagacagaaggcagaaaggatttggaaaataggataaaattagttacatgaccttttctatttttctttttgtttcttttttttttaagagatgagatctcactctgctgtccaggctggactgcagtggtgcgatcatagctcactgcagcgtcaaacttctggacttaagctatcctccgacctcagcctctcaaatagctgggaataaaagttcatgccactgtgcctagcattattattattttttttttttggtagagaaagagtctcactatgttgcttaggctggtcttgaactgctggcttcatgtgattcttcccactcagtctcccaaagtgttgggattacaggtgtgaaccaccgtgtccgtcctattctgtttttcttaagtgtcactgggaaacatggtcttccaatcaaattggcagtttaaccttggcttgaatgcaaatatgttgttattatggtccaataggtggtaactcgcacttgtagaatgagccattgcgtgtggaggctagagtcttaaactgagactcagtttctgggtaaattgaccattggaaggaggtgttgtgggttaggggctggtttattattcaggtggtcatgattatactcaaagaaaagttgttaaagttctttttatcctttacgtcctttacgtcaatggaataaagagcacactcaatgtatgcaggcagtctcacccatttagagctagaatcccaagccagaggaaggaaatcacaatagcctacaggggtggatggtgaggcctggattcaggggccatttcttgtgtcttagtcatgactttgggccaaatgggcactggatgtgtgctgagatgagctgtgctccctggagctgctttctgtaggagcaggactgtggtgagcatcgtttcctctgcagggccttctgagggaggagtttcttctaccctggaagtcagcttctgcttctcttcatcttgctggcatcttctctaccacaatggttattagtgtctttaatcttcaatcccatgggaagaaagagctgttatctctcttcccataaaggacactcagtcacctaagacatttctctgtagttgaacatagcttagttctcactcacagaatgacatttgaatagttctaaaggctcattgcaaacatgagcaccctacggtgttacaaagtccctgtggattggctggcatggctctgctgatagggctgagctcacctacgtgactctaatctgcgtgttgcctgagtccactcttgtttaccctgcactaacaggctaaccatgatgctgtctctttctggcaatgggagaggtacaagagggctgagcagaaacaaggcctaggctcagactgcccacaagccatctgccaaaccaagtcaatgagcaagcccaaaaccaagggaagagacagccagccaacttttagtggaaggaacacagatcagggaagggtgaagaatggggatgaataattcagttttccaggagcatgattgttgaattgaaaactgcaagcattcaggaaaatggaccggcattagggaaactacagaaaagacatttaaaaagaaagaggactggctgggcacagtggctcatgcctgtaatcccagcacttagggagaccgaggcaggtggatcacccgaggtcaggagttcaagaccagcctgctcaacatggcaaaaccccatctctactaaaaatacaaaaattagatgagtgtggtgatggtcgcctgcaatcccagctacttgggaggttgaggcacgagaatcgcttgaacccgggaagcggaggttgcagtgagctgagatcatgccactgcactccagcctggcaacagagtgagactacatttcaaagaataaaaataaaaataaagaggactaactaaaacaatgcaagaatgcagagagaaaggaagaagagagtaagagagaatatgagtgacttcaagatcaaatttgcgatctgatctttatataataggaatcttgaaaactataagatcagatgcagaaccattaaataaaggcattttaagggaaatcttcattactcaaggcaaaacattaatctgtagatctttagatttgggccccctagtctaagtcacccccagcaatcaattagattctcctaaagagatacataaactggttgcaaactataaagtatattagtacagttgtgccctgaaggtattttcgtccttgttgttgaactaagaatagcttgaagacactgaaggaggaatagagaatagtaaccaaagaacaaggaacatttctacaaagaaagactaagggaaattgggccatttagtttagataacaaaaggataatggtatcataactcagaacttcaagtgtatgtaggatctaggccatgtcttaattctttatgtgcaggccattttgaatatggcaaagacttcaaataaagcatgcaaatttctacttagatgtctatttccctagatacctcctagaagaaagaacataatcaccttttaattcttattctgtgattctttacagtgccagtaactgtacaagaagttccaggtttacagacatgtttttttccaaaatgttatttataaattggtggtggtttggaagggcgaatgttgttcctctgccagaattattatatgtggtgcttagcttttgagggcagcccacgaagaaggaaggaatggaggaaggaaggatggaaaaatgtaactagaatattaaaccctgggcattagaatcacttgggaaggtttttaaaaataagaattaccaggcctcattctaggaaatttggatttagtgatccaagtaaggagtcctgtaatctgttttttaaaagggtgttccagataattctgttgtatggtcaggttcaagaatgattgcagtaaatggaaaaaaggatagaccataaatgaaatcccattttaatacctagaaaccccccaaggagagtgggaagtaaatcatgtttataagaaaactggcttcacacacaaggataaaggacaacccaacccttgattcagactgtttctgagccttcctactttgacccaaggatatgtgaaacctgctttggggattcctgtaggtgagagtagctctggcttagagctgaagtctctcctccataggccccacagtagagctaagctttcatttgaagtggattagaaacagccttggtttaccaggctaaagatgatccaggtcaggaaaactgtgtgctttaccaaaggccagaaaattctaccattcttccaagatttcttgctaaaattcaaagtaatgtggtcttgaaggggtgacaccaaagcagctgcaaaggaagaggaaaacccggctgccacagtggagaaatagattgtcattcttttgcacagcttttccctgggtaatgtcaggattatatttttggctccctggaaaccagaattaaaataggctaaataagattggaattgttgaaagcaaaatctgtagacgtttccttttttgaattttttgaatgtccacatcttctgtatgctttgcttctttttggagtgacgtattgagaaagcccaagagattgtttctggcttgggcccattgccagccattgtccgtgccattattgtgtgtggtgggtccctggaggccacatgtggacctcgggttgatactttcggagattgtaggtagttcgagccacactagccctgtttacttcatgtctgccccaagcatcaagtcttgttgtttaccttgtcactttcccacttaagattctctttcatttcactgggttttactaaagtgtttgaaatacagggtttttaacttcctttgattagtgagaaatatggggaaaatttatctcccaaccttatcagttgggggcagaccaaccccagtgaagatgagaaacttcatggagtattaaatgaaaatgggatgagctgtcacaaagccaggatgttaattctagctctgctgatcatttgctgtgtgaccttgggcaagtcttttgctctcttcagtctcagtttcctcatatcttcagtgagccatctctcgggatcttccagctctggtattctgagtttctctaatttgaggagttggttagagatctcttttctcaacagtgtacctgttccgagaaatgttactgttatagaaggaagtggttttggaaacgggtcagagtggaggaaagaggttgagttctcaaaaaactaaaggctaggtataagtaactgattcatcacagagatgactaattcatcagaacagctgtctgttctaaaatatgtcacatcaaatattcattgaataaaatattgaagtctcaactgctaacctagagagagccaagcagcttttaaaaaatcaggatagaagtgtacttttcatttccacattggacctgtgattctctgagtacctgtgtgggtctctggtaaataccagaattcacttaattttccatattgttaggaggctcaaagccaaaggcgtagagacattaggcataagcatatgtatcttattaagcatctgtatgttatgttgtggggtttggcaaccaagaagatgacagttacttacaactgttctagaaaaggcaaccactgaaacattcattgaaatcacaaaggacacttgcttgagattcattgtgttcttcacatttgctatttttaactccatgattcactgttcttttgagcagggaggggaacactccacagtggcattccacatctgtgcacttccagccggggtccccaccccacgttcagccacatttgcagcccaattattgtttccattcttttgtttccttccaaaataaaactatatatgctatgtatacagtaaactatatagtagtgtctctatattgtgtaatatttcctgttttgtcactcccttctgggtagcggcctagcttttctgcctccatttaattcattaattttctaatttaagccttgtaatactcccatgaggtagtgatgatgatgatgatgatgaagagagaagagaagcacaggaggtgaagtaacttgctgcccccccctaaaaaaattcaatggaaggacatacaagatgaatgaaaaataattttaaaaaagtgaaagagcaagtatttgaactcaactctgcctaattctaaagcatgttctcaaaaatcccaacagaagttgttattttaagctaaatttttttgagacctctgatattgagtgaaattacactaacgtgcacctcgtgatgtaggaggagggacaggtaatgtgattctccctcctcaacctccacacatgcttcttcagaaggcggtgcatcagacgcaccatgactctggaggtgccggtcttcagcctattgtgggtggtcatcatgatggtgagactgcccccttcaggttctttcatgaagtgcaggtttcattttgggcttggctcctttctgtctcttttggaagccctttgttcctgattgcactttctagcctgtgtacagtctaaacctctgcgggaaacagtgtgtgcttctgaaaagggctccagcatagcaaactcactagaaagccggacctcagagcttgaccaaacttggctggagtcctagttctgtatttacaagttgtttgatcttggacaagccatgtaaactctctggacttaagtgtcctcgcctgtacattggggaaaactatacccaccttgcagtgctgttgtaatgtgtagaggtcaggtgtgtttgtgaagtgccaagaacagcaggttgtcagtaagaatagtgctgttggctgggcactgtggctcatgcctgtaatcccagcactttgggaggctgagacagatggatcacctgaggtcaggagtccgagaccagcctggccaacatggtgaaacctcttctctactaaaaatacaaaaaattagccaggcgtggttgcaggcgcttgtaatcccagctactcaggaggctgaggcaggaaaatcacttgaacccaggaggcggaggttgcagtgagccgagatcgcaccattgcactccagcctgggcatcaagagcaaaattttgcctccaaaaaaaaaaaaaaaaaaaaagaatagtgctgttcttattgttgtttcttccatccccctacagcagagtttcttaacagctgtgctattgacatttagggctggatagttatttgttgtgagtggctgtcttgagtattgcaagatgtttagtagcatccctggcctctacctagtggcttccaggggcaccattgccctttcccagtcatgataataaaacatgtctccagacattgctgaatgttgccttgggggacaaaatctctccaagttgagaactactgctcaaaagcctggcattatgtgtattgatactaagatgagaatctcaccaccgagtagttccagaatacagaaccctaaaaagatttatgaagataacattagtgattctcagtgcaaaatgacaaagtgtttcagttacttgaaaataaaaggcttctcttatgcactgagccatgaaagtctgttcagagttaaaaagaaatagttgcttttttggtttttgcattcagtattgtgctgcttttgcaaaggcaataattttatgacagttcataaaaccatggaatcttagagtatgcataactgacatgttatgcggatcaactcctatctgattcttgaatttgcaatgaacgtaatgagtgggagtgaaaaaacagtctctccccaaagcctgaaagtgacaggaaactcatttacttgcaaaataaaacccaagtatatactggaacaactctaattattacagaggatcctcctttgggatgaaagttttgttccctgcagctcctaccctctctctggtccctgccctatcctccaaggaccacacagaaaaagccctcttcactgactgaaaaaatctagatgcttagggtttgtggtcagctttgcaagctggcacaggtaagggaggaaacactctgaaattgcagtgcagcatttcaacatttcatgtgtgttacttagcaacaatagcaggaggcctgccagatgtaccagagtcatcgtgcctcgctcaggttttgtaggatccattataatcatctcattattggtctggcaaattgggtttatagtgcccagaactatgaaaatagtagttgaatttcttccatacactgaggccatgtaagagccatatttgggaaatacatgcatttcccagccctcagaacaattgctgcaatggaaggaattctgcaaagtcaacttttttggtagccagttccaggctttttggcctatgattgccacaccccaagttttctctctacaaaaagctttgataatagtctttttccaattttaggtcaccttgcatagcccctctggcttgtaacgtggtcatttccaaccgttctacattcttgatgaaatgaaaacagcaagcttcctgttgacatactcttccacagttttcatgaattatgcattttgaaggcagcagacaagatggtgtctcagtcctttccagcgattctccagcatggaggtcttatttggtacatccatcacaagggcccggagccaagatgatctcttgagcacaatccccacttcgtgtttccccttttcactgtgtaggccacagggaagagtactgtgggacccgaggctgcttgatactcatcaaggcccgcttcctccagccttcctagcttctctttccctcaggtctaggcgtggagccctccaggacagcgaacgggtgataaaatatacaaactgtctctgattatgggattttggctccttagccaatgcatgcaaggatggtagaaaaaacactcatcttccttctactatcctaaaagcaacttccgacatcaagaatttttttggatctctcatccaaaggtataaaccttaacagtgggaaattcagaccaggtgagaggaaagggttacacactaagagatgacttaggtttgggtagtttcatcaggagaggtctgcctgcatcctggttcctgtccttgttttgggaaactctttttagcatacttggagtacatattcagttaaacttgcaaagtgaagaatcagagaatggaggcctaaatgtgattcacctgaggccacacgcagagtgaggagataccagtgtgcttcctgcagaagcatctcccacatctctgccaagcctttttatctcctttgaaacagaatctctaatggaataaaccactccagggatcctagagtcttgtgtttgttcctcctatgcagaaaggcaaaggaaaaaattaaataatatctgaataccgcccagtgcacagagagtacctgtgaaattacagggacattcagccagcaaagaatgtccccctggccagggtgcctggaggaaggcttttaagcattaccatgctgtacagcatggggctgccagcttgaccagattctagctggaaggatcaggcatctttaaagaccggtagcattcagggccattgctgggccacatggctcctttgtgcaattagaaaatgcagttccacagggtaggcagcacttagaaagccactggctggacttcacctccctttgttcccttggctagcatcttgggcaacaacattctgtacaagcatgcaccatggccctgctggcttcttggtctccacgtgcctccttcttgttggtcattaaggttatgccattttcccccattattaagtaatgtcaggtaaggtctgaggagatggagatgaagacttttacaggtcgcaggggaacactgacatgtcactcatcattttgtgtgtgtgtgtgtgtgagacagagtctcactcactctgtagccaggctggagtgcattggcagaatctcagctcactgcaacctcccatctcctggattcaagcgattctctcctgtctcagcctcctgaataattgggattacaggcacccgccaccatgccaggctgatgtttgtatttttcgtaatgatggggttccaccatgttagccaggctggctttgaactcctgacctcaagcgatctgctcaccttggcctcccaaagtgctgggattacaggtgtgaatccccgtgcctggccatcacccatcaatttttaaatggtggagtagctcccatgatggatgttatgaaagggtctatgggtgcatatgaaagggagtggtcattactactcagtccaggtaaaactccctggatggagggtgaagacaatgtggtttgagttgttaggtaaatgtttccttatcatttttcattatatgttacatttacattctgttcatccctaagatataactccttaagattacatctctcagatgtaaactccaccagagtaaggactgtcttggttacctactgtgttcatttcctgagactgatgtaacaaatttctacacgttcgtggcttaaaacagctccagaggccagaagtccaaaatcaagatactggcagggctgtgctttccccagagcatctagaggcaaatccttccttgcctctctcagcttagtgggtccagacattccttggcttgtggctgtgtcgctctaatctctgcctttgtcttcacatgggcttctcctcttgtctctgtgtcttctcctttgtctctcataaagacccctatcattggatttagggccctcctaaataattcaggataatctcttctcaagatccttaaattaattacatctacacagacccttttatccacataaggtcatattcataggttctgggggttagggtgtggacatatctttctagggccatcattcagtgtactatatctgagtgcctagattactgttttacacctaggaggttgctcaataaatagttttcaatttaatttatatgtttcagccttagtttatccataagcttgccatgaggttcagaaaccatcatttatatccagagatggtataaggcagtggttaggggcatgaacatccgcgtaatacttgctgggttcaagttcagaatctctgcttgctgcctgtataatttgaggcaagttctttagcttctctctacttcagtttcttcttctataaaaagaaataataataataataaagatcaactttattggggaggggtgactattaagtcaagatatgcaaagagtacccagaactgtcttggactttgtgcccaataggttttggcttttattataaaaataaaagaatgatatgacaatgtacaatatataaacaatctcaaattgtttgattttatcagactccctctccactttcagaaacagctgagagggctgtcactgcactgagattagcatggcattccagaactcgggcccggtaagcatccaggtccaagggtgccttggaggggtacacctcacctttgcagtccagggcagaggaaggcagggaggctaggagtgcagcactgagagagcagtggccactgccttacaaggccaagaagcgtcccatctccccaacaactgtcaggttccttcctgccctgggaacagctctaatctgtctgtttaccacctacctgccagccttcagcaggaattccaggactgctgggcctatcagctgaagtagaggatgaaaaagaacaaatccaaaggcagaagaaataggacaatatgatagatggatttgacaagaatccagaccaattgtgggcagaccaagttgaaaagcgtgagaggctagagttatctcagcaggggtttcgttttgttttgttttgtttttgagacagtctcactctgtcgcccaggctgaaatgcattggtgtgatcttagctcactgcaacctctgcctcctgggttcaagtgattctctcgtgccttagcctccagagtagctgggattacagttgtgtgccaccacacccagctaatttttgtattaacaccgtagagatggggtttcaccgtgttggccagggtagttttgaactcctgagctcaagtgatccatctacctcagcctcccaaagtgctgggattacaggcatgaggactgtacccaaccatctcagcagttattttaaaaaatgtttagccttctgatgagaacacgtggacacgtggtgcggacaacaaacactggggccagtcgagggggctgcggggagagagatcatcaggaagagtagctaacacttaggtggtgggttgatctgtgcagcaagccaccatggtacatgttcatctctgtaacaaacctgcacatcctgcacgtgtaccccagactttaaaataaaagttgaaggaaaaaagttcacttttctgctttccagttgcttatttaaaaaaaaaaaaaaaaaaaaagaagcatctggctgggtgtggtggctcatgcctgtaatcccagcacttcgggaggccgaggcaggtggatcacctgaggtcaggagtttgagcccagcctggtcaacatgatgaaaccccgtctctactaaaaatacaaaaaattagctgggcatggtggcgggcacctataatcccagctattcggaaggctgaggcagggagaactgcttgaacccaggaggcagaggttgcagtcagccaagatcgcaccattgcactccagcctgggcaacagagcgagactccatctcaaaaaacaaacaaacaaacaaaaatgcatctaagttgtctgagtgatgtcctgctcaagtccataagggacttgctttattacagaaaagtggccaaacccagtaatattgaaagtatggtccagggactgcttctggtcaggcaactgtttattaccagtctgtgacaaagacagaaattgccagtaaggtgtttagaaactttaatagcaatatgatatcccaatgggtgatcaatggacccatcttactgaatagggtagagacaagtttgagtgtcgttgcactcacgtggtgagctgcatgtgtcgtgggctgagtgctagtattggtctgtgatggattgggatcagacccttgtccatgaccataaaatcttgagcaatattgcagcaagccaaatggcaaagatgactatgtgccccaagaccacacttttttttcctatagtttttttaagagagacacggcctcgctctgttgcccaggctggtcttgaactcctaggctcaagcaatcctcccatctcggcttcccagagtgctgggattacaagcataagccactgtgccaagcctccctaaatgtttaaatcttgtcattgccaccattctgcaagatttacctttgaatctagaaaagaacttggagtctttctactaggcctatccccacaccacttcccatcatagaggtgaagaacctgaggccgggacacaccacaggactctcagaatgacacagccagtcagattttcctggcacaaaacccagtgttctttcaaagccaccattcttttcctgtaactaatgcaaaagcaaatcttagcccatgacagggaatcacagattccaaatgagtgccctcagaatgactggtttccttgaaagcagctgtttcataaacatgactttgcgggggcagctcaggccttccatgcagtggagtctgctggtcttggggctgctctgttaagcaaaggatgggaaccaaaggtactgacattttaatattagccacacagatgtcttggcttgtaatctggagaaaatcagtcagtgtcccagctgaatctgtaaataggaacgacaataagatttgctctctctcgggacatcctaagaatttttgtcaggctagaagaggcagcctggagagatttgtttgatctgggaaagcagaagtcaaacttggtttttcattcggtaagatccactgtggttaaaatgtggtcagagggctcattcagcctcctacttcaggtcgaactatacttaccttctcttacttttaaagaaggaagggagattctgtaaatgagtggcttttcttttagtcagtgctgtcatatgccatgacaatattgtatttaagtctgttctcacagtgctaataaagacatacctgagactgggtaatttataatggaaggaggtttaattgactcacagtttagcatggctggggaggtttcaggaaacttacaatcatggcagaaggggaagcaaacacatccttctttacatggcagcagcaaggagaagcgctgagcataaggggggaaaatctccttgtgattcatgcctgtaatcccagcactttaggaggttgagttgggtggatcgcttgaggtcaggagtttgagaccagcttggccaacatggtgaaaccccgtctctactaaaaatacaaaaaattagctgggcatggtggcaggcacctgtaatcccagctacttgggaggctgaggcaggagaactgctcgaacctgggaggcggaagttgcagtgagccgagatcacaccattgcactccagcctgggcaacaagagtgaaactccgtctcaaaaagaaaaagaaaaagaaaaagaaaccattagatctcatgagaactcactatcacgagaacagtatgagggtaaccactcccatgattcaattacctccccaccaggtccctcccatgacacatggggattatgggaactataattcaagatgagatttggatggggacacaacgaaaccatatcaaatattaatagagtctggcagggaggaagcatgacttcatactggtggtgagtcagaaggggcatcttcatattttaaggaaggtggcacttagattccaagtgcgtcctgtgtgcagtggagtcatatgcagctctaataaagaacattattcaggccaggcatagtggctcatgcctgtagtcccagtttgttggcagcctgaggcgtgaagattgcttgagcccaggagttcaagaccagcctgggcaacatagtgagacctcatctctacaaaaaatacaaaaattagccaagcatggtggtacatgcctgtcgtcccagctactcgggaggctgaggcgggaggatcacttaagtccaggagtttgagtctgcagtgagctatgatcatgccagtgcactccagcctggacaacagagcgaggccctgtctccaaaaaataattaattatttaatttaaatgttcgaaagaacattatgcagatgcttctcaggcttctcttcagatggcaaaatctcactggttttcaaatatcctaactgaaatgttcagttccagctatcttttgcttcatccagtaattagtttcaagtttttttttgcctctttttagatatgaatcccatgctaggtaacaaattatagtgacaggaaaatgtggatttttccataaagtttaaatattcaccactcaaccttttagcagaaagctctgggaccaacctagcataagtatagagttgagggttaagagtaagcattcttcccttcgtcacttatgtggccttgaaccaattagttaagattttgtgcctcattttcctcatctgcaaaatggaaataatcataaggtatactttggggattagtgtgaggggcaaatgagttaacatgtataaattgcttaaaatagtatttggcagccaggcttggtggctcatgcctgtaataccagcactttgggaggctgaggcaggtggatcacgagttctggagttcaagaccagcctggctaagatggtgaaaccccatctctactaaaaatacaaaaattagccgggcatggtggcgggtgcctgtaatcccagctactcgggaggctgagacagagaattgcgtgaaccccggaggcagaggttgcagtgagccaagattgcatcactgcactccagcctgggcaacagagggagactccatctcaaaaagaaaaaaaaaatagtatttgacaatgacgatagctgctgttattatcatgacccaaatgctatatttgcttcaagcaaatggaatgattctcagaccaaattttttcaccaggcatttattagaaggaggtttcatgtaattctgaattatgctccgaatcatattcacttcattcaatatgaaaagcaagtatagatttacagtttaattgttttgagacagggcaggattcctaatcacatttttagaaatgacttttgtgtctcatattgttcatctcctctatcctctcaccaagattccactgtgtttcataccagcttgttcagttgaacaaggtggagaagcccatttactgtttggattaaatttttttatcaccagtgtatgaggatttgcattaaataaattataggtaattacattaacaaaccaagaagacttacagttaaagagggcaaaaatataatttacttaactgctctatgaaatctatttgtggatttctctcttctcaaaggagaattaatcagagaacaactttgttgttattgttgttgttgtcgtttaagaaaaaaaagaaagaatgaatgaaagatcacatagtagcagtggtaccctattcaccttgcaacagttgtactctgcgcacctgccccaggttatagcaacatcaaggtcaagctcccaatatttcaagtacaaataagacttcacctgtgcacaaacatgtgcttacacacttccatcctcctgaattttctttccagactgttttacagataaggaagcagctctcaaaagacctctctcagacatttgaaaacacattttttttcagagtgctaaattcatgcttcttattttatatatgttagaaataaacacataaataataaacagtcttgcctggactggttcatgttcaattcataggcactgagtattctttattaggacatactcactattgtttgttgaattattgcacttttaagaaatcaatctgaagattaaacattaggagtctcgataaaaaacaagtctctatactttatgaagatcttaggaatttctaactgactttggaacagccatttgttaaaaaacactttcccatcccaaactccactgactccatttttcttctgcactaactctcccttcctcctcccccatatttggagcagcgtctctatgtcccattcactctcctacacctgccaaatcaccagtgactatttaggggctaagtgcaaaggagacttctaaatcctcactttcatcaactgttgagcagcaacggaagctgctgaatgctccctatttcttcttgaaacacactctctccttgtttacttgagatgacactatccttcctctgtccatctgggaaatattggtgctttgaggttcttgacttggggctcctttcttcacttctcccattctctgagtgacattgtctgttcccatggcttctgaaatataggcattctttgatctaattttttctccagacctacccatatagccaactgccccctaaccatatccatttggatccccccagacacctataactcagcatgctaaaaattcattagtcattactttctctgattgattccttttcattgattcttaatctcattgaaaaacatcaccatgcacccagttgcccaagtctgaaatcaggacattgtccttgcttcttttcaccctttcaaatcctctatctaatcagtaattttatataataaaaggattcttgattccttctacactttttctttcccacttccatgacagtagtccaggccaccattatctttcatggggattgatgcaagagcttctcacctagtctcccttcccctagtgttgtgtccttctgacctaacctctgccacccagcagaagtatctttcaaagttcatatttgatgatgctactctccagcttcaaaccctttacctgttttccttggactataagataaagttcaacttccttaatttagcttagagagtcttttatgatgtgacctcctcttacttctctggccttgtctctcataattgtgtcattccattgctgaccactccagcaactacctgccattccttggatgtaccaagctctgtctgtgtcccgttctttggatctactgtcccttctccaaggaacgttcttcagctgctctttatgtggttaactcctactgaaccatcaagtctcagctgagataccactttccctgagccctaaaccctggtttaatgtttcctgtgggcatatttaccttagagcttactgtgtcatagtacattggaagctgatttttttctctatcctcctctagcctcagctgcctaggggtaaacacactacagtgttcacccttgtattctcagatcttagtacactgccaggctcaatgggttttcaaacatatttacataaagaaagaaaacaatgacaaaagtgcagatgacatgcccatggatactctggacataaatgcttgtaatatttctctctgtaagcgtttccagtgggaagttcagcttttgtctcaattactctgattggcatgcaatcatgacaagaaactaaaggaaggagattgttttcttgacatttactgagaagtatagacaagtactgccatgaacaaacattcttgctaacaattcttgctctaaattggttgatataacatccacttgagtcaaaatgattaagtaggtatccattgagtgtcatgcatcgcaatggcaaagcattggagttacagaaaataagtaaaatcatctcccttgctcttacagatctgacagtctaggcacccaatagatgggtaaacaagtactgagagatgtcatacttgtcctcaagatagtagaaattcaagaaagtagtgaccatggaggaccttaggatttgggcttttaccccagtggtgtttggctgagttaatctttctaaaatgtattcatcattcaatcaagtgcttcttctggaggccaagcataattagagatacagagatgaaaatgacagtcattaccctcacaagacctataatctacccaataataatgggaggcaagcctttagagttttttaatttggagttttcagagatttcctgaagcttctggactgacgtttctattgtacttgagtcccatcatttgacattagaagatctccttccaagaaatatttcttaccaccaaaagacagttaactttgacttcagacagaacattctggtctgcacccagaacctttaatacctgaatcttttaaatcagtgatggtctcttcttctaaaaagtaaaaggtaaatcaaattcagtatgtctcaattaattggaagggagtttcaagctcataggaaatgaactacgaagccatgttgggatatgaactgaatggttgctattgagatggagcaaatgtacctggatatcattaggtggaaccagactggaaaatgggggtccttccttgacctcagtgaagatttggccctttcagcctcaagtagtatcccagctccagaactggacctgagttactggataatgctgtcattaggaaactgtgaccacctaggagttggactgctaaatgggcaatgtcagcaggttgttacagatactctatgcagaccaagcttatttggctcttctcagctcagccacctgttgtaaacagctgagaggggcttagctccacgtggaggttgtcactatctctggtatgttgtctctccctgggaacggacatgagtgtggaaacagggaggacacagttgattcctgctttcactgagtcactctgtccattaggagaaacagtccaggcatggccagccaaagggaggttcttcgcaggatcttctgtctctttgaagatgggataatctcaggcctaaccacagaagcagttctggagaagagtcagaatagcagattggaaacagctcacaggggcctctgaatgctaagtggagggacttagaatttatcccagaggccacagaacactattagaagtttcagaggtataataaaggccgttgtgaggttaggatgctggttcaatgtcacaattagagcaaggcaggaggtagagaagtcaagggcagactgggaaccagctgggcaggccactcattttggttgaatttggcaagactgaggaagacaatctaccaatagaggatggatgagaacaccagaaagcaaataaaacaagtcattcaaaaatcccaagatcatcgtggctgggccagagaaagaatcagacagaagcagcgcacggctctggagagttgcagggagaagcattgctgcatccgctgtctccttttctttttctttttttaaatatcagcaatatcttggatctgaatagagttctatcacagattagggtttctctttccccagggttcccaaagactgagcaggatcttattacagatgcagcgaaaagggtacgtttttcagtatcagactgacctcatctgaatctcagcctcacatctcattaactacatgggaccttgggcaagctacttcacccatctgcaaagtgggaatcaatgatatgtatctcatttggctgttgtaaatcttaatcaagttaatatatgtaaagtgtctcatcagtgcctagcgcatagtgagttcccagcttctatagcaccctttcatctttctctccttacagcatcagagagcttgtcctctgtggctcccgtttctctctggccagaggcagagcctccatgggagcatgggagggatataatcagaacagcagcattctttcattatgacgtcaattcagccatccctcaatttactgagcccctgaaaggccatacagtgagccatcattgtaatgaagtaaaagtagctggatactccaggaagcccttctagtggcactttgttaggtgagatgtgtcagcattgacttcttttgtaagtgctacttctgttgaattcaatgcgttgaaaggtggaatgcattgatgaatgtattcagtgccttggccacttctcagttagcttttagagtagaggacctcatggccacatgacagagtctaactgtcagtttccagacatttactgtgcccttggccctgcttggactttggaaatccaaagatacatatgaccgacgcctgctctgggaggaattccctgtccatgtggaacacatctatgcccttctggtccaagtgagaagagaacatgaaggagcaagtgtgcatgcccataagtgccggtccctactcagttctcactcagtcccacagatacccaggtctactttatgtaggtccttgtgttggtttctggcattgctgagatgacagaggccccagtctctggagcctcagagatttcatggacacctttttctgcttgagctcatgagccagatatcactcctggcccaggtcactgggttaccagatgcacgggtgaaagagctgctcttgagcaaagggcctgggacacacatgccggagaagcatggtgagccagccgcagggaggaagagcactttgcaggagcatgctgtgcggggtcttgctgctgcttttcagaagcaggagagccatgagccttggggttcacatcagcaccgagactggcctttggtggcagggaggatatgcgtaccgggaggggttggccatactggaccacagggccactggttgggttgttcataattgatctttggggacacttactgcaacccatttattaggtgccccctctaaagtgatgatctcaatgaagatggttcacataggcccactacttctagaaggcccgaatccctggaccttcccaaccactttttctccctgttcctgggttacatggcttagctggatatttttgcacacagcattaagggcaagtgcactgttcctttgaaaacaacaagggaacaaggagttcagtgttgtggacatttaatgaactttctcctcctaagtacacaataccaaatcagcagaatcacagctgtctcctcccagctttacctaaattcccacatgtgctacctcagttagggaactatgacttcacctgccactagatggccctccatgtgcacataagccgctcccacatagcgaacttgcatcagattttctggatttttttttttttttttacatgtagacacacatgtgcatacacaatcttaacttttaccatccttgaagccaataatcaacactttagttttccttctggcattcaaatgatagaatgtattctcattctctggaaaatcagtttaacatcagaatctacagatattcctgaatattgtgggccacaaagcacatattaagatgaatttgaatttattctattaaatagtatgctttggtttatcttataaatgctgtatttaacagacttgtttctaaattaaatttttttaaagcactggaagagaaaggaagcacaaacatttgaatagtacttgctccatggaggcgggcagtgttctgaggtattttaaacattagctcatttaagcttcataactttgatgtaggtattccatatgcatcattataaccattttatagattgaggagaaaatcagattgcagcatgaaaggtgtttagattcccttttgccttcctgtcaattttcttacctataacatgggaataaaataatccctaattgctgtgaaaggatgttgtaaactctaaagcattacacaaatgttgttattattattatgacttgggtttcatgggaatataattttcttatgtgctcaggaggcttgtgatcattcattcattcacatgaaaacatttatgcaggtcccaggtcattgcctctgcatgagacgtctcataccgagatgcctgtactatttctaaaacaaatctagtctgtcttgaactctcttatagctgagggttccagggaagttgctgtgtgctttcagcaggtaattctcccttagtctcaggatttagaaatgatggatgtggtaggacaacttcaggggtgggacctctgctgaacacagaggtggccggtgctgatttcacataagccaagccagcgggaagaggcaggctgttttttaaaattattattctggagcacgatgtactatctctgtatccaagagttcacatttcaagtggactatcagatcatctctgtgacagagggctttaattaaaagcataagtctctgggtggattttaagtggcattgtttttctttggacgttatgcaagccacttctgtgctgtaaaagggcttttaaaatttggcttaaggaaatttgctttacccctcaggctttgatccctgcgtgtgaatcattttgtatctggaggttccaatttgcagtctcctgggtgtaaggaaaattctaccctcacagaacattttggatttgaaaactgagaaatctgcatcattctcgacataatagctgttgtaaaatagaattagggctgttaagtctatagggataaagttcaccaaagaatattttaaactttagttttagttcctaaagtttttgtctccaactcccataataaatgtactgggacagtgacctacccactcaacacctgaagctcagtgttctctgcactcaggccaggtggactcagccatcgaggccattgtccctgtccagcctcccagggggcacgcatgagccagggccaggatacagatacttctgcctcaacaccatctgtaccaccagaaaagggccccaaaggcccttctcactgccatttgtaaggcaaaatgtctctattttatctaagacaggaaaaaggcagagagatgccagagagaatgcaacgactgtgcccgtgagaaaccaacagtgcagggtggcgatctacccgcagcacatgcaggatgcagcgttagatgctgactcagtttctcagccatacaggagaaaagtttcagcatttctcaaactccatgaccatccttcagtcggctaccccaagccccgttttgctgcagccgggtgagggcagtaatgcagctcagtaggttaaggggccaggctgtccttggacttcagatgatatcagttcagtccctgggacatcttaaattagggcctcaagcttcaaattcatgccttggccaacacgttaccataaatgatcacagggagaagaaacagtcaggccagggatggtggcaggttcctgtaatcccagcattttgggaggctgaggtgggaggatcacttgaggccaggagttcaagaccagcctgggaaacatagcgaaaccctgtctctactaaaaataaataaacaaataaacttttttacaaaaaagagaagaaatggtcagtttacgttgcatttccttcttttcctcaagaagaggtgccccgtggtgcctgggacagctgggccatcacatggaagtggctgagaggtgggctggaaagaagaggaaaatccagggctcccaccaaccccagccaatctctagtcactgggcaacctcaatctacttctggtcatagttttacaattttgcgggggtaggggggatggaatcttgctctgtcacccaggctggagtgcagtggtgcaatctcggctcactgcaacctccaactcctgggttcaagcaattctcctgcctcagcctccccagtagctgggattataggcctgtgccaccatgcctggctaatttttgtattttccgtagagacggggtttcatcatgttggccaggctggtcttgaactcctgacttcaagcgatccacctgcctcagcctcccaaagtgctgagattacaggcatgagccactgtgcccagcaatagttttacactttaatattgccaactttttttcagcccagcctgtgcagccacacaaatgcaaaaaggttagcttaggaagttgtcaacatcattatactataaaaatcaataaatggaaccttcttgcttcccacagtagtccatgctaagcttggcttcaccatcccttgcttggacaactcctaattgttctttatggtttcactctgtaaccctttcatacatccaaatccgttcttttcacatctgtccacatggtctttctagaacatagccaatcctatcactgacttaaagcaaacacataaacaggcagacagacaaacaagaaactcaaatggctttctgttactttccgaatcagactcattagtgtggcattcaagagccatcatatcctgagcctgatcctccctgtcactttctttccctcatgagtgcactcagataggccagtcctacagaggtcctcattcactcacttgagcctgccttgcacatttctgcatcaaagcccctttgtccatgttatcatcctagcttgaaatgctgtctgaacacctctatgccttgatcatttttctcttcaagatcctactgacatgttccaacctcctgaaatcctgccctgcctccccacaagcagagttactcagactctcttctttgcattcctgcagcattttggtcttgcaatttgagctctactgtgcactgcattgtaactattcatatagcttcctccctcatgagatgatgaatttctcaaaagtagagactgggcagctgttactgaatatagcccaacacttgcttgataatgctcgataaacatgaatgagtgacccagaacatttcaaacttcccttccaagacctgaaagactcatatttctgggtgttttaagctctgtgatttctgctctggtcacctgggccaggaactgcctgcctctattttcatttcaggcctttctctctctgccagatgccttgatctctgagccgagtataccttgacccaaagccatgatgcagccctcagcttctgagaggaaggggtagggttcagtagttgcgcctctgagaacatgacagagaacaatagcaggaagcagccaagcgggaaacaatcagcccggcacaacccatgtggaggagcttcctgattggcttgatctggtgggagcaggaactcttacaataactctggaattatcccagtgggatgacaaatttctccactgaggagaagctgtcacctggtaatgtcaagcacggaaaacacagttagcaaaaaacaaaacaaaacccaagacaaagttctcttgaggaagagcagtttggatcagttggaagcctcccagccactgccatagcaccccatgccgacctccttcctagtctctgtttcaggtacaattaagtcgtcatctctaccttccggatagatatcattctgccgtccatggctcaaaggtcagaggtgctgtttattctttggtgtccttttgggtagtttagggaaatccatgctgtaggtgaccacaagagagaatgttcccttttagaactatattgattgagcacaggctgtgtgcaaatactcttctaggcactgtggatgccatagcaatacatgctgtttctgctttcatagagcagtgatttccaaatcctgtgtatcctatggaaagaccaagccaggcaaggggtggagtgacaggagctcccagtcagctttctccttaaaccacagcagctccctttgatcaagatgttggaaaagaaaaatctaccccaaaaagaggaaatgctgaaaacatttggattgggagtggtttcatttgctcttaggcaggacacactgcagggtagcagttaatattctaggctctagctacaagcagacctgggtttgaatcccagctctgccacttactggtggaaggtcataagttgcttgaactctctcaacctcaagttcttcatctgtcaagtgcgaataacagtagtagatattttaccaagtgcaaagaattgaataatgcttacaaaccatttagcatatcatctggcattgtctattacagtaaatgctcagtaaatgtgaactattttacccctgttgtttgacgttaattttttttcaatgaatgactcattgagatactaactcatgcgtcttgaaaacactaccagtctctccagagtaacctccaatatggacaacaggcaaaaatatggtgattattcccagtttgggcatttgtgaaagatgtggctgaggctgtatggatgcgtgtgcacacacacacacacacacacacacacacagaggccgatgggaaaatctaactcagcaggaaagctatcacagagcgctggatttaggcacaatgagtaaacagggatttggaagagaggaatgcaccacataaacaattttcacaatctggtatgaaagcccagatgcttcctgcatgaaggggtgaactcagagagcgtcacagggcaaaatgaagtaaatgctgagactgtccatcattctggcccaattcctacatatctgtgcatcttctacttatggttttatttaggtgagaataaataagagtacctcatagtagataagaatagtacattacacacgcgcgcacgcacacacacacacacacacctggggttagatgaaattgtatatttggggaacttggggtaaagagtacagagccacacagcagttaccttctgcatcctcctgcttcagagaaagcaaataagaccagtttctttttaatctgttgtttttactaagtccaggattgatgttaatttgaatttgttcttttaagattcatttttgactgaaagaactgagccggaaggtctgcttgaggctacttccagttgagaaacaatttatgtgttcattgagacagtcatttactcaaccaacacttactgagaactttcaatgaggcaggttccttgctagatacaggccagctagatgctagaagccatcatcaaaggaagatgaaaaagtgatggtaattatcctctagaggtttgtaaactggagttagggaagggagcccaaaatccatgaatgagtgattaaaatacagtgggataaagttggtggtagaaatatgtccatgagatatggcagcaaagaagaagagcaccttcatgggaaaagtccaaagaagacttccataaagagatgatacctgagcagatgctttaaaaatgagtagtaattacccatgggaaggggaagagagagaacaagggcaatccaggcagaggggtggtatgagcaaagtcattgagccaaacaaggaaatcttcatttctgcaggtaaatgagaggctgggagtgtgtcatatccatgagctttagcagagagcccatgaggggttttcagcaggggagtgctattgtggtgtgtctaggcacattctggattttagggtgatggggctgcatagaagcagagagattggttagaaggttgttgcaggcatttaggagagagcctatactagggctgaagagaagcagctatgaaaagagatttgtggggcaaattggcttggtggctaataagacacttagttgacctggtgactaataagatacatgtacgtgatgatagtaagcgagggtcaagccagaggtgaagacaacatctaggtttccctcctaagtagaatggattaacggtggtaccagcatctgagctagagaatagggaggagcagctctatggagaaagatgagtttggtcctgtatatgttgtgtatgtggaccatccgggtggagacattcaaaatacaattgtacataaaggctggagttcaggagagatgctgaagatatagtttggatagatttaagcatgttcggtaggaattaaagcatgaggctggacatgagtagccaagaattaaatgttaatcaataagaacaataaaacaaataaacctttagtggtagagtaggagaagaggtgcccatatggagaacatggcgtcatggtctcttcatcatggaggaagagtgatcaaatatgtttttaaaaacgaagaagtcaaacagatccacaccaaagagggtccgctggacgtggcagtcatggacttgactaggagcagacgcagcagggcatgagggcagagggactgaggctgaggcatggacttgactaaaagcagatgcagcagggcggtgagggcagagggactgaggctgaggcatggacttgactaggagcagacgcagcagggcggtgagtgcagagggactgaggctgaggaggggtcaggatgtgaggatgttgaggcagtaagagatgactggccttggggaagtctggaagagggattcagcagcaactagaacaggatgcagggtcaagagaagttcacttatttttagtatggaaagagataattcttgtttattgactagcaggaaggaggcatcttggagagaggtgaagacacaggggagaggggatagttaatggggtatcctcccagatcagtctgcacaagctcaggtgcaggggtggaggcgctggccttcaacagacagtctgagtcagaggctggaggtcagaaggtgtggctggatgggactttttctcttcctagaaaaaagggacatttttagggggaaaaggagggggtttaagctattgagaaaagtactgctttgaaatgaaataatctcactttcctgtaatcaaaactctttatttctgatgaaacagactcaaataagaatcacaacaaagaaatcagtgctcagctcaagcctggaaatgatttcctacacggaaatccacttgcacagattctgatagtgtgagtcatgtgattccagatggagtaaatacacatgaaaaggagagaaaagctggtgtctccatgggctgaagcacacttatggagagagaaattttcatttatttgtatttgggcttcaatatgattacatcaccatcaataatgaaaagtgctgccatgtcccagctgtatacttagatcaagatataaatcagtccaatattgttcttttttctcactgaatatctaaatttgtatatttgaggggaaagtagaaaaaccaagccaagattttaaaaattacatttactatcaccatctccaagttacattcactatagaatcctttagaagcatgttcttgggtagctttgctttttatgcactcaacaaatatttattgagcatctgtatgtacagggaagaatgtgaggtacagtaacacaaaatatatagtcctatctcttaataagcctgcacttgggagaaggtatagatagggttgggaaggataaatatatttttaacactctaatacaaggcagagtgtaccaaaagttagaaatgctgtggagaatcagaatgaatgaacataccaggctgggttggggggctgggggaattatggaaaacattcctaaagagatgtaatttgatttgggcttttattatgatatctgttttcagacaatggagttgagagtggggagtccttcctggctttgtcaggagcagtttgaggtcttggctgaagacaggaaggcataaggctggaaaggggtgggagcagaacatggagggtgtgaacttccagccgaagaagtttgatggggtttgggaaggaggtgagagggagccaccaggaaaggatgtgagctggacctttggaattcttaaagggacccttgtcttctctgccatatttctgtctcagggatgacgtgaggaaaaaaaaaaaagaggaggaaatgggcttgagtttccactgacaccttacagtcaaggaaggccctgttctttcataaggaaaagtggaaatcctctgtttacttaagggccattaacatgttttcatattaaaataccaaatgatctgccgtgactccagatagactcatctaaataaaaggaagctgtttccttacaaattgagtcacaaaggataaatatttgtggagtgccatagaaacaaatgcgctgtcttcctgaaatgtggaaaatgaattttgtagcattgatttgcatgaaaacaatattcttcccagtgttctacctagaatattgaaatggaggtattaagatagatgatagataggacagatagattgctagagagctagattagatagatagatagatagacagacagacagacagataagatagatagatcgatgaggttaaatattcttaggatggaagaaggggtcagataatcacatctcagacagatctggaattccaggcagcaggaactaatgaagtggtctcttcagagttttaccatgggacgaattcacccccgattagtttttattctttgagtcacttctctcaagacaaagatctttgggcaagagttcagttggcctagcttagatatgtttctactccttggccagggatgtgagccttctgaccaatagtttcaccaaatctacaaggaaccctagagagacttttttcccagtggaggagctggatgttgttcctaaaagaaaagggcagagggaccctgggcaggcaaaattttcagctgcctgccaccttagcccctgtccccacactcacttctgaaccacatgtgatcagtcttctcttcccaccacataactgaaacttcaaggtcatgggtgagctctatgttgttaagtcttatttataggagcgatcagctcgctgcactgcaaggctggaaaggtgtttaaaatgtatacttaggcatgtcttggctctttctgatataattcagctggcaaaggctctggcaggaagccagacggacacaaatagcgcaccaaagagatgctaagacatgggtgattataattgtgcaaggagtagaaacttctctgctgagactttggatgtggcagagatttggggagtagaaggggggcaaagcacagttccagccaaccccatttacaggcgttgattagcagtaatgaattcacaaccttgcaattgctcatttttttttcttctgctgctgagtcatggataagactctaagctctgattagctgtgatccctaattctcagcacaattctaagagcattccttcaaattcaacaatatgtggtaagtgtcttgtattaattaggattccatgtggatgcaaggaacagagacccacaataacagtggcttaaacaagatgcttatttctttttttttttttttttttgagacggagtctggctctgttgcccaggctggagtgcagtggcgcaatctcggctcactgcaagctccgcctcctgggttcatgccattctcctgcctcagcctcccgagttgctgggactacaggcgcccgccactacgcccagctaattttttgtatttttagtagagatggggtttcaccatgttagccaggatggtcttgatctcctgacctcgtgatccacccacctcggcctcccaaaatgctgggattacaggcgtgaaccaccgcgcccggccaagatgcttatttctcccttcaataaaaatccacaggtctgcagttatgtaaacatccacaggcatgcagttaagagctgtttggtggctgtgccctgtgaattccttagggacccagacctgttccactttaaccctaaagactgatccttgtcaacagtgaccaagatggcagtttgtgcctcagctgcatacatgtgcatttcaggcaaaggatgaagaaagaactggagaagaaagggctaaagaagattctaggagctgacatatagcactttcacttacatgcctttggccagagcatgtggctacaaaggatgctgagagatgtggcctttactctgtgtggccatatgcccagctcagccacaggaatgacattgctttgagagaaggggaggatggaaattgagcaacttagcagtcccctttccacttttacttgtgctgaattcataaacatgtgggcagctttcctctcctctgagcagcaaacacttcttctgaggttcttgttttggcaggttggccagacaggcaccccacttgactgctcaactatgaaactgcagttccagagaagagaacaggtctgaattaagcaccttaagccagttggtcagcatctccttttattcggagagtagttactgagattcaaacccatgtcaactgagtagcaatgtgtttggctatagggtagggcgtaaccctagtctatgtctctcaatagtgagttatttcataaaggctcagcccatcgtcaggaatatgctggtcttgcgtaagcctttttcagaagtgttcatagggtcctgagaattttgtgagcacttctttactgcttctcttgcctcctcttttagttggtgctgagttcactgcatgaagggtcccaggagtcctctttccccttggtttttctactcctttccttttctgctctttctaccacctcctactgctggacctctttgtatctgtactccaccatggaaaataagttttgtttgccccagatcttcccatttcccagagtggagcctttataattcatgatgtttactaaacttgatctctgccctttcaagggatggaactcagataatgaaagatatagggagggatacattgcttaaatctgtgagtgggcattacgatgggcctaagtgtcccaagagggattggcttgccatgggaggtggtgagctccccatgtgtggagaagttcaagaaggtgtgaaataatcgttgggtggaggacagttcaaggacttcatgtttctggagagcaattaagttcaatggcttctactcccagtctgacctgtgcttctgtgagcttgaaaaatatatattgtgttgcaatgtgcattctttagggaatgaaggtaaaagggcaagtggtcatgggaggatgtcaaggataggggcaaagggtactggttccccagccagaccaccagggtccaaattctggctgcacatcatctctgcaaccctggacaagtcagtgctctttctgtgtatccatccatctgtgtcatgggagttgcagatttttttacttcatgggatattgtgaagattaagtattataatgtacgtaaaacactcataacagttccaagcacacagtaagcactcaataatcctaatccttatgattattattgttacatatattactgtatctagcaaaaacaatattagaattgttagtattataataattattatcatcattgatggggaaggaaaaatgaagcccacctgagttcacagacaagaccctctccaaacagtaaaacaattaaaaaccaagttgtatttgtctgtgctcctttggattcaactgaccaacacccaggcaaagggaaaatatattggcttgctttttttttttgagatggaatcttgcactgtcgcccaggctagagtgaaatggcatgatctcggctcactgcaacctctgcctcccaggttcaagcgattctcctgcctcagcctcccatgtagctgggattataggcacctgccaccatgcccagctaatttttgtatttttagtagagacggagtttcaccacattggacaggctggtctgaaactcctgacctcaagtgatccacccaccttggcctcccaatgtattggcttttgtaagtaagaagggcaaaggagtagctgaggatctgggaagcaggaactggagattgaatggcacgggtccccagcagccagcatgctctgtcttcccttctctttgtttgggccttgcaggaaggtaggctctcagcagagccttgaaggccaggtatttgagagccaggcaagtgaagcagaaggagagcatgagtgagccattgggagtggggacggaaacggcgagaacctatccaaggcaccgtgctgagctatgaagctggagggcagcgcaggctgtgacccaaaaaggccacacaaggccacatgctcctgagtgacaggagggacatgtgatatgctgggccttggcccatgctgtctcctctgcctggctcattttctcctcttttctacctggtgaatgcatccttcaaggcccagttaattcatcatctactttgtcgagtttttctcaccacctgtatcagttgagaattgcattcagctatgatcacaacagaggcttaagcccataacaagcaatctggagccaggcattccagaagtggtgtactctttccatcgtgccctctgggacccaggcaatgtctctctttctgcacactcagacatactattgcccctgtggacataggattactgctctgcctatagcatcatatcccttgcagtaggtagaataatggacccccagagatgtccacaggctaagcctcagaacctgtgaatatggtaggttccatggcaaagaggaattaaaattacagatggaattagagtttccaaacagctgactttaaaatagggagatcagtatcctggattatctgggtacactttgtataaccacaagatccttaaatgtggaagagggaggcagaaatcagaaggaggggtggctgcagggaaggtcagagagatgcaacagtgctggttttgaagatggaggaagggacccacaaggcacggaacgtgggtgacctcagggagctgaaaagggcaaggaaatggattctcccctagagcctgcagaagggaacacaacgctgccagcaccttgattctagcctggcaaaccccgtgtcagacttctgacatacagaaatataagataataaatgtagattgttgtaagccactaagtttgttgtagttgttatagcaggaattggaaacgaatgcgtctctttagcaccaggtccctgtacctggcaggaaggaaggaaaggcaaatgtcacttaagccaacgctcctttccttttttttttttttttttttttgagacagggtctcactctgtcacccagactggagtacagtgttgtgatcatcactcactgcagtcttgaactcctgggctcaagtgatcttcccaccttagcctccagagtagctagaactaagggtatatgtcaccatgcccagctaactttttattatttgtagaggtgggggtcttgtcttgccacgttgctcaggctggtctcatcctcctgggctcaagcaatcctccagcctcagtctcccaaagtgctgggattacaggcatgagccaccgcacccagccctcctttcccttttagggagttgtgtggaagtcccttcggatcatttttacttacatctcattggccagagctgtcccatggccagctttatcttcagtggaagctaggatacataatttttttcaggtgggcatgttgccatccccaaccaaataaggattctgttagtttggaagagggggagaatagatattgagaagaccactcagcgtccccaccacacactcccaggcagaaccaactattctacagcatgttgttctttcctctattattgctatttttggtttgtattgtaatttatgtgttcacatggctgtttgcattacttgaccaagaagtctcatgagcagacactgtgtctgatttatttctccatccccagtgctcagcatagtgcctgatacagagaaggtgtttgcatgaagttagatggatgaatgtctaaataaactttgaaataagagcatgatcgatgcacttcccagagcgagagttcctttctgttttcttgtgaggatgatctattggggttaggtacattttataagaccatttggccatgattgcaacctcatctccagtaaattaaacctacacagctgcagtgtgtcacctttccttatggcttattacagtttgctttttgctcagaaggaactgagcaagcaggttagaggctgttatgtgcacctgccacagcctacggatcctcaattaaccttgcgtgtaaattacacttcctgcccattctttatttttagcacagcaacatctacttggctcttccagagaagactgcattagatttcagtcatgaaactacaaaacagtggcgtctgcagcctggctgggatgactgttgttaaccccatgacactctgttccttgcgaagctgctttgccccaggactcaggttttcctgagaaagagagcagcctggactgaccacaccctcagagcctggcccaaggccacatgtgaacttatagaaaaatctgctattggatctgacataaactctccatttccttcattcattgcatttgggttgaaactcagttgttgttatcacaaaggtttcatttcgttccttttttttctctccctctctcttcgttccttctcagttacacagtatcatgacccaaatctttagcacctgaaccatatagcgcagagccttgaaacccatagggccagggcaccccgtggagacaggccagccagtgggcatcaggtcgcagagaattcttaaccacttaaggttgcttcactggaagaagtgagttactgagagacagccattttcggttttagtcagccatttttatcacgatcttgtttgttttagaatcccctgtagtgcctagctcggagtccaaccaaacaagctccataaatgttgattttgaatttaaatagatgttggggtgctcccatttccccttcactagacacatgggaagctgaggccctggcccctctttcatgccacagcctgggagatgctgccttctcagcagaaagcctcaggaggtattttgaaaagggaatttgttgttttcattctggttagataagttacaaactaattttttaaactgggaaaatattgaaaattgttttttaaaaatgaaatcacctttaattccattactcagagacaactatcactgacatttttctgttttttcagtcttaattctcatgaaggtgtgccctgtttccctccagatttctcagaggattcaggattagggaagggaggagagggtgccttatgttctttctaatcgtttagctttgggtattattgggatatatataaatacattaacacacatataaatatatgtgtatatatattatataactggcatatacattattgggatatatattagtaggatgtatatatatatatgtgtgtatacatatgtgtgtgtgtgtgtgtgtgtgtgtgtgtgtatatatgtaaaatgtatacacacttctatttgacctgtaccagttcattattaccacaataatgctaactaacacgccctcaaattcagtggcttaaacccaaagtcatttattcttgcccacacttctgtgagtaggctgggtatttgctgatctaggctgggcttagctgagtggctctaatttcaggtgcttctgaactatatagctgagagccctgaaacccatagggccagggcacactgtgcctatctatgggtttgcctcaggtctattccatgtgtgttctttctgtggtccaggctgaaggggcagcagctgcccagataagttattgtcttggcattggaaggggtgcaagaggacaagctcaactgggcaagcacttttcaagcctctgcttgtgtcttatctgctcacatcctattggctaaagcaggtcacatggctgcggccagtgccaagggactgggaagtgtaacccatctaccataagcctagagcaaatcacatggtcaagattgacatcagtggcttggggaagcatgtactcttcccatggaagtaagggaggaaggaagggaatatttttgagaataatgtaatcttttttttttttttttgagatggagtcacactctgttgcccaggctgaagtgcagtggtgcaatctgggctcgctgcagccttgcagcctctgtctcctgggttcaagcggttctcctgcctcagcctctagagtagttgggattacaggtgtgcaccaccatgcccagctaatttttgtatttttagtagagacgggctttcaccatgttgatcaggccagtcccaaactcctaacctcaggtatacgcctgcctcggcctcccaaagtgctgagattacaggcatgagtcatcgcaaccggcccaagaataatataatctactgcacaccctaaatatctgctaaagtactctgtactttgagatttaaatcaaatctgctcaggccaggtgtggtggctcatgcctgtaatcacacctcaaataaataaataaataaataaataaaacctgctcagagcccacctggttggtagtatcatccagtctacacagggaacctctagtccagagctcctctactcattgaattaattcagtttctggataatgtgactgtctcgtgtgttgttcctatttcacactcatgtctctttacttactccccccaaaataatttacacagatgtgtgtagaagattttgctgaacatctggaccagcaaagaagttttacatctttatgttcgtatctctagattggccagccccctctccataaattctctttgcgtctcgcccacacacagcctctcaagttaaagcttgctgaagaattcactcttgtctccaaaattctgaaagtcttatcttggctgggccacacctttgcgcaacttagctcagctttttaaattcattcaatgtaggtgtattgagcatttgtgccctctgtctgaggaatttataatctagtaggggaaattaataatgtatgttactatttggggccagaaaattctttgctgtagggtgccatccggtgcactgtgggatgtttaccagcatccctggcctctacccactatgtgccagtaacaccagtcccacccccttgagctttggacaaccaaaatatctctagacattgctgaatatcccctgagggacaagatcacctcagttgagagccactgctctaatatatggtagacttgataagacttctgataaaacaaaataatgtgctaagaaatgttcagagggaagcgatgttatttcctggcagtgaaatctgtgaacacctcatgacaggtggcatctgagctgagacttcaagaatggttgggagtttgagttgagtttcctagaggaggaaaagacatggggtacatgtgggcaaataagagtggctctatttgactaatgcatgaagtgaaataggcatgttgttagagtggagctgataggtactgggaggctagataccatggggacttataagctgtaggacttctacttttaccctgagtgaaatgacaaatatttcagagctgtgttcatttggaggaggttaatttggatatagggcttgccttcataacccaaagtaattgctgcaaagattatccctccagaggtcacttttctgacacccaggaaggaaacagaaaggccatctgaggggcacagtatgtcgctaaataaattcatgcctggatcttggtgttccttacctttcagaaaaccccactctgaactccttattttaggtctaagtctaatggccagttcccgagagcagattaaaagatggaaaaagagggccaggcacggtggctcacgcctgtagtctcagcactttgggagcctgaggcaggaggattgcttaagcccaggagttcaagacccacgcaggcaacatagtaagacctcacctctacaaaaaaaaattaaaaattagctgggcatggtggtgtgtgcctttagtcccagctccttgggaagctgaggtgggaggattgcttgagcccaagaggtagaggctgcagtgagctatgatcgtaccactacactccagcctgggtgacagagtgagactctatctcaaaaaaaaaaaaaaaaaaaaaaaaaaaaaaaaaaaagatggaaaaggaggaaggcaagggaggggacttatataggcagacacagactcagcagcaaagcttccagcacaacagaggggaaagagaccaaaagaaaaaatgaatgaatgagtgattgaatgaatgaaccaatgaataaattcagatcaaataattcaagaggcacagcaatctagagttttagcaagagaacatttatcccttcattcttcctgaagacattgctgcatatcagtgccatcctactctgccaatatatgtaatgtttaacaaggtgggggatgtggagaacactttagatcccatgtggtaagagttgctcaatggttaggaacagggtctagagtcagagcacctggcttgaatccttgcttcaaggctctgtggcactaaagcctgctttactaggttacttcaccttgccaagccctactgatctcatcggtaaaatggggattccctactcacagggtcattgggaagtttggataaaataatccacatgaattcttagctcagttcctggcacagaataagtgctcagtaaatactggtggtaattattatcatttcactgaaagaatatggctgttgagactttccccaaatcatagctgcagctgctattctggaatatttccagagtctcctggcagtgctgaaatttcccttttataaaatacataggatggctgtgaaaattgaggaaagttccaaaaggcaggggcagttgcatctgtcttcttcatttcccttctttttggcagtagaatccagaccacagagggagaggacaccaggctcccaagggtactggccaccagctatttcttggcaacatacttcctttgagcaagaatggccctttactttttgaccaacctgagagagcacttactctgagccggtcaggagaatatgaagctattttccttctgatgttatgtcctatgctatgtaaatataatctccctccaaataagaaaggtgcacatgcatggtgttggcagggaaacatcgaaacatattgcatagtggtggctgtgaaccagtggaggcagtgctgtgttgatttcccttgaccaatgtctgcccagtggcagagctggaaacacaagatgctgtgtaatgtaaaaccttggcctggctcctcagcgtaatgtaaaacaaaggctgccaggaaggtacaaatcgcccaacaggaaggagctgctctcttgcccgtggatggcaggacaataaagtaacttgtcctttgtttgtgtgttttccaggctggagcaagaaatacaaacgctagaaagtgaagagtcccagatatctgccaaagagcaaatcatcctagagaaactgaaggaaacagaaaaatccttcaaggactttcagaaggtgaagaaaaccaaaacgatttctcaaagttatttccatggggaagtagggcctagcaaaatggtgctaactgggaaacaggccagtgggcattgatgagaaatctgagccacgaactctatgaaatgaggggcagatgtgtgaggaccaggggccatcctgaagctaagcatgacatatctttgggtgtgggaccatctggcctgctgcaaggcatagggaagagtcattagattaccccatctgcctgctctccggatccctgatatgccttgtgcctgaaaagccttctcttattggactctagaattctaaaaccaattctgatgaagcagaataaacatgctctttgtggctttaattatagtttgctttttgagtctttcattataaaaaggccagaagcaacaccttatgaagtggacaagaattccaaatacaaagagtgtaaatacatgacattttactgtatatagaaacagatggtgcctgtaatcccagcactttgggaggccggggcgggtggatcacgaggtcaggagatcgagaccatcctggctaacgtggtgaaaccctgtctgtactaaaaaatacaaaaaaattagccaggtgcggtggcaggcgcctgtaatcccagctactgaggaggctgaggcagaagaatggcataaacctgggaggcggagcttgcagtgagctgagattacgccactgcactccagcctgggcgacacagcaagactgcgtctcaaaaaaacaaaaacaaaaaacaaagacaaacaaacaaaaaaacaggtggtgccgtgtatcaaagagtagagtccgtaaaaccagtaggctctgaacaaacatctcaggacctccctccattttataactgtttctgctgtacctatgagtgacagaaaagcaatctaatgaaatcaatttaggatgggattttctgatatcattctccagcatgaccaaggatatttgctagatcattgaaataaatctctattgggagaaatttagtataaattgggaattataattttggaattctaaataaattgtccagaagaaaagagatcgttgcgtttccccagcacagtcaaattctgggctggggcatgggagaaagatgggttaagtctttaaagatgggaaaagatgggattgtacccccacatgtagagtaacgctctgccttgtttttgttcctacagggtttctccagtacggatggaggtaagtgctctctgccccgactgtagatgaatgttttaatcctggtcagcttagggggtttcattaacaggggcttaaggaagaggtactgtgttgatttgtaaaggcatcagaagaagtagcagcgctggttgcaggccactgaggaggtccacattccaagccttccctgcctctcttcttcaggaactatctcttggctcactgtttctcctcttacaaaattggcctggctcttctccttcccattagtcccaacactcactgcttgggcctctcttgaaaggtacccagcaaagaagagtactaacatcaggacctggtcccttgtagggatgagcccatttgtcttggtggttaggtcctcaggttgaaacatacgtgagaagtttaagaaatttggggaaaatatttggtgtttgggaaacctttctacagcctctggattttctttgctttctctctctctctctctgatcagacaactgtcgtttctttcatagaaacagggctgggcaaaaacttccctccctgtgtgggatagttggttcagagcataggaaggtaggagtggggtcctggcttcctggtggcaagagcaggtctttcaccttctctaccttccctacctttcctctgtcctctcctctccttacctggactgtggggatgaacttgagattgtgtacttctcacccttcaccttgctccctatcctcagctgcaaacccatgattcctactttcatttggccctcagctagacctgctttacaatgcagggacttgttggaaagaccagatattgtctgctcccctggctcttagaaagtcacattctagggctgggtgtggtggctcaggtctgtactgccagcactttggaagactgatgtgggaggatcccttgagcccagaagttcaaggctgcagtgagctatggtcacaccagtgcactccagtctgggtgatagcaaggtcttgtattaaaaacaaacaaaaaaggtcaacctctagactaggaagatgatcaggagccaggataagaattggcatcagtgttttcccagcgtcatttggaaatatacggggaaaggtttaaaaatgtgtttctctggattagtcaaaggtatttgcatgaaggatagttctgactttggcaaaacaaacaaacaaacaaacaaacctgtgatttttaatttttttttcccctagcaagagacctggattttgtctccccaggtgatctttaggaaggtactaaattaaacttcatgctctgagtacatgtaggcagggccaagtcatgtccaagctagcaaggactctaggaaaagcggacctacaatacttctaggaagtctctatggtgtgaccaagtcagggcacttgttctgtgctttgggggtggggcacggattgaggaagtggccttggggaattgtgggtacagcatggggaggatggcaggcttccctgagtctgggaagacctgaggcatgccacacaattagcaataatacagtgcatgtcaggctgggatgaagtgtgggacactgacccatgaacacctacccaaagagtgcatgtcggccttttatgctttcactttttttttcccttcccttctcaaatcaggaatttccctagacatctctctgatacttagggaagggaaagaccctgtatgtcatgttcctgaggagtctgtgtggggcatggagacctgtcatactctgtgacttgttaacaagcaaaaatgcagccgcatcataaactctcaccacctctttcatttttacctcaaacttctttcattttcttctgcattgcttcccattgttttcacttatccacctaagccatttgtagaggtggtaagaagcctagtcataactgaaaagagcctgcagggaaagttgcccacagactccatcctccaggatgggggagctcaggcttaagaggatgcaaaagtcttagggatctcatttcttgggaagtggcccagggaagagtttccgtggtcttacctgtcaccctgcattataattcctgccatctgtggttatcaccaagcctgggtgacctctttatctgtcataccacatctattagcaaagaaagaagtttgaaggcgggaacacatacatcccagaatgtgattgatgtatatagagtcacaatgtggtgaagcacatcccagttgagggactttgggatgtctctttatcttctcattcttcaatttcaaaggccccgagttgccaagaccctcttagaatcatccaacttgctacaaaaaactaaccagatattattatagaacaatggtgacttaagaaacacagttaatttctgatgcgtgcagattacagaatccaggtccagttaggattatgtaactatacagacactgcagataagcagcaaaagcatcccaactcgtgaggtgctatgagatagctgctggtgtctgtgtgtgtaatgaccccatctcaggtaacctaagtgtgtccctctatgcatggcagaggaaatagaggtaccgtactgctggatcaccagtggcttttgattgcatgatagcctgggcaatcaagaacaatttattctattcttgagtagaatctcctggtcatatacattctgacacccactctcctcccccgccaacacacactgttgttatatagcagaacgctcatctattgggtgggttggttttcactgtcttaggcataatgtcttgtacacctataaattgcatatagtatatatctggtgctaattctgttctttacccactgaggagggagctgatgcaaaactcttgccagaacaggcaaaggaaaatgtctgtcctgggcctatctcagtccttggtgtatgatatggatcttcttaggttcccatcccataccagtctgtggtggcttagagcgtttcccacatcaaaaccttcataccagttattcgcaaacctcaatcttcagttgcctgtaagttatgtgtttgtttgtttgtttatttattttgagatggagtttcactcttgtcgcccaggctggagtgcagtggtgccatcttggctcactgcaacctccacctcccaggttcaagccattctcctgcctcagccccccgaatagctgggattacaggtatcagccaccgcatccagcctaagttatgttttaagaagagttttcatcaatttgtttctctggctttagctgtttagattcttcatagctactgtaaatatttcagcgggattagaactaagaagcagcactcatctttaatttctactctataagttactgctttccaccttctctgtcagtggggagaatagtgttagactattctgactttggcaggaagagggcagcttattaattgaggccacctgaagaagtttttcccattgaagttttggcaagcctgtttgttactctttgtgctggcctatcagacacttcctgtctatataaccttagggtttagtacttaatcatatattgagggggctgctctgtcctctttctgatgccccattctccactcccttatctttctctcgctctcttttttttttttttgagtcagcatctcactctgtcacccgggctggagtgcagtggcgtggtctcagctcactgcaacgtccgcctccagggttcaagcgattctcctgtctcagcctcccaagtggctgggactacagacacacaccaccagtccaaatttttgcattttagtagagacagggtttcaccatgttggccatgctggtctcaaactcctgacctcaagtgatctgcctgcctcagcctcccaaagtgttgggtttacaggtgtgagctactgcgcccagcccattcccttatctcttaacagaagccatgtagcccaaccctctaagtgctgtagacttcaagcttgtagccagtaaacatctggcaaaggtaactccatcatccattcccatctggcagggagctatctcctggaggaggctgagacataagccctgggaatcacatgttctttcagatggaaaattccctgtctgtaagtagtttttttttttttgtttcttttttaaactgctaaaacattgagtatgcagacacacatgtgaccagtccatgagatctcacatgggctccagcctccatcttatttgaatgcagaaagtcaaattcaccaagatcccattccacagatttctggaaattatcagtgaatcttggaagttctacaaatctgctctggtcatcccttctttcctaaactgaccctctagtcctagattactgcttcactcttcccacggacaattgtcacccacctgcccctaccccctcaggactactgacctcaaggtgctgctctttctagttctgccttgtgctgctttggggcacagacccttcctacagccttccacagtgggaattaaaggaaagagaagtctgtgacctaagtttaagaatcatggaggtggctcacgcctgtaatcccagcactttgggaggccgaggcgggcggatcatgaggtcaggagatcgagaccatcctggctaacacagtgaaaccccatctctactaaaaatacaaaaaattagccgggtgtggtggtgggcgcctgtagtcccagctactcgggaggctgaggcaggagaatggcgtgaacctgggaggcagagcttgcagtgagctgagattgcgccactgcactccagcctgggtgacagagtgagactccatttcaaaaaaaaaaaaaaaaaaaaaaaagagagagaatcatggaggtgcagttcaacatggagaataatgcacaacttcagacatgtggcttcactcacagcccctgactcaaatccaaaaccatcttcagggggtccctgcaggctgctttccagccatctcccagcccaccatcatctcaaaggctcaatttccttccttgcagtgaggggtgccttcaaccatgtctgccttatccaggatccaagctccaacacatataaggcacctgagagggaaagcaacttgagcctcactccaccctaagtcctgctgttctaatcttcctttctcattccttctccccaaatggttaatatggaaaaatctatttttttttttttgagacagagtctcactctgtcacccaggctggagtgcagtggcacaatcttggctcactgcaacctccgcctcctgggttcaagcgatcctcctgcctcagcccctctagtagctgggactacaggtgcatgccaccatgcccagctaatttttgtatttttagtagagacggggttttgccatgttggccaggctggtctcgagctcctgacctcaggtgatccacccgccttggtctcccaaagtgctgggattacaggcatgagccaccgcgcccggcgaaaaatctgttttcttagcgatactctacctttgcctatgaacataatggtctaatgtcaatacattctggattgttcagactcatttgcaagtcagaaaagggtctggttggtctagaactgaactaagcctagtccagtgtgtgtttgcaatcctcttcagcaagaaatgaaaaagaaagctgctagaatggaagcagtacgagtggggatgcagaggaggggtcagtgatgagaaatgcggaggattttgaacagaggcagaggctattgaacagattggataccagcagggggaagagtgaagggtgctgctgaggatcccaggtgaactgcagtgctcgtgagccaagatagaggacaggagaagcagcaggtgagcagagatacaaggtccattttgcacatgttgagtttgaggtgattgtgggatattcagtatagacctacagtgagcagttagatgtaaccattgatgactgatggacgttccaggattttgtgatatggtcgtgatgcaaggaagggatcacatctcatggtgcccagctttccggaatcttcctgctttcactttcccacttctttctggggtgtacccagatttgtcttgtcttacctcaggggtttcctcctttcctctgataccttggcatgcttgctaatgttcatgctccccatgtctcacctccctaaagaggcttgtcgaggtatttgcccaagcaaatctaatgggctccttcttttacatagcaacattccctgcaactgggctaatggtgggctcaaggggtattgtcatttagaatctcaggactttctagctgaaacaccagcctgcagtattgaaaacatgagatcaattctgaagtctgtttatttgttgtaatgcatataaaattggtcttttgaatgaatcaggctcataaagctatattgccagttcagggaatgaaccccataataatcagacacagaaagctttatttccggttcagagaatggatctgtttttcagtactgtttaatgtacatttctagttccatgttttctatttgtcaatcccaccaagttgataatggctcccacaagcccatctctgaatcttccccccgtccctgaactcattgtcctcctagaatctagagatttctgatgactcttctaatacatagagccatcctggggcttgagctctctggccaggatccctcctgcctcagctactctgctgaataccagtcactgggcaaatgcttgtctttgtttaccctgatcctcctgttcagtggccgcctcagcggtccattatgtagggcagacaagctgctgtctcggcagtgaacccattgggcctcccaacactgtgactaattgtattccctgttctctgctaccagatgcagtaaattacatttcctcccagcttcccgacctgccaatcctctgttcacgaacagcagaaccatcacctgggcaggacgggaccagcagagcggctggtaagtcctggggacctttggacgctaggatggtccaaggggcttgcatttcactgagctttattaatgagatgagtgccctgctatccttacatagggggagctcaccttcagcccagcctcagatgcagccttcacagtggccacacaaggcaggcaccggccccagatgggtaactgaggaccaaatgggaaggagttctgaggaaatcatacggcatttcacctccgacttcgggggagtctttctttggtgtttgtggtccttatatctgtgtttattctcaaagttaatctgtattctgcctccagggattttcattttcctcattggaaatatacaaattgagagagccatccatgatggaagctggatgggaaatattttcaaagcctgtggtatctttacagaatcctttgggaattgtgctatttgtatattatgaatacatatattcctaagtcttcccatttctggaattatttcttagccactgtggtatatttgggaggaaaagaagcaatttaaagcacacatgttacttgctaatgtgtctcacaattggaaattttacaaataatatatttatgagtgttgagtgtagggagaaccatgctttgctctgcttaatgcagacatgcctcagaaatcagaactggaaggatgcaagcaataaatctgtacacgaacccttatgatctacacagaaatgtgctgagggctgggggttaaatggaaaaatgaattgcccaaggttgcatggttagttacaacataggtgacttcaaatatgagtatcagattctgctttgcatattctaggtaagtgtatgtttaaaataaatcacataatggcagattttttaaagtaaaacaatcatggatgtttaagccagaggatatcttttatataggccaacctgaatatttcatgaagcaaagaatccctacttattttaatacaaaagtaaaataaaaggcaagtaagaattaacatagttgtcacgtccactggctaatttaaatatctgttgggcatctctgtaaacatcttagcagattacttttatgtacagactcacagagtcctagagatggttgggactgtaagtggtatctggtcaatccagagccagttccacatcttcctggacagtgacaggatggataaacaggaacctgcaacctgcagttatgcttcaaaggactcactggcagtcactttaacattggactctttaagtactccagggtacacttctgaggtacacttctgaggtcaacttaggtaaaatgtgtttaagagtgacaccccttccctctggttattagagacatgggtgttgatggctcctgatagttgtgggtaaacaacttctcaggtcctctgcacaagttcctgcacttcaaaggacacaggatatgatccaacatatggatcagcttatgggagggtagggacaatgtatgagaaataattttaagagacagaaaaagaatttgagcagtgtgggtagtcaaagagtttaaagttcaagagtaacacatgaatgtgattgtagtgctgtgtaagcagcaatacacattattaccacaacccagctccctttatctttgaagatcctgcaaaacatgattttaaaagccaatgcattttcaaaagtataatgtgatcagaatctttttcaaagtaattttacatatgtttctgctgattagttaagagttaatttgcgtaaatgcatctactgtgggattacatataagcagagctatggaaggaattgtatttgttacgatgaactcctttgtccaggctgtttagggaatgggatgttcagattcatgatcaattatggttaatggtgactacacagagcatgtgtggcttaccaaccaagggtactcactagaattctcctagatacagtccatcttgctttaggaatgtccttttggaaatttatataacctcagggacattttgacaaatgtcacttgtcattactgagtagtataacaaatatcctggttgtttggcgtttggaaggtttgggactctgtataaatgggaatttatttagaatcattgcttttcagaattaggagacatctattccaatcctttatccaaacattgaatccttaacatagcagccctgtgaagaggtcctcaaaccctggtcacacacctctgtgattcatgtttaatcttcctccaagtttcccattccatctctggttggttctgactattgggaaattcttcctctgatggagccatcatttgtctgccttcatcatccacccacttatccttatcctgcaccctggagctactcagagcacatctaagttctaatttcccttcaagtgtagaaagtcactgttatttcctgtttttcccagatcctcactctaaatcccctttgtgctcacagtcccagtctctccagctggtattgagatgatgagattgcctttagacaccctccgccatccctgtccctcccctctgcacgctcttcacttggttgctagtcttcttgatgtatcatgctcagagctacccaatgccttcagagctaggctgctcacccccaaaatagagcacgacgctgcagaccacatggctgactttgctggcaatgtggcctttcagcttcagttttgaaaggcctcaaagtcatttcatgtgtgccactgctcagcctcactccgtttatccatagaattgttgtttctgagtcatttcagttgaaatgttcagtctgtttcccctagctatacatatactacttcacctgttcatacatagaaggacctacagaattcttttgttttttaatctcgaaagacaaaaataagcatgagctatgcacttttctgtcctttgtagatttgctatgactattaaatttcttcttgttagattgtctctcaagaatgttgcgggtttcatggaggcactgaggaaccacagcaggaagtgggggaagggaatgatgtcatgggatttgacagggctctgacattccctcccatttcaaacacgcgcagttcctccatcctcatgtttacatattgtgtttccacatcagatttcacttgaatctaggcctcaacaagttttgaatgtagaaaaccctcttctctattgttagggtctttgtagctcatgattatggtatcctcatagcctcactttgcttctcagtttagtaccccctcaaatctgaaaaagcaatcttttattattttttatcatctcattgctaaaaatgttgcatgttggaaccaaagtcagagccctgtggcacaccattagagatctcttggccctcaataaccctaaattgacatctttggggtatgatcatgcaaccactaacaagttaattgtcttaacacccaaggcacatgtttctgtgtagtccacaggaatataagggattttgtgataatccaaatactctggatcttttcaaatgcaatttgcctattctttccagagaccttgaacagaaaagaaaatgagattaatctgcatagtttctgcttgattaacccatgctggctcttagtcatctctggtctttgaagattaactttagaatttagctagccatgatgtcaagctccttcgatgtagtttagaatcccctcattctcatttttgaaaatcagacctttgagtgtcagcttccagcacctttcctgatgttcaagattcttgagacaaattcaacaagggaactgggaccctgatcccaaagcactgagagcctttatatccctgcagtgctatgttattttccaatcttctctgctcatctgggcttcacttccctttctgccactttctttctggcactttacaggctgaaaactctccttcttgaccaaaaatagaagcaaaatcagacacaagaaattggcttgcctttattatccatcaacatcacacccttgctgacttatttttgttactactgaggtgtcttggaaaaacaattgattcacagaaatttttgatcactgttttttttggggggagttacaattttttattgatacataataattgtacatatttatggggtacatgtggtattttgatacattcacacaatgtataatgatcaaaaaagggtaatgaggatatccatcatctcaaacatttatcatttctttgtgttgggaacattcaaaaatcttctagctattttgaagtagacaataaattattgttggctttagtcaccctactctgtattgaacattagaacttattccttctatctaactatatttttgaagttggagattgtgctttcggatgagagggagaacccattctgaattaatttcctcatttttattgtcattggcatcacaatagccatttttacatttccagcccaaagataatatgtgaacacatatttatatgtataaccatttgctcgaagggataagactacccatatgtgtgttcattcaataagtcaaccatgtgcattgcttgtctatcacatgccaggtgcaatgccaactcctggatgtttctgttactgagatgaccctgaccccccatggatgacacttatgatctgcttctctcctactgtactttacgcatcactgactcgtgaaccacgcagggtgttcacagcaccataaaatatcaaatctggataactttcattgtacaaatgagaaaatgaagccccaaaatggggtgtgatctggataggaattcagatcctatctttctccctcctcccatctccctgactaatgacagcggaacatgtggtgcttatattttagatgtgggctctcagcctgttcctcctcccgtaatcacagtgagtgaaagaaagtgagctgggaaaagcctgaatcaatgattgaactttccatcctcctggaatagtcttgttttgtatgctcttggactgatgctcaaatgtattcatgtccattgctcttcccgccttgcttgtgtcggttactcttgttccctcttctctaggctccctacagcccttgcagttgctttcactctgccaaaggtgaaggcaacaggcaacacaggcatgtgtagagccagggggataagtctgaatcagaaccaaacattctctgctcctcagacccatctctctgggccctgcagagcaatcgcttctctgctcaaaactaccaccttggtttttaggtgggcaccttccccagaggcctcacactccgctccacacctgggtgttttcagaacctagagactggaattctcaacctcaacttaatgtctctactccttcagggcgtttccctattgatgaaagaattattagggagcaagaaccaagaaaaccaaatgcggaggcccaaaatcaaagtatccatgcagtcattcatctgtatccctttgaataagctagcaacattcgttcttactctctttaataaaaagagcatattaaaataaaataaaataaaataattcttaaaaacagcatattactcagctgtctcgctggcttcttggaaggagtagcaaatatgctttatatactccaatctcattgtcatcagtatatagggtttggaaatcaataattaaatacataatttaataaaaacatacttccagatttcagccagcctatcagtgaaacttccattgaattgtcttctatttcttttccttcttccccaggtccttcatccaggaaaatttccagagctttccttcaaatacttttctgtatgtccatgtatgtttcaagatttctttcagggctccccagaaagccctcacccctcaacagcactccctcctcattttttaaataagatgaacaaaggcagcaagccctttgaccctcatcattatacaaattgtagtgtacctctgacatggagaagctggagagaagacagggcaggttagagagtatgctctgtgctttgtggttagagacaaagggatgaaaagtgtgagaggccattggtataaacttttggcagcaacaggaagtagaagagtttttaaaatcttgtgcatcaaaaataagacattgcactgaaaacgtaagtcttatgttcctattggttcatatgcactctagttcatgcttttgtatattattggctgagaactgaagcaaaatataaatgcttactcataaagatgacatttaaacattcacacctcttgcatggctttctaaaaggcctagataacattctcatatatgtatccatgaaaacgaaatattgcctttgggttaagtcagagcttctcaaagtgttcgcctttgttctctttactggaggaaagagtgaatgcagaaaggaatgtagaatcacactcttaagtgtgatttgtggttcctctgaagccttatgttttatctaggaaaaaaatacatatgcattttgtgacataacatatctaagtttattttattataaaattatattaaaattcttaaaatattctatgctcatattctaggaatattggaagaatagtgtacaacatgtaaatataaataggtaaccctagtaaaaccatgtcacatgtggttcagtcccagagccatatcacatttaaagaactacagcttaaaattgcacaccaaaaaaccattaagaaggtgttctgttctttaactatttctcctgaaggatattaaaagggaccttggccgggtgcggtagctcacgcctgtaatctcagcactttgggaggctgaggagggtggatcgcttgaggtcaggagtttgagactagcctggtaaacatggtgaaaccccatctctactgaaaatacaaaaattagccaggcttggtagcatatgcctgtaaccccagctacttgggaggctgaggcaggagaatcgcttgaacccgggaggcagaggttgcagtgagacaaagtcgcaccgctgcacttcggcctgggtgacagagtaagactctgtctcaaaataataataataataaaaaataaataaaagggacctaatttatatctccactaagtaataattctcatattcacttttctttcctccacatatcacctgctctaaagcatcatttaccaccacaaaatactccttctctatgcatatttcatacagtttttactctctttcccactaaactccttctttctcatttgtgtattatgtggatatacttaacctttccagcaaagaacttttcatcatcatctctcctttcttccaggctctgattctagaacaggcaaagattaaaatgacagaaaattggaccaacaatgatcagcattctcattggtgggaagagggagagggatatctgtaaacatccccatgttaataatttgtatttttatcctatcacatatggatataaaaatagaaatattttgttccatattctgtattgatcgcaggccagtgtgtggatttgttcacagataactgaatgtttgcagaataataagatattgtacctacaaactaacaattattactttccttatttataactgtgtcccatgagtgtgttaatagtgataagatatattctaatcccaaactgctttttaaaataagtgttatatttcaagaacaggcttttggagtccatgcaaattttaaatgcctattctattcttctgatggcacattttgtgagaaatcaggaactaactgagataaatgtttatttggatacacagtcattgtgtgtgtccatgcacctctatgacaaatgctggttggcctcccattgtgtcacttgaagaaacttgagatctttatgctgaacaagtgaaactttcaaaatggatctgatgaaaaccaaacatgggattttgtttcataatctttttagttaagtgttaaccaggaacagagtgtatcttattatgcaagcagatggaacaatatcatcactgttattttttcaaacaagttcaaacattaattactgtgtgtaccatttcattggtgtcatattatacaaagtatttgttactagattacaacaaccatattagactcttgaattattagcctttgtttgagagatgtgtatattgggtacctgctatacaaatggctctaaggtaggtgctgacagggagggggcatcatggataggtgttgggcaagaaactaaccctcaaaagatcctaaaaatctatgaagctgatgaaacattcccacagataattatacaactgagtggtaattgttaagagccttcagagaagtttagaaaaagtattgagaaaattttaagagagggatgacttagagatggaaggatcaaagaaagcttatggaagaggaggcagttgaccttggcgttaatcaatgggccatatttggatatgtagaaactcaaaacaaagacatttcaggagaagggaatcttaacaaaagcagaagatatttacgtctgggatggtgttatttggttgtgctaaatggaaaaggagcactagaacatatggttgaaaagatagtttggatcttcttaacacagggaacttattcagaaagaggtagggactcaagacaatgacaagcagatgggctagatctctagaagtttggaggagcaacagaaggctatctaggcagagggacagcaggcacacagatgagcagccgtgggaggaagttgagtgtcctgggaatagtgagaagtcgttatggccacaatgtgtaaagaatgagagagcccacaagacaaggctagaaaggaagtttgcagacacatcctgaagggaactatatgccatgctggggagtttggtgtttattttctaaagacacaaggaaccaacagagggtttatgactcaagtaactgtgggcaggatggagcacaggctggcaggggtcggcaaaatttttgtataaatggccagattttaactattttagactttgtggaccatatagtctttgtcacacattaattgttttctttctcttttctctttccttcccccatcttttcctccctctctttcttcttctccttcctcttcttttttcttccttctccttccccttctcttcttcttcttcttcctcttcttttttttttttttttttttttttaaagaaacaaccctttacaagtgtaaaaccactcttagctcctctggccatacagaaacaggctcaggctgtctttggccctctggccacagtttgcagtcttctagactagagcaagaagacagaagtgttaggtaaaataaaaagcaaggctgttgtgcagagagcagaggagggcctggactaaggccttggtgacagaaatggtggtgaggagatggatgagatatatctgaagtagaatgatttactgtcagtgagtgtttggctgtaagaaagtaggaagaaaagaacaagtcaggtgtgattctcaggcctgtggcttgagagactaggtagcagtgctgctgttatttggcatggagactgtggaatagttttgatagaagaagctggagtcagtttggaagctgctgagtttgatgggttcgtggcacatccagataaagggcacctggagcctggtggctctatgggcctgatgcacagtttcttcccatccaggaagactgtgaagaaaccagtttggaagtatgaggtgtcacaagagtctataggacaggaaagagctgtccttagcaaccccagactggcagcaagagttgggatgaattagaaaggatacaagactgagagacaggggcaaggggagggggagaccaggtaggaagctcttccaacaatctagggaagaggaagtgaatgtcttacattgaccagtagcaatggaacaaaaagaagacaacagatgggaaaggtattaatggaacaaaaagaagacaacagatgggaaaggtattgtgggcagcaggacttggcactctgtgcatggaagatgaaagaggccttctgcgatcattgtcttcaaattccagtgtcctatgtgatgttacttctgtcttgttcttttcttagttcttattttaggtacctagtttagtgactgaagtactcacagggcacataatatgaatgctcccatgctttttcaattgttgaaaatattctgttgtatagtacagtggaggatagccatgacccacctatgaaaacctttgtggaaatgtagagaaaacgaaaacacttgatgaaagaggttttttcatttatttaaaattttggacctggaacacattttaaccaagggtttgtaaattgtctgtcagcctgggaagccctcagtcaaggtagtttgcatgttgccagcctccatgaaattcttcacactaagatctaaagtctcttgtgcccttattttagcagatcttccttaaatgtgtgagtgccattgagatatagcaaccgtgcatctgtcttccaagtgcattaaactgctgtgttacaatacagatataaccatctttattcacagtgcgcacctcactctaacactcaagatgcttggcagttagaatagaaagggcacaaaacctttttttttgtctgtttggcaattaaccattcactggctttttttgttgtaacatgcacttcctttctcttgttttcattcaagctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgcggctgagcttgtgtccgggaggccggtctcagacaccacagagccctcatccccagaagggaaggaagagagcctagctacagagccagccccaggtacccaaaagaaaaagcgctgtcaatgctgtgttgtcatgtgaccacttctttcttctcctttcttctgggcagcctgtactctccaccactcacgtagacctcactgtaccactaactgcaatactgtgaactggaagcaaacacctgccttgccttgcagttgaattgctttgatctctctcattttttttccttttcctcacctgagagacaacgtgcatgtgtgtgcttcattctctccaagaacttgcttttcctctaaacctttccttgtgtcttcaagagtgaatcacttccttcctgctcgattggaatggactcttcgtatcagccagtgatatggtagccttaactcacttgactggaattgaacccattggcactgggggtttcattttgtagtgtgttcctgtaacgtagtcacacactgccatgtctctggtttctcacttgcctcctttgctgtggatctttgtttttatatcttgtgtggcaaaatgctgttggctctagccggttgctagtgtagccaaaagtggaccttacttagtctgtccgatctagggtgatgctttttgctgccttacataagcttccagattacagtattgtgcattcatggctttctttctgttaaaactgaaatgaagtcaatgtagaagaacccagagcttgtcacagctgaaatgtagggactgattccataacctgcccatcagcggttgtctctctttctatggtttaaccgatgaaccctttatataagaagcaccattttaaaatttctaaggacatgaaacaaacattgtttgaagcatcagtagcaattgatctccaaacttaggcaaattcacaagccttgtttctattctcttaaaaaaatgtaaatttttatattgtttcttttttctggatattttctggtcatgttaatctattttcaatgaggagatcatcttgagaagtatctttgcagtgaccatatttctaaaacagtctgtccaacctacaatggttgccatgatgctcccacttcatcatggatggtgctgtaatgcattaactgttcatctcctccccagttgattacaaagccttgcatccatactcttttctttctggccccatgagaaagagaatgttttaggtaacttcaacttgtaggtttatctgcccttcaaaaaaaaaaactttaaaaaacttttaaaaattaagaaagacctatcttctcaatgttaagcacttaatttcataacaaatattaagtggcacatagctgagcttcttagggcattgttttgtttttagcttctggagattccagaagagcaaagaatattttttatctagaacacaatgaacagtttttgaaataccttctcagcactcccccaaagcaaaaagccacatatgtagtaaaaccaaagggaaacaatttaataaaataacaatagtatagtaatgaaataaagatataacatgattactggttttaataagagttatcttaactttaagttatttgcccatttatagcattgttatgaattattcataaaattatgtcccacagtatatagttttgaaaaaacatatgatatactacatccagtctaacttctgtggaaagtagatcagaaaaaataagatagtcttgagagaattttattatagaagctgtctaatttgacctattttgcttgctcagtgctaaatctattgcttttttttaatctcctggcttgaaattatatttacttcaataggaaaggtaaaaacatcagtttttacttttcaaagttaattttctgaaataattgcattttaatgagcacaaaatgggtcattttatttttattatactcatcttgtttacacctatacataaacagaaaacgttaaagaagagaaaaataaaggagctaagttctgctgttgaagattatttcatccaaggcttggttttgaataactgagggaaatatctctaaatctcaagttcatcaaagcagctgcaatggaataaaattgctattttatcgagaaacctggtttggatgcttataaattccactactctcagcttcattttcctgagtacgtggtcactgaagcatcatttagacattacataaactggcatgcagataaacctatttacatagagggagaaaacagtttcaatgtcttggacaatctgttattttaatgatttacttaagaaagaaacaatctgaaagcttaccatagcttatcttttctactcacttggagattcaagctattcaatgtgagttttaaaaagttaagcacagttagtgagtgaaatggtagaatgtagaacctttaagcttgctggttgataaacagaatcaatcttccaggacagataattccctgaagggacctatccttgcataagtgaactagttactcatacagaaaatgatctgcacatcttactacaacactacacacaagaactaaaagattaatgattatctgtattctcttcactaattactattatgggggaataatgattagcaaattatatgaattcgagttctctctatacttttattagtaaagcttatcatttaatggactgaagtaagatgtgttacctttattcgagctatttgtagccacactaaatgaaggtgtgtttgaatatggcgcatatatttgcatatgtcccatcattttcttgtcataatggggaattcaggcttagccagtacttctatgggatgagacctataatcccacctatagcagcaagtaactacccttcatgatgatagtgtacatggagctgtgattatgaacatgctgcctttcctgctgccattggcattctctctgtaaattttattatgtgtggtatcacactctccaaaaatgcagggtatttggttacataaccaaactaattaaagaatcagtaatgaaattgcaaaaccatgatcttttttgagctaatgattagttgggctttcctttaaaataatataatcaggccgagtgcagcggctcacacctgtaatctcggcactttggaagtccgcggcgggtggttcacctgaggtcgggagttcaagaccagcctgaccaacatggagaaacccccatctctactaaaaaaaaaatacaaaattagccaggcgtgatggcgcatgcctgtaatcccagctactcgggagactgaggcaggagaatcgcttgaacctgggaggcaggggttgcaatgagccgagatgtgcactccagcctgggcaacaaagagcgaaactccatctcaaaaaaaaaaaaaaaaaaaaaaaaatcatataatcagttcccttttaaatagaaagaggaggaaaaaaaaaaggaaaagggggggtatctcatttgtatacaaatagattttcaatggcatttaataaaagattctttaatggttaaaatgataaagattaattctacatatcttgaaaaatcttaatgacttctgtattcttgacttcttaaaaatattttctttcttttagtgtgcaataagacaaactaaggggaattttttcagcttgtatctcttttacccatattattttccttgcataagcaaaaaaataataattgcctctaaaactgatttgacagtgttcagtgacatcatttaatattggtgatggggtggaagagaaggtagggaatgcccttatggccaaacctaaaacacagtttccttgagccttctgagcaatcttagaattattcagaagctttcaggaaactcaaattctattaatttgatttggttcctttccaaaatgttaatagacatgtatttgcttaaaacgtctacctattccatttaatttcctgctgataaatgtattttatctacaagcaagtagaatattttgttttggttaaagtcaagtttttataaaaggaggggaagtataagagagagtttcctagagatacaatatcatctctggagcaaaatgttgaggccaagtgtaaaaacagactatttctctttacttcctgcagaatttcatttcaagggaccacagcacacccttgaaaattaccatttatttaatgccagttgaaccaatgggtagcaaaagaggagggagggaacatggtcatagagacaaaatctaactactataccaggtcttcctttgtaagaaatattagccctgccaatataaaacgcagatggacatagacagaataagcatcgaggactttttcttatttacttgaaatctagaagctcagtcatctctgctcatccctggacccactggagagttttactcactaacaggtcctttcctggaagaaataacctcatctcctgccatattagtttacaataaaaatcattccaaagtgagccatttcacattgcatttttgccacatgcacatttgctattgaaaccacagattctcagcataagtaagacataggtgtttcagaaacttcataaatacacgatctttcaggtgctcctcaatttcttaatcaaggtatattgaactccagtgattaggatagaacctgaaaacatcctttgttctattggatagtacaacacagcaagagcacacagttatttgtataataaaacaacttaattaatgaggaagatgggatgtttgattcctgctaccaccagttcacttcacaaaggccttcttctggtattaccaggaaaactttcctgcattttctagggaaaaagaaaagtcgtttattaggagcacaatgcagatatgtatctgtgttttcatagcttcagcaaacttcttagtaaaattcccatttcaacaaaaaccaaaatactgattgtttgaatgtagaaaggtatagaataaagactacaaaggggaattttaccagggctccttagaccagcttccccagcataatttttatataactcaagtaagcctctgcttcccctctcctttccagtataatataagaaggtcggaactgtcgcacaaaagaacttgatttcaatatgaaaatataatatgtaattttggggactgcagactttctgcatcaaagatctggacagccttaacttttataaaaataatttttcaatgttctcttttactaaccaggaaaacaagatgttttctgaaattaatgactttttctattttgggtctgttttctaagtttttacaggttgaggtataaagggtcgtcttctcctcatattgcctcttcataatcacctggggctattttttgcaagtcactgcatttttacaaaaaataaaaataaaaagtacatctcacaaatcataaaattctccctagacttcagacagtccttctggagtgaaagaatagaaatacagaaagaaaagaattacagggtggctttctttttattttcctatggttaatgtactgtatggtatatatgtttacagaatgtatctgccttgtgatgttaacaaaatgaatgacaaaaaatagtactgatgtgccatttgacagtttgccttagcatcactgtttatgttcttcttttctgtcctttttggtaaaaaaaaacgcaggttgtattccaaagctgtattaacacaacattctcttccccactcctacccagccttcttcagagctgtgaatttcattacaggagcattgaggcagaaccttgcaggtgtggcccaaaggggctaaagtgggcataggttgggatttacttctgcccgtctaccaaccaaacacgtatctgtgttctcatataagcctgcaaaattttacaccctgcctttcagggagacaggccacatggagcgcatgacctcttgtagtcgtctcctcacagtccttcccactgtgagagaaggaaacttgcagacccccaactggatctgggagcatatttttaagcacagttggcattgcttgaaaaagcaagagagatggactcaaattctatgattgagccatgactgaggaatgtgcccattcgttatagtcgaagatgagtaggatgatatgggtgagaataggagtggctgtagaaatggaatattttacagttatgtatttttttaaggaatagtatttttataatgaaatctatatacattatggagcttgagttggaaaacacccttgactgagctatttcttcattccattaaaggtaactttctggggagtcctatagcactaggccaagccttgggggcatgaacaaagggcctgtcacttggccttgcactgccattacatgagatccagtgtttccaaataggccttggttggaagattgagctttctatacctgccattaggtagattagatagatggcttgatagctctctgggctatacttttaataatatataataatctttgggaaggagatagctattttaaatgcaagcaaagcccagaaactatcaaagtccaaatctttcacatatttaaggagtaattgccacatttgaggttaagggaccacttactatggtgcatttgagaaatatatatgaaacggtgagtcagagccctctgaccatcttcagtctacacataagcagataaaccaccaatataaatcttataggggccagacgaggtggcttatgcctgtaatcccagcactttggggggccaaggcaggaggatagtgtgagcccagaagttcaagaccaggctaggcaacatgttgagaccatgttgtttagtctctactaaaaaatataaaaattagccagcatggtggcacacacctgtagtcccagctacttgggagactgaggcaggaggatcacttgagcccaggaggtggaggctgcagggggctgagatctcaccactccattccagcctgggcaacagagcaagactctgtctcaaaaaaaaaaacaaaaaaacaattatcagttggccttctacataacacagggctacactgtatttttagagttaagtagatacaggaaaagattgtctttatccataaaggagattctgaatttttagagttcctgaatattttcccccaagtttctgtcaaattcctgaagtcccttccctatcacactcagtttcctgaagctcttcccctacacctgctcctctgtctggctaacagagttgtcatgtctcagaaactactcaccactcttgtgagactctcttcccaagcatcatccttcctcaggatgaggcctttttctactacccaagagatcaagaccctttttctaacaagacaaggttatatctactccattttcaagagaaataacccctctggttcccatgcaaatcgcttaaattccttcatcaccagaatctctccaacaggcccaactccagcccagctgtgaacactgctgtcatggagacaactccaaaatgaaagaactatgcaattgcctgaaggtgctaatggagagccagtttactctaatctcttattactaaggaacctctcggtttcgagattaagtgggcagggagacatccagtcacttagttttgcaatgacaggtcttgatatacacagaggccaccaggcaatgcctgatccaaactattctgtatgtagctccaactccaattctgtgatatcctattctggcaggtgggaagagttctattctttgcagggttctggaacattctttcctgctctcaagctcctgacttaggagagtcaaaatcatacaggggttccagaaaatgttgtgtctgatgcagcttctcagtgaatgtaggttgttggtgaaattttcagctttagcatctcactcggggtgagtgatgtctctgtaaatactttcatttgtggttggttggtgggggtgggggtgggagcctgtcgtgcttactctgaattagcttactgggctagctgctgtactttgtaacctgaagtgtactttgactgttctgtttccttcagatgaaaaacaaaataaaaaccgacttcagaaaagacactaccagcgacagctgatgctgtacttgtagcttctctctgttcctctgtacagtattaatagacaataaactgccttttcactgcatctacctctgtgtgtctgtgccctgattctttccccttctcacctgccactagcggacttcaggccagaccgtgttgggagcaccttccgctgttcactaaaactaaacactaacccagtgcctctcaaactccagtgtgcttcagaatcacccgggggtacctgttaacagtgtggaagcttagtcacacctctggaactcagattccgattcccaggtggggcccagtagcatgcatttgtaataatgtctccaggtgattctgatacatgtggtacctggaccgccggtttgggtgccccttggtgggaatcctcatggcccacctgttgtagttggtttctacactaatccaatctcccaacatgtcctccctctaaccccctttgcatgtctctctccacaactgtcatccttttcttgttccttgcaagctcccagcagcagcccagactgtgatcaaacttgggctgccccttaggctaagtgacagggttcatctggtgcagtctgctgtttaagagcatctgaagacacgtggggactttgtttctcttgttcacctctctttacctggaacagggtcagcatagtttttcaataaatggccagatagttttggctttgtgggccaaatgatctctgttacaactactcagctctgctgcaaagcagccatgtatgacatttaaatgaatgagtatggccatgttctaataaactttatttacaaaaacaaatgctgggtccgatttggcctatgggcttataatttgccaacccctggcctcaaacagggcctggtccatagtaagtgctccaaaaaaaaagtttcaaaaaattattgcatgaaagaatgaatgaagagtagatatgatgcctaccacctgcagagcagtcacagaaaatggttttctttgaggagattaagtaaatgaatcagttgggagttctcatctggttgggttccatggtagattttttaaatgtctttatgcatggaaggtaactttaaagatggaaatatgagtggtgttttatagattgctcaaaccgccaggttaagattgacaagagtttcaaccaatagaacgtggaggaaatgcaagaacatcttgtcctcatcaaaagtgctggggataccagaactgggtgctccctatgtacctaagcatttagtgcagttgtttgtggagctatgttttgtcagattcatcttacacagtgaatggcagggctttctttacattattctctttgttaattgaaatactttttaatgtgtagttaggtaggctggaaccatgatagcacattacacatcccacagttctagagcataccaacgggttcaaatgtaggagcatatggaaagtcgtgtgcttacattcatccctagtgttgttgtgaagttaaaggaaattatatttattaaaagcactgtgtaagctggaagtagatgacaaatgttagtttagttataatgagaaagtgtctgttgcccaaccagaggcctcatgctgtccaaatatagagattataagctgttcaggtgtgtttcagaactagtatagaaagggaagctgctttggcctcctttagatttgtgactagttttgtagtacattgaaccttatgaaattgccattttgtagatccataatattgactattgacagttccatatagttcaacctcataattcgattctggggattatatctcatcatggagggcaaatgattaccagatgaactctaaatatagcaggaggaattagatgagaaaattagaactttggaagggaatgtagttcagtactaccaagtagacctagacatttcacctgatagggtaggatttcctttaatctcacatcaactttgtaatgtagccattgaggttactgtccttttatacatgaggaaactgagttatagagatagtaagtactttggctaatgtggcagggctaaaaatccgtgtggggtggaggagggccaagttccaacctcagttgtctttacttcctcccacacagagagctatgttatgaaagtggtgtggaggccgggcgctggaggccaggtgcggtggctcatgcttgtaatcccagcactttgggaggctgaggcaggtggatcatgaggtcggaagatagagaccatcctggccaacatggtgaaaccccatctctactaaaaataaaaaattagctgggcttggtggcacgtgcctgtaatccccgctactcaggaggctgaggccggagaattgcttgaacctgggaggtggaggctgcagtgagctgagatcgcaccactgcactctagcctgggtgatatagcaagactccatctcaaaaaaaaaaaaaaaaaaaaagaaaagaaagtagtgtggagatgcccctgagactggagacaaaaagatttagataatgaggttatttatgcaagaaagacccaatggcaccagttcttattttgcacctttacctactcaagcaaatgctctgttaattataccaccccctggaggctgggaggcatctctgcagcgcttccttaccaaaggagaagcggagggtaaaatcactttgttttcttatctgttcatcaggagtcctgttgttctatttgacagtttttccttcaccattcataaaaaggattaacaaaattgcccaaaacaactctataaagtctaggagtggcacgtcagtctctgaaaaagcaaagggggttttgttattgttgctgatgatggtattgttactatttcaccactgtcataacagcaaagaggaacagctgccctatggtgttatgcaaatgccttttgatctaggctatatcatccttgtgcagctattaatagaccacatcatctccccagcagcccccaagccctagcttctgtcctgcttttctcaaacagtattaaatcttgcattttatcaacagcacaaaaaagcaaagatttgctatttagaagtggacacaggaaggggaatatcacactctggggactgtagtggggtggggggaggggggagggatagcattgggagatatacctaatgctagatgacgcgttagtgggtgcagcgcaccagcatggcacatgtatacatatgtaactaacctgcacaatgtgcacatgtaccctaaaacttaaagtataataaaaaaaaaaaaaaaaaaaaaaagaagttaaggttgcaagatcttaagtgatcatgtagggcagaagtcagaaaatggttatgcagattctgggctgaatctggcctacagtaaggttagtttacctgcacagcaattaaaaatcattttgaattcattgccaataataataaattaagagagttcttattttaaaagtatatttccgacttctcttgagaattcagtctctggcaataatagcctgttctccccactggcaattgtctggagctgatggtggttgctaactttagaggagccatattccgttgttcatcaccaccaacaccaacaccaccaccatctcctattatttttaccaccttctattattcttactcttggcccacttcctttgtctgtatcacctgcctggcccctattggcatttgagcatgtgacccctaatctaccatcattcactcattttatggctgggtcaaataagtcctaggtggaaatgggacttaccttagcaagataacagcagactcagaactaaagtcccctgaactctttggatgaatgaggctttgtactgtgttgggattcaaatcttctaagggcatttttagttttgaacaggctacaagcagaaagctaatgccagaatctagtgcttttgctacagaggaacccatgtgacttatataatgatgaattaaccttaggttaaatgaacagtgtaagtttgtaaggaactttagggtatcctgtgtttcatggtaaaaagtttcattcccaggaaaataaatagatactttgtagtcaacacctcaatagttctggaggcttcatgttccttcttagcaaaaataacaagaggcacagcccatacttatttaaattgaaatgtgatcttccatgccttcctaatccttagtctttgattgtgttcctgaggtcatgtggttgtagaatactactattctgtattgtccactttttttatcttcctaagagcaataatcctcacagaagcttgataattcaaaggactaatgaaacagagatctttactcccagggcttgtcataaatcctggccaatatggtgaaatcccaactctactaaaaatacaacaaaattagctgggtgtagtggtgcgtatctgtggtcccagctattcaggaggctgaggcaggagaatcgcttgaatctgggaggcggaggttgcagtgagccgagatcgtgccactgcactccaacttggcaacacagcaagactcctctgtcttaaaaaaaacaaaacaaaacaaaacaaaaaaactgatatgatttagtgtttgtttgttttaaggaaagactaattttttttttttttgagacagtctcactctgtcacccaggctagagtgcagtggcatgatctcagcccactgcaacctccgcctcccaggttcaagcgattctcttgccttggcctctctagtagctgggattacaggcgcatgccaccatgccaggctaatttttgtatttttagtagagatggggtttcgctatgttggccaggctggtctcaaacttctgacctcaggtgatctgactgcctcagtctcccaaagcgctgggattacaagtgtgtgccaccgcatctggccaaggctaattacatttaagatgataattgtatttcccaaattaaaaaaaatatttccaagtcactgaatattaaaaacacgagctgtgggcctattctcttcaggccagggttcttaggtcaacctcagacaacctgaaagtgagataaattctgcagttagtgtgaattattcagactatcagaatctgccaaatcaaattccatttcttcaagaacttatttccagtcagagtacaaagatagagtcagcttttctacttttcctgaaagactgcctaaattctaactatagctcagagactcagtgtgaggtgctgtcacataccttaactcagtttttcctcaaacttcagacttttgggcatcatatttgttatttttgtcctgtgtgtaccagctcgctcctgttaaaagaaggaaatagccaggttagagaggtgtcaaaaacatagctccatctctttaatataatcagatgggagtgaaagagaatcaagatagcagtaactttcttgctatgtgagtcagtgttacataatgccatgcccacttacccccaaaatttaggaaacactgtcttgcctccttgcatcctcttaaaaaaaataaaaatcccaattcctcgtttcaaagagactagggttagaaatagaaagtgacttgctcaaagccacaagaagagcagagacacagagctgggattcagacccaggcagggtgacttcaaattctttccattgcaccaggtgcctgtcatgctgttccttttataaggattgaatcgagtacatcagtagcaaacttaaactctccagtaagatcacgatcgtttaaacaaacaaaagtaacatctgttccagctaaagagctgtctctggcataagcaatttttcaccgatggaggctagatctgattgggctcttgctgagttaattgagcaaagttacgtggccagatgtgagttttcagatagaaggggaagggaatgcaatatacaagcacatggggagactgatggaccaaatggctggctccactataaaacactccagcgtttagcctttgttctgcctcctgggcgttagcaagctgactcccgcacagaagacttcttggttgactcttgaagagtcagggatttagtcaatgcaagctgtaaactggctcagcactagagaagcagcagacatgagtagaaaaaggttctcccaaagacagctcagcttcacttttctcttctctcttcactcctttcttctctcctcttttctactgaatgaacttaaacatttttcagctgagatgcattcccacctgcagggtgaactgaacttttaagaagcctattaattctcccaggaagcaccaggctgcagctctctggttctcatttcttgcttgctatgtattagaacctgggacattttctccaaaatataatgctatgagggcccccactccagagatcattatttaattggtagggtgaagcctggcacatttattaaatggttccaggtgattctaatggagattcagccagtgttggaaacagcagcacacgggtgcccagggctggccgcagtgagtccgggctatgattcttgcctcaattctgcaagccaagaaaaacgggctttggattcaggaacaaagcaaagcccaagtctgtcattggccagctgagtaatcttaggcaattaatttcaattcaccaagcctcagtttcttcttctgtagaatgggaataatacctaccttgcaaggcttctgttaggaatgtttcccttctcctttccttcccattacaaaagaaatatatttgaggcagttgattgaaaaaaaaaaacagcagaaaaagaaacagatggagaaattaggccaagagaaaaataagatgaaattagaaaactccatctagcttatattactgaacgtttacttctctcacttgtttgagcaattcagtttgtaaaatgtaccacataatactactttatcaaccaaaccacttaattctaagatcttgggtctattttgaaaacaacaaaaacatgatgtgacagaagcagcattcttgagtgtaaagggacccatggactgagctttgtctcatttatgcctttatcgtatgacttagaggaagtcatttttcctctcttggtcccaacttgctcatctataaaatgagacaacgtgattgtgggtgacattctgagtggacgccaacctcaggagtatttttctataatttaaaaagaaaggagagaagaaaaagagaaggagaaaaggaagaggagcgagagaaaaggaaggaagaaagaaggaaggagggacagagagaaagaaaaggaagaaaggaaggatgaaagaagggaaggagaggaaggagaggaaggaaggaaggaaaagaaagagaaagacattaagaggaggggagttgttccttgaaggtgctgaagtccctggcctttagaagccatcacatcagccatctgctgtgcctggccctgtgaagttactagtaagccacccgtcactgccttgttccagggtcttgaaaccctgtggctattttcctgtgtatgaaattcagtggggggaatacctgcctgaccaaaatttgtagttccccatggttgaaaataagagtctgaatcttccttttaaatatatgaacagaatcgtctttgcctgccatctttgtgccctcactttctccttggagacttggcaaacccccccaccttgagggagaatactgcagacacgtgccactgctcccctattctagatgttttctccaaaggaacgttgagtttgtgagcaacaggctgacagtgcttctctccacagacaatgtttaactctggacaaaatacaggctccttctcttgttctcacttgtgactccctgctccatgaatgtccagtgtactgggtctgaaagcagtaagccagttctgctctttaatagctctgtgtctttgggtcagacacttagcctctttgctctgtaatacaccatagagagttgtcttaagtataaagatccaggccaggggtggtggctcaagcctgtaatcccagcactttggaggccgaggcgggcagatcacaagctcaggagatcgagaccatcctagcctatacagtgaaaccccgtctctactaaaaatacaaaaaaactagccaggcatggtggcgggcgcctgtagtcccagctactcgggaggttgaggctagagaatggcatgaacccgggaggcggaacttgcagtgagctgagatcacgccactgcactccagcctgggtgacagagcaagactccgtctcaaaaaaaaaaaaaaaaaaatcctaatatttccattgatccaaagaattttagaagtggtagatagaaagttaggcatagaaactccaagttgaatggggttagttagctgaagtttggctgaagagagtttgttttcatgtcttttcacctaccaggagaaaatttccctcattgaatgttggaaggagacgtgggaatttttggataatttcctgaggcagtggctgggtaatggaaactctcattgtgagcgtacaagcatccatcctcatcactaaggcactctcctactcagtaagaacagagaatcactgctttgttctctttctccagaattaagatcaaacccttctctctggaattcaacatttgctaaaatgcaacaacttcttctccatcacccccctccgcgaaaccttagttcccactgattcccaacataaatttttctttttaattaaggatcccaccctggccctcactggccattttcaccccttccccacacttggcccatgctgttctgtgcacacttggaatcatgtccctcttcccctggagaagccttcatcctgctcagcccagctgcagtgctttcatctcatactgccccctgcacccacccacctttcgctatcagccctcctctgcacactgcactcctgctgtctttaccatacggctgacccttcagtggggctcctctgtattcattggataaaatactaattttttagttccaaaatggatcagtagcagcacctttgatctctgaagtagttgactttcaccctgagacacagacttatagaccatagatgaaaaatgacaatcaagatataatgcataagttgagcacggtggtatgtgcctgtaaatcccagctacacaggaggctgaggcaggaggattgcttgagcacaggaatttaagtctagtctgcacaacatagcaggaccctatttctttaaaaagaaaaaaaagatgtaatgctatcttttggctcccaagagtcagtaggaaggatgggagaggaggggacaggagcccttgccagaaaaggaaattgtagttttattttctcccgtatgtcagaagagaacagattggtatggtgtgcaggtagccatgggtcttctcttaccaggccagaggagaggctgaacttccctcagcagttcccaagcaagtttagcagcagaatcatagacaaattgtcttcctatgccttgcagtgtgggtgcttgtttactatttgagggaaaagtgtttaggcaaacaggtatcctgagggtgaccagctgtgcaaggattaggctactgaagcacaccagttctggctggtgggaatggaactggagctccccagcagggctgccaagtatgattgttcaggttgcatactgcacaatcctggaaggctccattcacatcaagtacaatgtgaatggtgctcttggagttgttcagtgcataacatgcatactacacctgctcaggcaaaagcaacctatccgttctttggaacatatagctaaaattcaaccagaaacttactttataatcatagcattgcacatatattaaacttgctgtagcctgtcaagttgcaggaatcagtttataccctgaagactatggacttgacttctaggaaccggtaatgaagacatacttccagggaccaggcatattcttccttgattttctccagtgaagtttagcatggtataaacacatggtatggggtagatatttcatgatgttgtagctgggatcatggagcagaatgaaagggcagaaccagttgctcttttctcaggggcggcattgcccaagcatgaattgttattgagtggccacttagaagaaagatttctctgactggggtgaccatatgtcccagtttgcacatgttttaccagcctaattttcagtaatgttcagttgggatgatgaaccatatggtcgtgtgacctctggcatggagatgggcatctctgctttgtcaactactccacatctgcaaccagcctttccttttattgatgccttggcaattctccatgatacagacacaatgctgagggcacggcaagactcctgtacgcaaactgttctgaaggatcagagtgttgtagggtgacagtcagcctcatccacatcaaagcatttcctttttttcttcaccatttttgatcagtttcatattcctgtgggtactaatgaaaaggaacagcagaaccactatcaagtccagtacttactaggcagatagagacccactggcttctggcctgtgccacttgctgctgcccacactcatcagtggaggagaattccctactaagttttcagtagttataattgccaccaacattgcatgggagagaggagcatgacttgaagtcgtttgcaaatgtatgttcatccaacaacagccaagaagcatacccgagactgtgcaggtgctgcccaagtcctgaacacattactgcacagttgctcagagttctggttcgactgctacctcttgtaccccagtttcttcatgtgtagaatggcaaagagggttaaatctcttacaaagtgttttggacactgcctggtaaatactggcagaactaaaatatagctattagtaagaatagtatcagcagctttgagagccagggaacaacccctaagaatggtatgaagtagggatcagcaactatggcctttggagcaaatgtggtcctctgcctgttttgtaaataaagttttattggaacagaattatgtccacttatttaagtattgtttatggatgccttattgagtagttgggaaaaaaatcatatggcccataaacctaaaatatttattgtctggtactttaccaaaaaagtttactggcccccaattaaagcataagtaagatactcaaaatctcattcctattcctattccactagcagttactgagcactgattaaatgccctgaactgtgccaattttttttttttttttgtaagacagagtcttactctgtcacccaggctggagtgcagtggcacgatctcggctcactgcaacctccgcctcccgggttcaagcgattctcctgcctcagcctcctgagtagttgggattacaggtgcatgcgaccaagcctggccaacttttgtatttttagtagagatgagatttttgccatgttggccaggctggtctcaaactcctgacctcaggtgatgcacccacctcggcctcccaacaaatgttttaacatagattatcttatttaactttcatgagaagtagctcttcaaggttaatggaaatatcccattttatatgtgaggttcagagcacttgtgcttgtgtacaattgcagagctaggattcatactctggtctggaactttaggagttatgaggacagacatcctggaggagttcggtttgcacttgttcttgaagaatgagtatggttttcagtaagcaaggagaagacccaggggagggtattgcagaaagaaggaattgactgagcaaagggcctgaaataggaagcttgggctggttgtctgatttgtttagcctgaagggactgaaggagacaaggtgaaagaagtggctgtatgccaggatgtagagagacaggtacttcctcgaggaagcagctataaactgaaagttcaaggtcaagcccatagacatattgtgtttggcctttactgtattgattcacacaaggatgtttgctttggttttcacttgaatttataaccagcccatcctacatttcatcttctcttaaaagactgcaagatctagccagactcagccacatttccaggaggtgggaactagctagagttgagtttagctgccctctttagatgcagcatctgctttcctatgggcctttactcatcttagactcaagcaagcacagcccccatactgggccctgggctttatagggccttgctctagtcacactcttttctaaggggtgaggagtctttgggccaaggtgacttgcctgctccctacccctgtcccctgactgtgcttcacctcccaagactctgaattgtctcctgaacggtcccagctcacatccagaactcacatgggcctcttctctgcatctgtcttcccaaggatgggccactctgaagggtgtaccaaagggaagcagtttgccttgaaggtagcgtatgtgtggatggacctttgaggtgcaggctagggtgtccaccatgggtgtgcaaggcctctagaggtgcaggacagagcagagggtacaaagagtagggaagaaggtaacaggccacagaatctcgctctgcaccaccaaatctcaatatgggacacgcaggaatccaagaactcacaatttgaacttggccttctcagtcagtatgaagtatatttgccaacttagtaagagagaacataaaatatttaataattttgaatttgatttcagatattgagatatactgtatgtcagcatctatttgtgcacttgctccaagccccagaaatgttcggcataggcctggctgcagccctaccagttcccattgtcttacaccagagctgtgtctctcatggacatgacctgtctggtgcttacaggaatgagaggttttggccctagctaaattggtttagtggtgaagaagattgaaggtttttgatcagggcagattgtgccaaatgggctactgcaggcagaggcagaggcaggaaggccagtgagggagctattgcaggagaccagctgggaggtcagagatttgaaccagtaggagcgagagaagaagggacagatgcaagattaattatgtcttttccttccacaatgatctttaggttaaggtcgccaacttaacccaatttagcctgtgactttcttggtttttgctctgcaagcttctgtcccaggaaaccccacagtactggtcacactggggaggctggcttgcctgcctaccacctaaatatcagccaccatcatattgagctcttactatacctcagctgggaacttgagctcaaggctttggacttgagtataactttgctcctggaagcaaactgtctggctatttctattccttgaccctaaatcaaaaaatggcaaataactctcaggccatggagcttcccttgggtgttacagttacagattttcaagtcaaggatatgttcaggacctaattagctcatccagacacttagaatctagattcatgctggaagggaagaaaatgtctccctcctcacctttgctggacacaaggatgtgtcatctttcatctgtttcttgccattgtcattaccatcaacattgacagagataacacatagaaccttgaattatggaatccttattaagttagatactcatctcttctagaaaataaaatgtttattagtaaaagcagaatcctcaggaaaacagtatttataagccctagacacatggccctggaaaagtcacttaacttctctgaacctctttttcctatgaagtgggactaataatccctacgatagatttgtatggagaataaagtttaaaatgcctcatgcacaaaagaattgagagcaaggactcgaacagatatttgtataccaatgctcacagcagcattatttccaatagccaaaagacggaaaaaaccccaagtgtccatccacagatgaatggataaacaaaatgtgatatatccctacaatggaatattattcagccataaaaggaatgaaattttgatatatgtcacaacatggatggaccatgaaacatagtgctaagttaaacaagccagagagaaaaggacaaatattgtattattccacttacatgagatatctagactagtcaaattcgtagtgacagaaaggttaccagaggacctgggggagagaagaaaggagagttattgtttaatgggtacagaatttcagtttgggatgatgaaaaagttctggaaatggctggcggtgatggttgcacaacagtgtgaatgtacttaatgctatcgaactgtaaacttaaagtggtaaatggtattatgtatgttttaccacaataaaaaaataaatgcctcgtgcagtacctggccattgaagatactcagggggaaaaaaaagagctaaaaagagatattaagatgtttctaagtgttactgagttcagaagtgggagttcatactttaaactaaaagtagtcaacgaaggatttgccaaggaggtgggatttgagatggagtttgtaggaccaggcaagggaaaaggcaacccagccaggaggaaatgtgtaagcaaaccatgaagctcctgtgtgtggtgatggggacccggtgatgatgttgtgatctgttttgttttttgttggagactagatttgggatggggtttcaagggacttggagtccaagttgacctgtttaggtgccaggcagagcagaggcactaaaactatctgggcagggaggatgaaaagatcagtgtcggcagaaagatcaatctggggcatcgtagaaaatggattgaatggtgccataccagaggttcaaggcagccagggcagtgttgcacaagtcctagactaaactaggatggtggctgtgcaaaagaaaagggagagatggagactaatttcagaagagccttgatagacttaagatatcaaggaagaggtggcaaagtgttaaatgtttagcagaatagctcaaccctggagccaggtaccctgcatttagtactgctaatgttctaataccagtactgctgcttatgagcttgtgtgaccttgagtgaatgacttaatctttctgtcctgtttcttcctctatcacataacaatgaatgacaaagtagtgcctctctcacaaggctgtcatgaaggttaaaggagtcaatatttgtaaagatcttacaatagtattcagcacagaatatatgcttgctattttttatcttttaaatctggatggttggtacgttggtgtctgttacgttattttttggtgtttgaatattttaaagcatgaccttaaaataatgtactttcaaaacagtcttgctaagcagtgcttcttaaagcttaacatgcatgtgaaatgtttggcagtcttgtgaaaatgcaggttctggttcagtaggtctcaggcggtactcaatggtctgtgtttgtagcaagctcccaggtggtctggtgccgcgggtctgccggccactccttgagtagcaaagttgttaaggaacggagttccatcacggtgtttctaggattgttctggttgtcttttgccacataacaaatcatccaaacctagaagctaaaacgaaaatgatttatgttctatgctgttgttgttattattatctcttgcagttcagctatgtagttcttgggatctgtcacaagctggtggttagatgtagctggggcaagagtcaagagtcatcctgaaggcttcctccccctcgtgtccggtggtagatgctggctggctgttgggacctcagctggggctgtcagcgagaacatctccccagggcatctccatgtggcaaggggctcttcacagctcagcagctgtatctcaagacagagaaccaggcagaagatgtattaccttttcttgcccagcctccaagtctcacagcatcgcttctgccaccttctatgtattagaagcaaggcactaaggccagcccatatgcaagggtagcgcagtgagactccgtgtcttttttttttttttttgagacagagtttcattctgttgcccaggctagagtgcagtggcacgatcttggctcactgcaacctccacttgctgggttcaagtgattcttgtgcctcagactcccgagtagctgtgactacaggcaggcgccaccacacccagctaatttttgtatttttagtggagatgggatttcaccatattggccacgctggtctcaaactcctgaattcaggtgatctgcccgccttggcctcccaaagtgttggggttacaggcgtgagccaccgcacttggctgagactccatgtcttgaagggagaagtgtcaaagaatttttagacatgtctcaaaaccaccacaatggcctgcttaaggaagctctgggaggaacagaaagtggtggatgagtcaaccagggaaagttgactttgttgtgtttaaatttgtgggtttggggtaccatgaagaccacttgaagttattctccaacaggcaggatggtgtgtgagtatctgagtatctatctctcacaccagatcataagcttcttgaaagcaaggacttggtctttttctctgcaatagttctggtgtctaccacagtgcttggcacacaaaagtgacccaaacaatgtttgtttgatgagggaatgaataaatgaatgaatgaatgaatggtaaaggatttaggactgaggctgtgtggtctgaagaagaaaggatactggaattctggaaatctctcccagaacagtcctctctggcacttctcccagggagagggactcctgcatttgctcagaggccaccatggccctgggggtctggcctgcctgctttgcaacttgaggccctcgcgtaccccataggctgtggaaggcctggatctgctgggaaacctccttcttccactaaatggaaactggaattccaggagaaagcaaaaatcaacaagagctattttgattataatgatatctcatttctaagcagctctctctatttcctgtttatagcccaaactgagagcagaagcgactagatctctcagtgaaaggttttctccgaagacgtctagctatatcatcaacaggaaacagtactctcccaagacaaaagtccctgtctctggccactctgttgggtttcattgcaccctacaaagggaggtgggaaacctgggtttctgaaagaggccctgattttgtgttagccttcagcatctaccacttgtacccagctcccagtcccccaaatttctggggactccatgtgaaatcaatgcacaggaattgtggggggaagccctaaggagtccagccgcgattttcagcgcgattttcagggcagctacatttcacttcaaaactcccagtaagtctgccactaagacccctggaaaggctggctatgtcagccctctgtcttcattagaagaatctcaggatttcttccagtgacagaacatgatcctcagattccagggagtgaccccagacccagttcctctccgggctataaaactgtggagtgtgacacagacagagagactgtggtaatttagagactaagaaaaaaactgactagaaagcaactgaacagaacagctgcaggaatgtaaaatgcaagaccctctgatctgacagtcttttcctgcacctctacaaatgtgcgtgcacacacacacacacacacacacacgactcccagaaaggaccctctgaagacaggacatttcagctgacatctgaaagatgaggaaggcagccatgccaagagtattccagaaagaaggaacagggtttgcaaaagctcagcagctccacagctgctggtctgggccaaataggacagacagcctgtggctctccccacaccttgtgcttcctcactcagccactgtgagtctcctctcgcctgaaacagtctcccgctctgtcctaaccttccagcatctttctcattcactctgtctcctgaatatcacccacaaagggtagcagtatcagtcttggtccacacacttatgcaagaagtgccactttgttttctttaaatcaagtgatatcagactctgtaccccaaggctgctggtctggcaggcagttcaaactcagtcgttcacggggctctctcccacccaaggtcatgcaaaggtgacatgctcatcttggggaaggcccatcatcactggttctcactggatttatccttgggtgtgcattgtcctggttttcagagccccttcagggctgaagtctgtgtggcttctgagccaagcttggagacaggagccttggcagaggctgggagcctggaatcagcatccagcttccctgcttacaccacagtgtagcactcccacatcctcaccccaccccaccccaagtgcagcctacagcccctcccctctactgcttctgggagaaagtgcacccctccccgaaccccaccaggatgcctagcttcatctctttagtgaacttttggcttttgcaaaagacctgaaggcccattgaccaaaagtagcctctgcccaggcaagggagcacaaaacccactcatcttctagaaatggactggagagtgcaacacaggaagtgcccacacagatgtttcctagaccttgcctttagggtccctctgttctcagggatgcagtctatccagccctgggaacttgaactccctgagaacaatgtccctctctatctatggtaaaggattaggttttgttttttttcttttaagcttccagttcatctcagaacagtacttttgtaaagtacaatgaaagtgaatgatgagaaaagtaaaatttttgaaagacacacagaatacaggtactgattttttattattagattcaataaattgttattaagggttctaaacatattctttccatttctgcactcacttggtcaccgatcagtaaccaactgtggagggacacggattggtgggccactcactttgaggagcgctgccttagagcactcaggagggagcagtgagtccttcttcacctctagaaatgtggagcttagtgaactgtagaatcttcaaggggttagggtagaagctggaaacaaggacagcctttacctagtgagccaagaaactaaaatccagcctcctcttacaactacttacaatgcaaaaagaattacagtgtaggactatggagcctgcctctggggcaggctgcctggtgatacattcagcactgccacttactgccttgacccaggatgagttaatagctcacagcctcagtttactcatctgtccaattaggatagtagtactatctcatagggtttttgtaaagactgaagttaataagtgcataatcacatagagttgctcttggaaaatagtaagtgcctgtgaatattaaaaatttcctggccaggtgccggggctcatgcctgtaatcccagcactttgggaggccaaggcagaagaattacttgagcctaggagttttgagaccagcctgggcaacatagggagaccctgtgtctacaaaaaaaatttaaaaaattatctgggcatggtggcatacacctgtagtcccagctactcaggtggatgaggtgggaggattgctcaagcccaggaggccgatcacaccactacactgcagcctgggcaacagagcaagaccctgtctcaaataaaataaaataaaagtttccttagaaagaaagcttcaggaggttagggatctttatttcctgatgtttcccaaatgcctagaaccatgcctggcacatagcagtgctcagtaaatatcagtgaatgaatccatctccttatccaatgctgaacttcaggcttccatgtttatcccactcttagtccctttttttttttttttttttttttttttttttacagagaaaaggggtctgtttgctctttgtgttctttgtgttcatagtgtttccaagccccaggccattcagagcttttgtctccagtgccccacacattcaagaaagacttgaattgcctctcaggtctgaacctgttttgtgcagggtgtccaagctggagtgcaatggaccggtcttgactcactgcaacctcccactcccggcttcaagcgattctcctgtctcagcctcccaagtagctgagattacagacgttcgccaccaagcctggctaatttttgtattttcagtagagatagggtttcaccatgttggtcaggctgatctcgaactccttacctcaggcaatccgactgcctcagcctcccagagtgctgggattacaggcgtgagccaccgcgcccagccaagatacattgttgcagagtgtaaaaccagatcttgttgacctggcatttagaccttccaaaatctgatttccacctgtgtttctaggcatgtgacccactgcacactacacagcccccacagggaccatttctcctaccctgagcaagccattcctccaagacacacttctttgcaactcctgcccgttgaaagattactcattctaccaagccaggcttaaatgctgcctactctctgaagctgtctctgatattccaccagagttcgtctctcatctgcacatctactaattctctgttctcaactcctgttcagaagaccttgtaatcaagttcattgtttgcacatctgtccctttactaaggtggaactccttaaggacaagggaccatatcttcagcagctctgaatagcattggtgcttcatgcagggccttgcctataaatacaacttcaacaggtgggagttgttggtgggttcccacctgcaagcataagtcagcaggcttcacagtgagtggcctaacataggtgtggatcagaaggaaatgaaagcttcattctagcttccccaatactacttgtctcttaccattccgttgtcttgagtattctttggggaacctgctgatataggaggaacagtggcttcaatctgaaggactgtgccagcttagggtgagtatgactcagtctggaagcagaagcagaagggaatatggttttgtggatgaacgtgggagacagcatggcatgaggttagtgctctgaggtctggtgcatctggcttcctgtctaggctctgctgctgactggctggatgacctttagcgtattcttcatgctttgatgcctgtttccccatcagtatactatagacaatgttgggacctcccctaacccctgccactaggggcataatgaagaggaagccaaggggtgtgcatatgaccccaccaccagtctgcagggaatgccacaaagatgctagcctttgcaaattctggtgcagtgttacgaggagacaaagttcacaaacattaccttgcccctgggtaccacgtgacttttgtctccctatatctcctgcacaattgcaaggattaaacatgctaatatgtataacggacttagcaccctgctctccaataatggcttaataatgctctggtttctcttcagatcatataaatctttcaccttttaccaataatggcttaatacaccttttaccaataatggcttaatacacataagcaaaaagactcagttaatataggctataagttggaatcaataatccatgaaagaaaccctggatagggtttttaggacacaggcactgctataccctaatagaatggatcaactttcattcagttaaaaaaaaatctacttcttttttatgccacaaagtgccaccttaaatttatcttagtgattgaatgtcatacccaaaagaatcaaaagcactggagcagttgatctggtagaaacttcagcatgtgtttgttcattccacaaaggtttactaaacccttgctttgtgacaggcactgtataccagttggccttctctctacattatgctgttgcaacaggcaaccccagtaatggtttctttcttgctactggagctctgttctaggtgtcttcattcctggacccaggctgcaggatcagcccctatatggaacatgccattcttatgacagagagaaaggggtactaggagaaccatatagtggctcttaaagtcatgcttggatgtggcacgtgtagcttatattccattggccaaggcaagtcacatggccaagcctggcaccaatggggtaggggagtatcctcctcccatagagcagcactgcagatctcttgacaatgagtgaggatatataatcctcccacagggaaggcagaaaggatttgggggcaataatactgtctgccacatgctgtcatgaatgctatctagttttagtctcttgataactctgtgaggtaggtattattatcctcattttacagagtggaaaattgaggtttggtgtggctaaccaacttgcccaagatgtagccagtaataagcacagctgcctgaatcgaagccagtaccaatggtatatagccagccttgggcttcttgaggactcattttcatatagatgttgtcattcagtaaacattgataaagcatctactatgtgcctggcgctgtgctgggcattggaaacacagtgatgtgcaagacagacactcttcctactctcatggagtttagagtccaaaggaagagagaggcagacaggacacatgtaaagtatgactggtatgtgcttctatgagggagatgcagactaaagcaagagtccatggagagagcatgcaaccagactcagagcataagaaatggacatgtctctgatgactgcacagaatgtaagagctggaggactgggtcacatggctgttgtcaaggccctgcctggcagggtgagtgccaagggcagtttctgattcagaattctaaagggcactcacaagagttcaatgccgatgggcatatgcccagcctgttgctaacgggactggacaaaccagtggctgtgtggcaggaacctaccatgtgcttccgactagtgagtctgacccaaagcccttttcaggcttcttctgggagtgttgcctctgccttacctacactcagagccatgcatgctgaaaaaaaaaacccaaagacccagagatgtcaacaacaacctgagagagaaagagaaacccagatttgatctgattttgaatcggcagagtgacacatgttgcttagactgccaacgcacgccactctcacttccctgaatggtttccattttagtggcattgtaataaaaagaagaaggaaaaaaatcccctgcaatggtttacaaagtgtaccgcaatagtaagaaataccattttctcatcactgctgctgcagcaccagagtatggggcccagcactaggcctgtctttgcaagcaggactaattacatagtaagtgattgcccctcaaacagagatggcatgtgtgctgggaaataggtcacttcttaatgaggtgaagctccagcaagaagcaagcacagatgcagactattcctcttgggatgcaaaaggcatctgaaaggtgagcacatatgtcccataggggagcctctggccaaatgtcacatctccagggaaatgtctttgaaacagatgactctactttcagcttggttatggacacacacaaccttgaaagtttcagaaaatatcacaaagccaaatatatatgtatctgcacgtgcacacacacacacacacacacacgtttgtgtatattaggattcttaagaaaagcagaaccaataagatgtatgtagacatatggaaaaatattatgagggattggctcactcaattatggcggttgagaagccccacgatctactatctacaagctggaggcccaggaaagccaatgatgtaattccagtccaacccagaaggccagaaaccaggggagtcagtggcacaagtcccaatccaggtccaatggtccaagaaccaggggcaccagaagacggacatcccaggttaagcggagagagaaagttcacccttcctccacttttgtgttctattctggccttcaacaaattggatgattgcccacccacactggtgaaggccatctttttactcagtctaccaattcaatgctaatctcttttggaaacaccttcacagacataccaagaaataatgttttaccatctatctagccattccttggctcagtcaaattgatacataaaattaaccatcacagtaggtatatgtatcttcttacccttgattgtatttgaaaactacacatggacactactgggctttgagtgtcgacttgctttaaaaatagtcttggagcttggaaaggagcccttcttggagagacaagcaaactgactcagcccgagggttatgggcagagaacctgcaaaaattgtggttcacagccaccatcatacattccttgctaactctgacacaaatggtaaaatgatgaagagctacacattgctggggaaccacggggcctgtgcattcagggtcagccggtggggaggaggaagagcagattaagcaagtatgtcccatgccccatgcctcaataatcaggataaatcatattttaataatgcagtattttagaaaatcaaattagcaaactatggccatgggccatctgcctgtgtttataaataaagatttattggaagcattttttctgaaactattccaagttttactggaacggagtgtagtgtgcctgtttaaattttacacccaagccaagtccttaccacctcatcttagtcctggccctgcctcatatccatttactcatcatttccttctcatccagcactacagagtgccaggcactaggagacagagctaacagttactgagcacttaatatatgccaagtactatcattagcagtttacacatattacctcacttaatccccacaacaatttcataggtaagaacagttattcatgccattttacaaaggaggaaactgaggcatagaaaggtgaagaagctttcccaagatcaaacaagtaggaagaggtagagtcagggttcatatgaagaagtttgagggctttgatggagatggatgcctggagaaaggaaggattactcagctctgagaggtcatcacagaggaggtgactttaagcagggtgttgaagggtgagtagaagattgctaggcagaaataataaatctaggttgctgtagtgtttcagaagagaaaatatatctggagaggttttctctggcttccctaggcccatgtgttgccctaaaatcagaacagcagcaaaataatacaaataaccaacatttattgagtgcttaccctatgtgctaggtactgaactaagtactttatatgtgttatctcattaaatcctcaaataaacctgagaaatgggcactactcttatttctgtctgacatatgaagagtctgaggctcaaaggagttaagtaacttgccaaagctatacagatagtaagtggctgagccaggatgcaaaaccaggggatgccacagtgtgaaccgcagtgggcactgctcatcttgtagtctgtgcaaaacccaaaaacttggtgccagagcttcaggcttagcaaaagcaatatgccagtggtgctcaaacttcacagtgcatccagttcacctgaagggcttgtttaaaaaaaaaaaagcaagcagatttctaggccaccttagaatcagagattctcatttaggaggtctgaggtgaggccaagaatttttatttctaatgctgctggtcctgggaccagacacggagaaccactgtatcacattgactctcagcaacagcaatagtactgtcctcctaagctgcaccagggaatacaagtacaggaggtagttgaaagaacatgcttcttccttcttagtatatagatcaggatccacttagtgagaaacattcaacctcccttctttttattccagttgtccttttctctgacacttgcatcaattttctgattgcctaggctcttaatattgctttctgttcatgtgggctttaatgacttgctcgacatgctagtgcttttgcagaattaggcagcccatgtcccaccacttctgctctgagcctgatgtgcctcttaaattgacacaaactccagctatcaatgtgagaaggatcatgtgtttcctgatggttctctaggctccacaggggccaaattacaccaaaaagtaattggtttcatgtattagtcaggagtctttgggttgcaagtgacaaaacacaatttgaactgatctggaaaaactgacatttactgacatacatatcctgatcacaggaagagcaagggtgccgctggtctgcaagcgtgacacatcagggctttaaatgctactgggactctgcccttcaccccctgcctctctctgggtatcagcaacatcctttcaggcaggctccaaacagcttcctttgactcccaagctctgttttcagtcccaccttgaaatagggataaacagacctggtttctggattctgggaaagggctcttggtggcctagcttagatagttgtccatccctggaccaggaccttggccattttggatgtctacccatacccaatctgagatggagtgggacagggcttgtagaagatgttagctttccctcaaaccataatgtcagagtgagtgaaggagcatttctagaaaagagaggaagagatatttggtaggaaaataaagccccagaggtgagtgggtgagtggaaggagggatgcatgcctcctcaggaccaggtgctgaggtggcagaggggagatggagagaggggagaaggaaagtctcagccttcctggaactcacagtctagaaaggccaagtcatgccagagatgtcagtggaggttggcagacatttctgtggatcacagcaggaggcatagcaaatatttcatctcaaatattttgagaaaacctgggttcttctggatgggctcatctattcacccccacccccaaccaacttttgagcatctactgtgtgttaaacaacatgtctgcactcaagaagctgagcattaatggaatgccctaaggtggcatcagaccttgtctctagtggatcaatcactcccaaagatgcatttaaagctccctgaaaaggagcatctgcgtcttcactggctactgtccccatcctccttatgttgcctgtaaggactctctttctatatccactcaggctttcacaggccaaggctctacctcacttttgcagggtaatctcactgagaatgaagagtcccctcactgtggctttctattttctcactctgggtctgtaagtggagacagtcttctatctctttatgtcattgcctttgatttccttgggattctccctgagattcgttggccatcttaagctgtggcttccagagctttttattaaaaatggaacaatcattgcaaagccccctcagccattcaatagtgtcactagagacacgcttgactccatttctctgactgagctggcagatgttgaccctgggagaggacaggaggcaggtaccactgggcccctgtttccctttctgtcttctccacaagcctctctgctccaggccttcttttttttttttcttttgaggcagagtgttgctctgtcacctgggctggagtgcagtggtgcaatcttggctcactgcaacctcctccgcctccctgtttcaagcaatcttcccacctcaacctccagagtagctaggactacaggcacgcaccaccatgcccagctaatttttgtatttttagtagagatgggatttcaccatgttggccaggctggtctcaaactcctgacttcaagtgatccgtccacctcggcctcccaaagtgctgggattacaagtgttagccattgcgcctggtctcaggtctcctctttctaagagtctagccatgagggtggaggaagaacgcaagccttgctctcaagccccgcctgtcttaagagtctgaggggcagcatagcctgaggaacttatgtgtggcaacgtggggatatcagtcacctgtctcttaccccactgggaatgtcagtagcccctgtctctacctctgcagcaatgtagtaaaccaagtttaaaggtgtcttgcttcatctttgtactttccatattgaggatacctttctctctgcctgtctgcctgggagcttctatttggtggctgtctttactgtctttatttcctcaatgcctagcatagtgcttggagcacaataggtattcaacaaatgactgatcccattaatggaactaatcaaggaaccatctcaaccattcccttaaaagtaagggatgagtagggacaatattgtgggggcttctgatgttattgttggatttggtgaatgataattaagagcacccttaaattccctttaaattcaaaatagattgaaaaatgagacaacatgagctttttatttgtatggctgattagtgaatatgatttagatctgtgtgctgaatacatcctctgctgaattaaactctcccccagacgcagacaggcctggatgacaccggcatcctctgggaataggctgcttttcaaaggacacaggaaagaagtgtgtcctcaggatattcccaaaagggtagaaaggccaccccacacatgcccatccctgtcatagctgggcctgctctgagctccctaaaccctcactgtgccctgtgcccatagtaggccactccaccatcactcttcttggttctcaagttccaggagctttgcaaacaacagatgcttccctagtataaaggaaagaacaagtctttgggccatgggtcctcctcttctcagtgtccctggataaagtcatctaatcaccctgagccttgctttcctcagtgaaagaatggggctgatctcaaccttgcctgccatcgaggctcagatgacctccaaatgcatcctaaactgctcacattcttttgcaaggagggtttttcttcctcaaagcaaatgggagggccaagtaagagaatttatacaagggctttgaaaagagctctgcatgctccttttggaaactgaggcaagtgagcgctaagtaactttctggaggcctcatcgtacaccagctgggattcagcctcaagttgtgcatgttggcctccaaaagccctgacttctcgctagaaggagccttctcaaatgaatcctatgacgacctaatgcaggctcataggtctcactccagaatactgaatcagagcatctgagatcagggcctggaaacctacaggttaacaggttccttgggtgcttcttactgcagtagctcaagctgtcccatggtgatgggctggagctgccacatacaggccaattgttctactcagttattctcatctctgccatttccataatgacttagcatctatacccatctctaaaatgttaaggcactttgccaaacattattttgtttaattgacagacagaaccatatagtggttaagaacctagtttctggagctaagctccttggtacccagttgcagctggggtgcctcccagcttcgtggtttgtgcctccatttccttctctgtaccatgggaatgcgctttgcatcctacctcataagagttgttagcagtgaagacttcagtgcactaaagtacatagaatagtgcctgttgtggagtaggtgcttaataaatcttcatttattattcctaatgaggaaatggaggatagatttgtgtaggatacagtaaaaagtggactgaccacagccaacacccaggttttctggttctacttctacacttccatgaacttaatctttgtttgcctttcaaagtcacttagaatttaaagcagtagtaaaaatacctcaaatgcagtcaaccaacaaatatttattaggttttactgatgtgtgcaggatgctgtaggaagatatgaatggatgttattagcacacctaagctgcttagatgggcttgaagggttgagagaacagagaagtagcggaatgaaagcagctttgaatggcaggagcttgtctagggagcagaggcctaggtctagctgagctgctcacctggtccccatcgcccacaaagctttaatcaagatattctgatcaggccaatgcttctgaacaggctaataaggaattaacacataaatgttgcttagcaaacttctccctagcatggaactgaaacagggacagtgctgagagggaggttttgttttgttgttgttgttttgtttttgtttttgagatagggactcaaatggcaaacaggtatttgacaaggtgctcaacatcattgatgatccaaaaaatgcaaatcaaactacagtgagaatcatctcaccccagttaaaatggctgttacctaaaaaacacgcaataacaaatgccggcaaggatgtagagaaaagggaacactcttggtgggagtgtaaattagtacaaccactatggagaacagtttagaagtttctcaaaaaactaaaattagagctaccatacgatccagcaatcccactgatgggtatatacccaaaagaaaggaaatcaggatattgaagagatgcctgcactcccatgtttgttgcagcattattcacaatagccgagatttggaagcaacctaaatgtccatcaacagatgaatggataaagaaaatgtggtacgtgtacacaatggagtactattcagccataaaaaagaatgagattctgtcatttgcaacaatatggatggaactggaggtcattgtgttaagtgaaataagctagtcatagaaagacaaactttgtttattttcacttgttggtgaggactaaaaattaaaacaattgaactcatggacatagagagtagaaggatggttaccagaggctcggaagggtagtggggagggggaagtgggtatggttaataagtacaaaaatatgattagatatataactagaatgaataagatctaatatttgatagcacgaagggtaactacagtcaataataatttattgtacgttttaaaataactaagagtataattggattgtttgtaacacaaagaaaggacaaatggataaatgcttgaggtgatggataccccatctaccctgatgtgattatttcgcatcgtatgccagtatcaaaatatataatgtacttcatatattatacctacagtgtacccacaaaaattaaaacagtaaaatttttttaaagagagagagagacagggtctcattctgtcacccaggcaggagtgcagtgcatgttcatagtccactgcagcctagagctccagggctcaagagattcaccagcttcagcctcccaagtagctagggctgttggtgtgtgccaccacgtccagttattttaaactttttgtagagatggggtctcactatggttgcgtaggttggtcttgaactcctgatctcaagtgatcctcttgctttggcctcccaaagtgttaaaaatataggtgtgagccactgcacctggtctttagtctggtttttgacaagaaagagccagccagctgtctgcccatgtctttgagctacatgaagattagatcccattagtcttggagagggagcaacaagaaatagaagagggcacagaactgcacgtagcctcacctacttcaaaagtttcccctaaaaccccttaggcattcaggaatgggtgagaaaagggttttctttctatgagagtggggattcctctataaaatttccggctttcaggatagcggactcacattaaagtgttaggggctagcctgaaaacctaaattgttttccttgacaaaatgtgccatagatgcgaatacctgattctggttaaagagttggtttttgctgattatgtagtataaaatggaatctgttttccactttccttctcttctaccatccctttgctttttctatgctctctcctctctcaccatttgttccattcatgctctctctcttctttttcgtctccttctttttccttctcaccccactcctcctttttttcctctctctctccctcttcttttcctctctgtctatctgttcttgttttcttaaccccatattctacaaagcatttagggtggcttgcagaaatggaaactaatatagtaaaatgtaagtaaaacatgtaagatctggctgggtgcggtctcatgccttcaatcccagcactttgggaggctgaagtggatggatcacttgaggctaggagttcgagaccagcctgaccaacatggcaaaaccccatctctactaaaaataccaaaattagccaggcatgatggcacatgcctgtaatccgagctacttgggaggctgaggcatgagaatcgctggaacatgggaggcagaggttgcagtgagccgagatcatgccactgcactgcagcctgggcaatagagccagaccctgacttaaaaaaaaaaagaaaagaaaagaaaaaaaaattgtgagtcagatgctcaatggcatcaaggagataattcatatagaaaacaagtattcaggaatgaatttattgaataaatcatcataattaatgtgtttttcaggatcaagaggagcaaaataatttaggaacaaatagttctgatgagatgctaaaaacttacctaatgtgtatacgacttcatcttttttcttcagtcttgaccactttttggtgcgaacttctccattgactttgagacccttaaccctatatatttttaataatactattggggtagctaaaataaattagtacagtgaagtatatctctagtctcttaaatacatctctaaataatgaatatattcctgaagatttctttgtatttgtaattattgcagatcaaatattttatttccatagaaaactgaccttctaaagatgatacaaggtgtctctctttagtattaaagaatttatgctttaaaactttagatactgggtatggtgactcttgcctataatcccagtattgtgtgaagctgaggtgggaggatcacttgaggctgggagttcgagaccaatttgagtaacaaagcgagactagattgagcaacaaaatgaggccctacaaaagaattaaaaaaaaaaagttaaattaaaatagataaataaacaaaattttagaaactttgggccaggtatggtagctcatgtctgtaatcccagcactttgggaggccaaggcaggaggattgcttgaggctaggagtttgagaccagcctgggcagcataggaagaatctagctctataacttttttttttttttttttaaagaaaaatcagctgggtgtggtggagtgcctttaatcccagctactcaggagactgaggtgggaggatcacttgaccccaggagttcgaggtttacaaagcactatgatcgtgccactgccactccagccagggcaacagagccacaccctgtctcttagaaaaaaattttaaaaaggccgggcgtggtggctcacgcctgtaatcccagaactttgggaggccaaagcaggtggatcacctgaggtcaggaggtcaaggccagcctggccaacatggtgaaaccccgtctctactaaaaaatacaaaaattagccaggcatggtggtgcacgcctgcagtcccagctactcgggaggctgaggcaggagaatcacttgaatcaaggaggcagaggttgcagtgagccaagatcacgccattgcactccagcctgggtgacagagcaagactccgtctcaaaaaaacaaaacaaaacaaaaacaaaaacaaaaaactagatattttgcacgttacctttttaaaagcctgacatatctgtatgatatccctgcactaaacatttgctatccataatgaggtaaaatgtgcttgggctttttccccaatgtgaaatatgcttaattgtcttgtaaaactgtcttgagtaatcccagcactttgggaggccgaggtgggccgatcgcgaggtcaggagatggagaccatcctggctaacacagtgaaaccccgtctctactaaaaatacaaaaaaattagccaggcgtggtggcgggcacctgtagtcccagctactcgggaggctgaggcaggagaatggcgtgaacctggggggtggagcttgcaatgagccgagatggcaccactgcactccagcctgggcgacagaacgagactccgtctcaaaaaaaaaaaaaactgtcttgagttttctttctttctttttttttttttttaacagtcttgctttcttgcccaggctggagtgcagtggtgtgatctctgctcactgcaaccttcgcctcctaggtttaagcaattctcctgcctcagccacctaagtagctgggattacaggcatgcaccaccatgcccggctaatttttgtattgttagtgaagatggggtttcaccatgttggccaggctggtcttgaactcctgccctcaaatgatccccccaccttggcctcccaaagtgctgggattacaaacatgagccactgcacccggcctttgagttttcttttattccggctgcatacctcccagttaatctgacatctttctcacctcattaaactggctccaactgctaatacgtcatcaaattcaaaagaaatgcgacccgctaccaaaatccagatctgaaaacatttaaccttaggctgtggttcaaggtgcaaagaaagctaatatctaataaagccttggtatagtgtgttccttgagtcaacgtttgagaaactgaatgacatagagctgcgtgaaagtttagggggtaaaagtgtatttgattgaatgtaattaatgtgtttttctgaatgattttcttacagttcacaatgaaccttccaattttacagtaattttcttggccttgattttctgatctgtcttaatttagctgtcaatactatgagtaacaaaattcagtttcattggtgatccttgaaagagaaattccaaaaataaagggctataagcacctcctatgaaaagattcatgcagctgtttcatctaatatggatctgataggtttcctttatgtccagttcttcctttctcaacattttctctgattttcaggcagatgcaaatagaattttcagtgctacggcttctctgacttaaattttctgtttcccttgtgtttgtgccaattaaaacaagactcagtctgtgcttgtgacatatttttggaaattcattgtgtaagaaatattgacattctcttgtattattttctctgagtctttacccacttcatcacaattcttgcctttcttttccttgaagtctgtgtgtttcatatgttttgaaaacttctgtcacatattttagttattataatggataactgcattgaggagaaagctctaaatcataggcttggaatgactagttctagaagcatttcctaaagcacatgcccctcctcaatagacatttctctgccatttattttgtgcagcagttcatatttgtggcctgatgctatctcttttctcagaaatttcagtaagtgtttcaacttgagtaatcatttacagaaacataatgtagtggacattcaataataaactattgccatgacattgaattgtcttatgatctttggtggaagctgtgtgaatatttacattgtcaggatcatgcacctacccgttatgttctgccttcctttctctattcttttcttttcttttttttgagacagagtcttgctctgttgcccaggctggagtacattggcatggtctcagctcactacaacctccacctcctggattcaagtgactcttctgcctcagcctcctgagtagctgggactacaggtgtgcgccaccacacctggcttatttttgtatttttagtagagagggggtttcaccatattggccaggctggtctcgaaatcctgaccttgtgattcgcccacctcagcctcccaaagtgctgggattacaggcatgagccaccatgaccagcctgctttcctttttcataatgtgattttcatgtacacgtctctgtgtttttcagcttcagataaaaacttgctatcttttgggcatttctttgatatatcatctccaaagtgacttattaagtcaaaaatataaattattttatcatttcctggaatgctttttctacaagtaacagaaaattatatctcagttggcttgaacaacaagaaaacaatataattgcccataacaagaattcctgtggtagggctgctatggagttgtttaattttacaacacagtgacatcctcaagggcccagtttgcttccatgtttttgttctgccatctttgggggaacatctctgttgtgaaggatgtcctcatggtcacaaaatggctgccacagcataaacatcaccgtacctcacagatatgacaatgttcagtggaagaagaaaaggaagtttcttcatctgtgtctcttttaacgagcaagaaaatattagagattcctcatcagtctctgtttcattgttcattcaacatttctttggccagtccctttcctaaaccagtccctggcaagggacataggatttctaccatgaatttagtatgggttctgttctacagagtaagggtgctttctgctacatgtcctttgacatgtggcctaggttattattatctcaagaggcaaaactgctttatagtaccaatctgcagtctaataagtgtgtttgttccctaacaaagctaagtttctatatgtttttgcttattgttataaatttgaagggtccttgtataatgaaaatattattgtaatttatgtttcttcagtgataacaaagtcatatgcagtctttttagaatgagttagtttgttttcatttcctctagtgttttacctacactgaatttgaaaactccattctaaccaattttatatagtcattgtgccagaatatttgccaccactcattattctgtaacatttttgagtcacagaccatatctactaaataagccaacattccaaaagtcttccttataagatgttaacatttaaaagtaggggaaaataaaagaaagaaaaggaaggaagggagggaagaaggaaggcaagaaggaagaaagggagggagggaggaaggaggaaggaaggaaaaaaggaagaaaggaaggaaggaaggaacgaaggaaggatcgaagggagggagggaaggaggaaggaaggaaaagaagggaaggaagggaagggaagggaaaggaagggcgggaggaggaagggaggaaggaaggaagaaaggaaaagaaaaagcaagcaaacaaagaagtgaagggatagtaatgtggtttggttgtatccctacccaaatcgtatctttgaattgtagctcccataattcccacttgtttcgggagggacctggtgggagataattgaaccatgggggtggtttcccccactgttctcgtgttagtgaataagtctcacaagatctggtggttttataaggggaaaccccttttgcttggctctcattctctcttgtctgcctccatgtaagatgtgcctttgccttctgccatgattgtggggcctccccagccaagtggaactatgagtccattaaacctcttttcctttataaattacccagtctcagttatatctttatcagcagcatgaaaacagactaatacagatgtgttgagaggtcaaaaattctagatactttgggattgaaagacatattgaatctggagcgaaaaggacaccccatttaacaaactgccaaatgcccctctcccaagggcccctcccttcccacctttatctgaacatcgaagtgtgccatcctgttgtcttgcccaacaatgaatggcaaggcaagcagctgggactatctactcgtagcttgtcacaaatgtgctccaactccagaggatggtgcagtaatttcctccctttttctttcgggttgtgctttctgctactcaaaagttctgctctcctgtgatcaagatggtaagtcctgtttcatgctgttgcccctttggaattgtgccttcaaattccatttgcctggaacagtcacattcttcagagtgatgggcctcaaccacaaaacagcaacagcaaaaaacatttttctctaatatttgttactccaaataggttatcttcaatacgttattgtggtaagagattcttctcaggagtgtttgctgctgtcaggggtaacatggtgaaggatagagcaagccctgccatgctccagtctcagctggctgtgtggattccacccaggaaaaccctgccagcttctcctactgtgggtccatcacagtctgtccattcttgtcccatctaagatataagttgtcatagatggctgccccctccaccattcgccacgtgggcatgtaggtcacatctcaatatgtccctaaagatccctctcctaatctaaatgctgaacttccacgtcagttaaggattgtttctctaaacacacaccaaaaggggaaaacatagttacttcctaaattcttatatccagaatggaaataatttcgggaataacaaactccttatgtttaccactgttccactgtttaagtcactgttttcttttttctttctttctttttttttttttttttcttttgtggcagggtctcactctgtcacccaggctggagtgcagtggtatgattttggctcactgcaacctctgcttcctgggttcaagtgattctcgtgcctcagcctcccacgtaactggggttatagagcccagctaatttttccatttttggtagagacggggttccagccatgttggcaaggctggtctcgaacttctgatctccagtgatccgcctgtctcagcctcccaaagcgctgggactacaggcgtgagccaccgtgccttgcctgaacgcattgttttcttaggggttggctagatgtcttcatgaagatgcaacaggctgcacttcagtgtgtcagaacaggtgtggcacagtgagcccacatatttctgtatagtgtcgtcaaagctctttccattagtgaccctatgtaagcgtaccccaagttgatcctagtctaaaaagcagggtctcagggcagagttcagagccagctcctcagattcttagtccttgcttcaagagctacctttaaaatggctcaaaaattcaactctctgtcaaagtaaaagtgaagccatctggctaggttgaacaaaggcagcttcgctttactgcaataggcatcagaccaaagccacagatcatttgggtgtgggaatgtaaagctgaatcagtgacattgccagaaaatggcacatttgccagaatactttgccttttgttccttgtgagataaacatgagcccagaatcctgtaaatctgtggtaatatttttactcttggagaaaaaaattagaagacaacgttgagaggctttttccgcattttccaaatttccttttggtgccgagtaatttgttttcaactagtgtaagagggccatcttgggctagtagggaagtcctctaagttagggctcagggatatgggcttcctagggcaattaccccttacctctgtttctgactgttgggggttcttgaagcagctcacccagggtgagactggtgcagagagcaacatttctgcctccctggttgggaagggagccaggttatttttttaagtgctacctattgacagcattttctctatgtctcagtttttcttcttcctctaagagctttttataatagccttaaccatcatcacatttttttttttcttttttttttaagacagagtctccctctgtcactcaggctggagtgtggtggcgtgatcacggctcactgcagcctcaacttcttgggctcaaggcatcctctcacctcagcctcccgagtagctgggactacaggcaagcaccaccacacccagctaatttaaatttttttttttcagagatggggcctccctgtgttgcctaggctggtctagaactcctggactcaagcaatcctcctatcttggcctcccaaggtgtaaggattacaggcgtgagccaccacacttagccaccacacttggccaccacgtctttaagattatgaataaaaaggtgtcactttcgaagattctcaaagggagtaactcctccccctaatactgagctgcagtccatcttaagccttgctggtatacatctcaaagaagaagatattgaggatagcttgtgcaacgtagctctggtggccgctaaggaaagagcaaacagctctatggctgcagacatcaggctttaaatgacaccaggatggtgaatgacctaggaacataaacaaagggatgtctcagctgggacataatcgcatcctggaagcttgaaggctgttttgtagaggaagaatagacgtgtgtttgactccagaagaccatgctaggaccagtagttacataaaattaaattctagctcagtgtcgagaagaacattctgacctgaaagttgctaaaaatggaatgggctgtgtattggtttcctaggactgccatagcaaagtaccacatattgggtggcttgaaacaaccttgttttttttctgggttgaaattaatttcttctctcacagttctggagcctagaagtccaaaatcaaggtgttggtagggctatactctctctgaaggtctaggggtgcttccgggcctctctcagcttctgctccccgaagcattgcttggcttgtggtagcataactgtcatctctgcctctgtcttcatgtaaccatcttcttggctgtcagtctctcttcttattaaggactcccagttatattggattaaggcccaccttgatgacctcatcttaacttggctacatctgcaaagatcctatttccacataaggtcatattttgaggtactaggggttaagatttcaaaatatctttttaattttatttactttgtttatttattttgagacagggtctacttctgtcgcccaggctggagtgcagtggtgtgatcatgactcactgcagccttcctgggctcaagtgattctcctatctcagcctcctgagtagttgggactgcaggcatgcaccaacacaaccagctaatttttgtattcaaagtatctttttgaggaacacaattcaatccataacaggctgcctttatgaaagtgagttccttatccctggaagtgtgcaaatgtaatcagagtttttcaaaatacttgaagaggtgtaagcgctaaagagagaatgcaactagatgacttctagcatctcttctgaccatagcatttcctaatgctatgagtcctgtagtaaatgactctactaaatcctgggaccacacttgggaagaccacacagtcttggtgaaatgtcacatgcacggaagcatagtctagcttccaaaaaccattgaaaggagtttcaatcttttcttttaaattcatatatatgtatatatatatatatagagagagagagagagagagagagcagagagagtttatttgggccaagcctggggactgcaacccaggagcatagattcaagttgccctaaatatacactccctccttttaattcttaaagaacatcaatgaagatccctttttctgtcccctgcagctgctcctcttggagtctctctgttcagtactcttttggtcacacatgacagaatcctaattcaaagtgccttaaaaaaaaaaaaaaagataatatcttcttgcaaatttgaaaagtccaggagttgttgttttgggttggactccatttcccagctttgccttcctctctgtgggctttctcttctgcatagtgtttccactaagaggtggccaccagggttcccaggtgttatttagcaattgagcaatttagcaaactcattgagaagagtttccttcttccagcattctaagggaagtcccagggctggctctcattgggccaactctgtcacgtgcatttatcacatgcccatccctaaacttgtcagtaggacactgaccacctcctgaggaagaaaacttaggaatggaggcacctctatgtgagttgcataaactaggaatagaagagggtagcagcccaaagggaaattggagtgctattaacataataagggggagtccgtgttgggagggccaaaggccaaaaccatcactgtctactctgattcctcccctcacaccactattctctcttccttcctctcctcattctccctccccttcctctctccctttcttctctccctctgtttttctctctctcctttcctctctctctccctcttctttttcactctctttctctctgtctccctttcttctcctcctctctcttttactctctccccctctttttctcccctcacatctctcttcatctctccctgtctctcaccctcttcctcctctccctcaagtctaggcagctcagcctctctcttttttctcctttctttttcctcctgcctctccagcttatctcttcctacttattttcccaattcagtattataaatacctagctactgggctggcaaatactgaactctcccttaagggtaaggacgggaaagaaatggagcctgccagtgccaggttcctttagcagctaaggggagggaggacgggaggaactcccattggtaacttttattcacatcgtatatcaaatcatcagagtgatcctgtgtcattttgagttgtgagtgctttaaaaatttgcatgtgtgtccaggacagagatagatgaatttgcacatgacggcagaggaagactttgggatgtatccactttgatgctaagttatggatacatcccaaaagactagacaaacagtatctgtgttttagcttccagacttctgtagtgggtccagccaaactcccgaatgggtttttaaacttgagaaacctcaggcttttttgtttccaatcatacaagcactcttgaattgaaagcaacactgggtcataaagcaatatgaaaactacataactaatatcttgatccttctgctttcagcacatttagccccacagcagtttagactcaaaccctctaaacaaaccaaccccctcaccccactcacaaacagcctgccaagagcattgagcgtccagtccctggactccatcctgaccacctcctactcccccgtcctgcatcactggtcttgctttggtcatctctgtgttctccattgctctgtctcccctccgccaccccacacccacaggcttggtgagttgtcccccaacactcatatttagactctcccttcctcaagcccccttgctctctgactctgctgggaggctctgatcctgagccctgccatggacctggttctgggagttgacctttgccccacacccatcagctgcgagtcaggggctctcttgttctatgccttgacctggtggtacccaagtgcattcatttgctagaattcatttgccataacaaaataccacagcatgtctacaagccaccagggctgccatgtataacactgggtggatgattaccctaaaacccttctggaactttccagataattcttttaaaaatattctcttttataggcttctacatgattcaagtgagtttcctaaatggctgggtgagctcccataggtgacctgacactgccacagccctctcccacccagggactggagaggaagctctggcaggacacccagaactcagggtggaaatggaacatcctggccacctacccaggagaggcctcatgtagtaagaaaagggagaggaaggagcagtgctagaaatcagattatacagacagaaaaccacctcccagactgcctgatggcagggggtgggtctttccatcttaatctttccagcccaagcaccatgcctgcaacacaacagaaatgcaaggaatgcagttgaggtggtgcattagtctatcctcacgctgctaaaaaagacatacccaagactgggtaatttataaacaaaagagatttaattggctcacagttccacatggctagggaggcctcacaatcatgacagaaggtgaaggaggagcaaagtcacatcttacatggcggcaggcaaagagagcatgtgcaggggaactcctctttataaaaccatcagatctcacaagacttattcactgtcatgcaaacagcatgaggaagacccgtcttcatgactcagttacctcccaccaggtccctcccatggcgtgggcattatgggagctacaatttgagatttgggtggggacactgccaaaccatatcaggtggggagtgatgtgagcacagctacatttctgaaaaataatgatggtcatggaatggaagacagatctgagctgaggaccttggaggcctgaactggtgcacttgccatgaggatggagaggaaggatgaggcaggaaagatactgcaggtcccagcttctccatgaatccaagggctttgctctccactctgccttcagcctagtgacacaatttatacagcaagagaaggaatgtcacagaccaccagatgggtagctgacccttccaagagcacaaagactctaaatatgtccctgtcaccacctgctgttttaacaactagttgtttaatacatctcctctggatggaaactagatccaagacagtgactctgggttttgtttaattttatgtcacatttttagggagcaaatgttaaatatgtttccagcctagtaaaataagggtggcaaacttaatcattagagtatgtggagaatataacaggatcttttattggacctggaaaggggccccactgaatggtaatatttgtgaaataattggagaggaaaccaagttttaagctattagttctctaacctttgagtagggaaaaggaacagtcccttgaacttgctgcaagtctcatggttgcttaaaaaggctttaatttctgaggactggcacaggctagccaaaacaaaccatttccaaaattagtttgggcctcaagggtcctgtaaaactcattttaaacaatgtaccatgatccttttttgctctcattttgtgcaattggagtctgcttccttcttcatatacagaaggatgtttaaaacgcacctttgagggtagggtgttgaaacacccagttttctgacccactctcagatgctatgacagagaaaagctcttttctccttcaagagaggtccaagcttctgagtgtactgtggtagctggaaagctattgcagcttcatgcccagatatgcatctgtgtgtgcacatgcacatgggtgtgtgcatgggctgtgcacatgtatgtgtgtgggttggcatgcgtacacacaagcctgcacataaatgtctaagagtgcatgtgtgtgtgcatgtgtgtacataagaacatatgggccaggtgtggtagttcacgcctgtaatcccagcactttgggaggctgaagcaggtggaccacttgaatccaggagttcaagaccagcctggcgaacgtggtgagaccccatctctactaaaaatacaaaatttaactgggcgtggtggcatgtacttatagtcccagctacccaggaggctgaggtgaaaggatcacttgagcccaggaggttgaggctgcaagtgagtcatgatcacgccactgcatgccagcctgggtgacagagcaagagcctctcttgaaaaaataaataaatatataataaagtaataaaaagtaaataaataaatattgattccatcacttgttagctcagtcattttaacttttgcaagcctgttttctcatctgcagagcggggataatattgtgtctacctcatcatgttgtatgaggattaagtaaggtaatacacataaaggctatatatagtacatcctctggatagtctcgctgtcattactgctactattgcagccccgctggcaaacagagcaagggggttgagaagacatggggccacactggcaagacattgagggttttatatacacatatatatatttgagatcctttaacatccactcagaggcactcagagaggactcccctactcaaggagaaatagttggggttgcaggagaggtttccaataacctatggtgagttcgagaaaaataacttatccaaaagatggaccttcctgtttctcaatgagctctcctaagagagagcagaagagggagagggaattgccctctatttggaggccgcagggcctggtcctcatagctatcctaaggaagagaaagctcaggaccaaggaagagccaccacctggagtggggagggtgggacggggttgcatcctgccctcctccttcaaacccggggcagagcttcccatccagaggaagcaggccccatcagcttatcctggggtggggcttcctaaagccaagtgtttaaaggcagatcattgttctgaagttccgctaagttctaatgcccaccctgctgagaaatcctccaagaacaaagtgagattttaaaaatccacagggttacttggagccaaaggcaattaagaggaagagaaataactggccaagtctcaatgtgatggctgtctgtgcagagactctagtgaggaagagagctaaccccattctttttgttgtgatcaagcaagatgattccccagtgggccaatcttttgcctataaaatggggttgatatgattttgtccaggaagaagtctggtttaggaaaagcagaggcattcttgtctccttcagtcccagcttagtggctactgactgtgagactttgacaacttattttccaactcagagccttgtatctctccttgaaacccaaaaggccgggctccagacttcctcaaagttcctttgctgtgtctatgacagtgggctgatgaaggtagaagcaggggtgtgatgaggacgagaataatcaggatggataggaaggctggaaggctgagaagggtataccaaagtcccagcaaacaaaagcgaacactcaatagccgtggagggcgcctcaccatgtcctctccataagccaggctacataggtcatcatctgggatcttatttttctgaattgtttgtggctcagctcttcttaatatggtactttctgaccagggcgggggagtggggagcctgtagtctcagctactcaggagactaaggtgggaggattgcttgagctcaggcattcaaggctgcagtaagctatgattgcaccgctgccgtccagcctgggtgacagcgagaccctgtcgcaaaaaaaaaaaaaaaaaaggggggatagtccattctagctgcccaatgtgcatgaccttgtgaggtagtaagaaccatgaccaggaaaaggccatgtcatccatcaggtgactttgtagaggaggcttctgccctgatgggagagtagcttaggcagcctcgaggccccttccacttcaatttgggaaatatttaatgagctcccactgtgtgccagcccagactgtgctgactgaggcctggggtgggacagcagggaggacagtccctatcttcaaagtgctcagggtctggctgggcacggtggctcacgcctgtaatctcagcattttgggaggctgaggtgggtgcatcacctgagatcaggagtttgagaccagcctggccaacaaggcgaaatcccgtctctactaaaaatacaaaaattggctgggcttggtggcgtgcacttgtaatcccagctacatgggaggctgggtcagcaggatcacttcaaccttggaggtggagattacagtgagccaagatcacaccaagatcacaccactgcaccactccagcctgggtgacagagcaagactgcctcaaaataaataaataaataaataaaataaaaacaaataaaaataaaaaaaatgtgctcagggtctcaccacccagacatggtctagtctagtccacccatgtggttcctgcctctccagtttagggggatggactgaggcctgggaccatctgttcccagtgccctctgccttctctcttgtagcattcttcttttctccttcggcactctctgaagctcctgtcgcccaaaacttcctgcccagaactaacacttctcatttaacaaacacttggatgagactaactgtgtataagcccagttcctgcccacaggtgctttgcgtggagaacggcccgctgaagcagcatcgaccaggaagcaccatgagacacatgtcagggctctccctgcctaggccctaatttgtgtcccactaaatggggccatgatcagaactgtgagttcccagcagagggtggaggtggagatgccacactggggctgagctaagacaccaccaaggaggagctggcagcagaaggctgagtcccaggatcccctgtgtacttagcttacacaaatttgagtgtagattcttccttttctttccttttttttttttttaaagactgaaatttttgtatttattgaatggaccattccatttttctctattttttttctttttttaattatactttaagttttagggtacatgtgcacaacatgcaggtttgttacatatatatacatgtgccatgttggtgtgctgcacacattaactcgtcatttaacatcagggatatctcctaatgctatccctcccccctccccccaccacacaacaggcccccggtgtgtgatgttccccttcctgtgtccatgtgttttcattgttcaattcccatctacaagtgagaacatgtggtgttgggttttttgtccttgccatagtttgctgagaatgatggtttccagcttcatccatgtccataaaaaggacatcaactcatcattttttatggctgtatagtattccatggtgtatgtgtgccacattttcttaatccagtctatcattgttcgacatttgggttggttccaagtctttgctattgtgaatactgccgcaataaacatatgtgtgcatgtgtctttatagcagcatgatttctaatcctttgggtacatacccaataatgggatggctgggtcaaatggtatttctagttctagatctctgaggaatcgccacactgacttccacaatggttgaactagtttacagtcccaccaacagtgtaaaagtattcctatttctctacatcctctccagcacctgttgtttcctgactttttaatgatccccattctaactggtgtgagatggtatctcattgtagttttgatttgcatttctctgataaccagtgatgatgagcattttttcatgtgtcttttggctgcataaatgtctccttttgagaagtgtctgttcatatccttcgcccacttgttgatggggttgtttgtttctttcttgaaaatttgtttgagttcattgtagattctggatattagcccttcatcagatgagtagattgcaaaaattttctcccattctataggctgcctgttcactctgatggtagtttcttttgctgtgcagaagctctttagtttaattagatcccatttgtcaattttggcttctgttgccattgctttttgtgttttagacatgaaatccttacccatgcctatgtcctgaatggtattgcctaggttttcttctagagtttttatggttttaggtctaacatttaagtctttaatccatcttgaataaatttttgtataaggtgtaaggaagggatccagtttcagctttctacatatggctagccagttttcccagcaccatttattaaatagggaattgtttccccatttcttgtttttgtcaggtttgtcaaagatcagttagttgtagaaatgtggcattatttctgagggctctgttctgttccattggtctatatctctgttttggtaccagtaccatgctgttttggttactgtaaccttgtagtatagtttgaagtcaggtagcgtgacgcctccagctttgttcttttggcttaggattgacttggcaatgcaggctcttttttggttccatatgaactttaaagtagttttctccaattccgtgaataaagtcattggtagcttgagggggatggcattgaatctataaattaccttggacagtatggccattttcatgatattgattcttcctacccatgagcatggaatgttcatgcttttgtttgtatcctctttgatttcattgagcagtggtttgtagttctccttgaagaggtccttcatgtcccttgtaaattggattcctaagcattttattctcttcgaagcaattgtgaataggagttcactcatgatttggctctctgtttgtctgttattggtgtataagaatgcttgtgaattttgcacattgattttgtatcctgagactttgctgaaattgcttatcagcttaaggagattttgggctgagatgatggggttttctagatatacaatcatgtcatctgcaaacagggacaatttgacttcctcttttcctaattgaataccctttatttccttctccttcctgattgccctggccagaacttccaacactatgttgaatgggagtgatgagagagggcatccctgtcttgtgccagttttcaaagagaatgcttccagtttttgcccattcagtatgatattggctgtgggtttgtcatagatagctcttattattttgagatacgtcccatcaatacccaatttattgagagtttttagcatgaaggttgttgaattttgtcaaaggccttttctgcatctattgagataatcatgtggtttttgtcattggttctgtttatatgctggattatgtttattgacttgcatatgttgaaccagccttgcatcccagggatgaagcccacttgatcatggtggataagctttttgatatgctgctagattcacatcaaataaaatactgatgtgccagtattctattgaggatttttgcatcgatgttcatcagggatattggtctaaaattctctttttttgttgtgtctctgccaggctttggtatcaggatgatgctggcctcataaaatgagttagggatgattccctttttttctattgattggaatagtttcagaaggaatggtactagctcctctttgtacctctggtagaattcagctgtgaatctatctggtcctggactttttttggttggtgagctattaattattgcctcaatttcagagcctgttattggtctattcagagattcaacttcttcctggtttagtcttgggagggtgtatgtgtcgaggaatttatccatttcttctagattttctagtttatttgtgtagaggtgtttatagtattctctgatggtagtttgtatttctgtaggattggtggtgatatcccctttataattttttattgcgtctatttgattcttctctcttttcttctttattagtcttgctagcggtctatcaattttgttgatcttttcaaaaaaccacctcccggattcattgattttttgaagggttttttgtgtctctatatccttcagttctgctctgatcttagttatttcttgccttcggctagcttttgaacgtgtttgctcttacttctctagttcttttaattgtgatgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcattttgttatgtacccagtagtcattcaggagcaggttgttcagtttccatgttgttatgcggttttgagtgagtttcttcatcctgagttctagtttgattgcactgtggtctgagagagtttgttataatttctattcttttacatttgctgaggagggcttcacttccaactatgtggtcaattttggaataggtgtggtgtggtgctgaaaagaatgtacattctcttgatttagggtggagagttctgtagatgtctattaggtccacttggtgcagagctgagttcaattcctggatatccttgttaactttctgtctcgttgatctgtctaatgttgacagtggggtgttaaatctcccattattattgtgtgggagtctaagtctctttataggtctctaaggacttgctttatgaatctgggtgctcctgtattggatgcatatatatttaggatagttagctcttcttgctgaattgatccctttaccattatataatggccttctttgtctcttttgatctttgttggtttaaagtctgttttatcagagactaggattgcaacccctgcctttttttgttttccatttccttggtagatcttcccccatccctttattttgagcctatgtgtgtctctgcacatgaggtaggtttcctgaatatagcacactgatgggtcttgactctttgtctaatttgccagtctgtgtcttttaattggagcatttagcccatttacatttaaggttaatattgttatgtatgaatttgatcctgtcattatgatgttagctggtgattttgcccgttagttgatgcaatttctttctagcatcgatggtctttacaatttgacatgttttcgcagtggctggtaccagtttttcctttccacgtttagtgcttccttcaggagctcttttagggcaggcctggtggtgacaaaatctctcagcatttgcttgtctgtgaagtattttatttctccttcacttatgaagcttagtttggctggatatgaaattctgggttgaaaattctttcctttaagaatgttgaatattggcccccactctctcctggcttgtagagtttctgctgagagatcaactgttagtctgctgggcttccctttgtgggtaacctgacctttctctctggctgcccttaacattttttccttcatttcaactttggtgaatctgacaattatgtgtcttggagttgctcttctcgaggagtatctttttggcattctctgtatttcctgaacctgaatgttggcctgccttgctagattggggaagttctccaggataatatcctgcagagtgttttcaaacttggttccattctccctgtcactttcaggtacaccaatcagatgtagatttggtcttttcacaagtcccatttttcttggaggctttgtttgttactttttattcttttttctctaaacttctcttgtcacttcatttcattcatttgctcttccatcactgataccctttcttccagttgatcgaattggctactggggcttgtgcattcatcacgtagttctcgtgccgtggttttcagctccatcaggtcctttaaggacttctttgcattggttattctagttagccattcatctaatattttttcaaggtttttaacttctttgccatgggttcgaatttcctcctttagctcggagtagtttgatcgtctgaagccttcttctctcaactcgtcaaagtcattctctgtccagctttgttccattgctggtgagctgcattcctttgggggaggagaggtgctctgatttttagagtttccagttcttctgctctgttttttccccatctttgtggttttatctacctttggtctttgatgatggtgatgtacagatggggttttggtgtggatgtccttgctgtttgttagttttccttctaacagtcaggaccctcagctgcaggtctgttggagtttggtgaaagtccactccagatcctgtttgcctgggtatctgcagcggaggctgcagaacagcagatattggtgaacagcaaatattgctccctgatcattcctctggaagttttgtctcagagcagtacccggctatgtgagatgtcagtctgcccctcctggggggtgcctcccagttaggctactcgggggtcagggacccacttgaggaggcagtctgtccattctcagatctccagctgtgtgctgggagaaccactactctcttcaaagctgtcagacagggacatttaagtctgcagaggtttctgctgccttttgtttggctgtgccctgcccccagaggtggagtttacagaggcaggcaggcctccttgaggtgcggtgggctccacccagttcaagcttcctggctgctttgtttacctactcaagcttcagcaatggcaggcacccctcccccagcctcgctgccgccttgcagtttgatctcagactgctgtgctagcaatgagcgaggctctgtgggtgtgggaccctctgagccaggcgtgggatacaatctcctggtgtgccgtttgctaagaccattggaaaagtgcagtattagggtgggagtgacccgattttccaggtaccgtctgtcacccctttccttggctaggaaagggaattccctgaccccttgcacttcccaggtgaggcaatgcctcaccctgcttcggctcatgcttggtgtgctgcatccactgtcctgcacccactgtccaacaatccccagtgagattaacccagtacctcagttggaaatgcagaaatcgtttgtcttctgcgtcactcatgctgggagctatagactggagctgttcctattcggccatcttggctccacctcttttctttttttttctttcattctttctctctatatctcttctctttcctctttctctcttttcctctcgcctgcctgccttccttccttccattttctctctctctcttcctttctttctttcctttccctccctttccttccttccttctctttctttctttctttctttctttctttctttctttctttctttcttctctctttctttacaagatcttactctgtcatgcagtgttgcaaacacagctcactgcagcttctacctcctgggctcaagtgatgatccacctgcctcagcctcccaagtagctgggaatacaggcttagacctatgccaccatgctcagctaattttgtttgtttgtttttagagatggggtctcgccatgttgcccaggctggtcttgaattcctgggctcaagtaatcctcccacctcagcctcccaaagtgctgggattacaggcatgagctaccattcctggccctgagtgtgtatttctaactaaattaatgagaacgagagagaaaaaaatataaatttatataacataagtgattctgcctgccattccaatctacatgtgcatcctcttgtgacagactgactctactaagtgcttagctgatggccccctacctattcctgtcgttgctagtcaagatcctgtttcattccttttttcatcctccaggtggccacatcctcagggaaggctgagaccttcctcaacccagggtttattcttggttcattaactccaagccagttttgatgattctattccctttcccttattggtttaggagtaggtttatgctgtatttttgatcagtgagactttgggggttcagctttggtgaggggtagggggtgctttggggaaagcttcttttttcttaaaaagggaggagaggagaatcctcccttttcctgtctctgaacattttaatgacacatggaacttctgtgtccatcttgggacatcagagaaaagccaggagaattgcagagaggtcaaactgaggccatcagggcattgagccactgaattagccacctctggtgccatactaccttgggacttgttatatgagccaatcaatcctctgttgtttaatgccccattaaataatctttctaccacctgcaggtaaaagcattctaaatgatacagtatgaggatgactgttcccacagttggtctcagcatcttgtatctctcaaaatctgagcatcaacaaatcccaagaaattctagagtttcaagatacatatttttgtacaacatgattcttagtacaagccagcaacatcatctggtatttaacatgagaaaaggaggtctgttcctaagctggaacttttgggttttagtgaggtatgacactatattgtacttattgggagatttaaggaattttcaaggggagttttgactatgcaaacttctgccttttctctttagaacctaatccttttctgagatgccactgtagggaactgaaaggaactttccctttcaccctgtgaaggttcactgaaaaatcaactcacgaaaggctaataattggtggaaagacgtataaatttatttaacatgtgcatgggagccttcagaaggaatacccaaagatagaggtgaaattgcccatttttgtacttagtttcaacaaagtttggacagccatgtagatctaaaaaggatataatctaatgttaatagacagtgaggaaacccagcaaggcctgtctgtctagattcttcttcagcatgcatcctctaagcatgcattccttccttctgagtgtgaggcaggaccccttctggaatgggggccttatgactatagtcaaattaggtaggtcagataatttttcatggccagttgttacacagaaaggtggtgggaaagtttgagttatacctgtaggttttgtggctggctctgggggaataaagtgttctggtttctgtgactaccctttggggaacaggggttctagtttctacggctagccctggggaagaatgagaatgagagacaggaggacagaagaatgtcagagaaaaactgttgtttctgaggttttcattttagggtatgttttctgagtcccaacacaactaaaccgtgcaactgggcacagtggaaacagagagtggcccaaaagaagtataaagtatgagccattcaagaccagcctgggcaacatggtgaaacctcatctctacaaaattaataataattattataataataattaaatttatttaataaaaaagaaagtatgggccattataacctggttgaggagaaaaaacttaaatggcaggattgattttgaggctagaacacagcaaatttatccaaaggagtctctatcatgggacttggaggttgatggggaaggcgagtctagaaggactccttcttcccatgaggctgggctaggctatgctggtgtaataaacaatccccaatcctgtggcttcaaacaatagcagtttagttctcactcatattacatggccaaggtgggttgcttgtgtctctgtgctgcattgcccttacactggggcttaggctaacagaattgccactatctaggattgccagttgctgtggtagaggggcagggtcatgtgaccagttctggccaatgggtgtgggcagcagagacatctattacttctgggctggagcatttaactgctgatgtaggacaccttgctgcccacatccaatggccagaactggtcacatgacctcagcaactctaaggaggccaggaagtgaaatcctgttacatgtctgcaaggagaaagaactgggaatatttgcatgagcggcattaatggccaccagtcaccctctttgtccagtgatccatctaaaatctgtgtagacaatgagcgagagcaaatttccactctcttgcacattcgggtccattcagacttgtctttctctcttactctgttttcacgtggtggtgcctggtgattacagggagtgtgggtacagtcagtgtccttccatgcgtgccactctctccctctgaggctttgaccctttaattttacttttacttttattttatttttagtactaaccaaggtcagagctaaggaagtcacccagtgattttttctggaatgccatccattgctgcttcaccaggtctctttagccgcctgacgccttcattgtttactgttacattgtctccctttgttcaaagatgcaaagttggccgggcgcggtggctcacacctgtaatcccagcactttgggaggccgaggcgggtggatcacgaggtcaggagaccgagaccatcctggttaacatggtgaaaccctgtctcaactaaaaatacaaaaaattagctgggcgtggtagcgggcgcctgtagtcccaactaccccagaggctgaggcaggagaatggtgtgaacccgggaggtggagcttgcagtgagctgagatcacgccactgcactccagcctgggcaacaaagtgagactctgtctcaaaaaaaaaaaaaaaaaaagatgcaaagttattttgtctacagggtactctactcaaaccctcatggcttcctgctaccagcccaaatccctctccctgcagatcctcatgtgtgtccctggcttctccagctggggcctgaactcagctcctttgttctggtggcacacctctgtctgccctcacatgcactcttcccaacagaagttagtagcagagagggcagccatgtaagtcaacagagcacgccctgtgaatggagacacagatgttggcgctaaggaattggagcctgggctaatggacttattcctctgactgtgcagctaggtgagagggtgtataaaaagcaatacaaaaaatgttatggtggttgatttcatttatttctgagaggtctttataaaactgtccctgatggatatttataaacataacctcagctacaagtagacaggtctcaatttctcctatcgcagggaaatgcaaacttattctcttctttcctcaaggtttggtcttgtattttaaaaatggaataaagattgtagtaatgttgctagggattataggaataatataaatgtaatttctcttctcaaagacattataagtaagaatttcagcaaagggagaagaggaatgtaagaggaaaatggttgtttgaaagtgcagtatatagaagtataatatctatttctatatatagagatagaatatacaattaatatacatactatatatataatatgtattatacatactatatatgtatagaatagttaatatagcaatatataatataattatataaattctctacatatataaattctatatatagaatatataaattctctatatttctatatgttctatacattctattccatatattctattctatttatatattctataaatatatagaatacttaaatttatagaatacttaaatatattttaaaatactaaagtatatttatagaatgtatatacttttgggctgggtacggtggctcacgcttgtaatcccagcactttgggaggccgaggcaggtggatcacctgaggtcaagagttcgagaccagcctcaacatggagaaatcctgtctctactaaaaatacaaaattagccgggcatggtggtacatgcctgtaatctcagctactcaggaggctgaggcaggagaattgcttgaacctgggaggcggaggttgccatgagccaagatggtgccattgcactccagcctgggcaacaagagcgaaactctgtctcaaaaaaaaaaaaaaaaaaatatatatatatatatatatatacttttgtatataagtatacaaaagtatatttatagaatatataaattatatatttctctatatattccatatatattctctgtctagaatatataaatgtatatatgtggagaatatgtgtaattttttatatgtatggaatatatatattaatttatatatggagataatatatataggatttatgtatatttctattatatatatatatacttttttccccaagttcttaggtcagattctttatataggttcttcccctacaaccagaggaaactgtgtttttataactaataatagaaatacatcagcctagaatatgtgtcttttacaattgaacatctaagctttgcaaatgttggtgctatagttataaaccatggatgttagtcgaggggaaactcttctccggaactcaaacatgaaagctgatgttaaaagtcattgctaaaattctagagctgaggggattacaaatcagcattctaagctatcctcctacccactggtccaatgcattacatgttggcagaatggaaatcattttggaaaagggaagtggcattttcagatgtataaacatcttcctataaagaagtgtctgtcattttctatctccaagttctcaagaagacagggtctcctgccccttggtatccaaataaaattggcctgtagtctactgtgcgcagtgtgtgggttaagtgctttctccaagattcttagcattgtgtcctccttcgactccacattctccgggagctcccatgggcacacagctgctctcttgtttccatccccaagtccaagtgggatgtcattcagcttccaacagacaactctagcacaagatactggtgtagaacagatctccaccataggtacgagagtgagggaagaattacatcatgacacagcataataaatactttaaaatgaatttgtaaacattgctgttctgaaaagccctttttaggctgggcacggtggcttatgcctgtaatcccaacactttgggagactgaggtggttggatcacttgaggtcaggagttagaccggtctgaccaacgtggcaaaaccctgtttctactaaaattacaaaaagtatccgggcatggtggcgggtgcctgtaatcccagctacttgggaggctgagacatgagaattgcttgtgcctgagaggcggaggtttcagtgagccgagatagtgccactgcactccagcctgagtgacagagcgagactctgtctcaaaaaaaagaaaaagaaaaagaaaaagaaaagtatttttttattaccccctggtaatttcttactgccaatttttgccctaatttctttcaatttctttccctcttctgactgcacctcttccttcttatcttccttctgtgatgtgggacccacattttcacacccaaatggtccatagagttgctttgttctccaaaatacagttttctccttggaaggaattttacctctagcttttaaaataacatttctgttcttacaaacttatcatcaggattaatcacatttttaaattaaaatgttattactaaaacacttaaaactaaaatagcatttttaaactaaaatgctatgtctgttttctctcactcttgttatgaaatgtttcctaatgtgaagtgttttcttgatggaagactaaaatattgagacaacatatatatttatgtctcacatctccttcttatggccatatagcctttaataaaggtagtgttgcttacaaaaggaatgattgtataatagcagagaaaaaattctttccaaagtgaaataatagagatgatagagatgaaaaccaacacttgtgaatgaaacttttatatgcagaattatattagcatagttaaaggtaaaaatacttgatccataatgattttcatttataattttggttatagattgtatctattagctattgttacaataatgctgcttgacaaaccatcccaaaactcattggctttcgttgtcatgcatatgcagttggctggggcttggctgatctagacctggcttggcttccaggtgcagattggatccagatctgctccccaggactctcatccacttgcaggctgactggggcttgtccttctcatgctgtagcagagtgcaagcctcacctcttaagcccatttcaaacctttgcttgcattatgccctctaacatccctttggccaaagcaaacatcagtgagacagggaagatcatttctcccacagcaggagaggaggagaatgaatatttgctgaacagtaattcagactcttacataagtgaagtatcatctgattgtccatcatgcccaacatctgtgtctctctgccagccaaatccaacaggtatcaaaagtggcttaaagcaggaggggttattagtcggttaaaagcaaagcatgtcaaggaaataatctattcatgtaggagcaaagatttttcttctataaacttgcatttaagataaagctgacaatctccttgcagcaattccttgagaagaaagtgtagaacaaggcacaacactcctctgacccaattcctgcaacctagtcagagaggacaactatttgcaccatgaattgaattatagccaaacaggtcttgagtaattcattgtgcatatatcctatgaaatgaagctctcaaggacccagaatgtaaactttaaaaagtaaccagtgttaatacattaaaatttcattaatttcgtattaatttacttaaagcatcatgtaatttcaagtaattattagtcattcatcaccttttgttcagttgattcttactagaaatgctggagtatggcaatcttacacatctctgggttcttgatttagcacagaggctggtagagtacatctcatgggacaaactagctgtttttgtaaataaagttttattggaacatactcatgctcatttgtttctatgttgtctgtagctgctttcactctacaagggcagattgagaagttgcaacagaaatgctatgaactcaaagcctaaaatatttactatgtgacgagcagaagaaagatggccaatcctgatttaacataatgctagacagttgaaattttggaatttgggttattcacacagttctgggatgaatattgttcttgagctatccttagataactatctaaatacttagagaaaagtatttttttaggaaaatcaataatgtaaacaaatattacacagataattttaacctccttaagaaaataatctttttaatacattaggttatgagcacttatttctaaacagttattataccaatcataaaatttgtatttgcttgttaaaggagactctgaaaaactctatcaaatattgctttattaacctttaaggagatgattattcttgcaataaacctacggtttttaaaaatatacacttgccagttgggcacagtggctcactcctgtaatcccagcactttgggaggctgaagtgggcacatcacgtgaggtcaggagttcgagaccagcctggacaacatggtgaaaccctgtctctactaaaaatacaaaaattagctgggtgtggtggcacatacctgtaatctgagctacttgggaggctgaggccagagaatcacttgaacctgggaggtggaggttgcactgagccaagattgcaccactgcattccagcctgggcgacagagcgagactctgtcctctgtctcaaaaaaaaaaaaaaaaaaaaaaaaatgtatatatatatatatatatatatatatatatatatatatatatatacacacacacacatatatcttgccatttcttcaaacttttcaccaatgtagatcattttaactctattcacgtacataactgcatctgaattagtacaattttactatattgtgtttaaagatatttcaaaacaccacactggcccctgatcttttctttgatattagaaaaaacaaaatcttgtgtcttgccggatgtccactcttggagacaatcgggtagctttagaagaaagaaacattagcatttctaaagacttggagagagaacatgggcagattttaaaagtgacgacacattcttagttatttccagtagatatattgagaacacagaaaaatctggagtcatatctattgggtattgaattagatgtgtgtatttctgtgttctgggattcactttaaagccccaaatgagtctcaatatgaggcctgaactggagaagaagaagagttcgtggagaagaacagaagggtggcttacacctgtaatcccaacactgggaggccaaggtgggtggatcaccggaggtcaggagttcgagaccagcctgggcaacatggtgaaatccccatctctactaaaaatacaaaaattagtcaggtgtggtggcgggtgcctgtaatcccataatcccagttacttgggaggctgaggcaggagaattgctgaggcaggaggcggaggttgcagtgagccgagatcatgccattgcaccccagcctaggcaacaagagtgcaacttggtctcaataaataaataaataaacaaacaaataaataaaaatgaaaagaagaagacgaagagttcatcccagcctcttctccaccctgggctaggaatagctctctataagatataggatttagacaatggatcctaaattggagattaggtaaaaacaaaagaagtgctccaggactacacttctgaaaggaagttttcctagcccagtaactgcaagataggtatagagctataggtcatcatcagctccctttacaagtcacatgggattgtaatctgagcaataacaactgtgtatccatgtcagctgaatgacttggctcaaatggcacttcttttttttctttcaggagtcgggtgggagaatgtgctgctaaaggaaggtgagtcagcctcgaacgccacagaaacatccggcccagacatgactatcaaggtaagggattctcttcaggttgattctcaaagtgtatctctagagtaaaggcagccgatggcaggtttttctgggggcaaaatgaacactaccaatccaccttgctagagttctctctctactcactgaggtcttagggaggcaaccgtacataagattttctgaaatttgggatctggtctacagccgtaccaccctgaatatgcccgacctcgtctgaaacttgggatctggattaggaaactgcttgaaaaccagaatctaagatgtgatttccaatgggcctgtcgtagggtcttcagtgaatatctacacgtaagctatttgtaaatggtaaccccagtgggcacagtggagcaaatctgaaaattctgatctgagaattcaggccccactgtgcattgtgaggaaaggtcagagaggcataaagtagctttgatcttggctcaagatttccactgatgtcagcaggaaggcagcacatggcccactccagctgaaacactaatggccaaaggtttacaaaatgagtcatctagaaatccacttaactatcactgttcaaattaaatgcatcaatttgtaagcactggccagaataaagaatctgtagcaaaagttatcagaggtgccaccatttcccctctgttacgggattaaacacaaaggaatgatcttcctctcttagaactctgctaacatattagttaacaaaggatgggggtgggagggctttctaacattcttgcttgaatgattataatttgaatatatgctacttatgaatttttctttgaaaaataagaagtaatgtcttattttatatagagctgtaactggagatatttctttttttttgagacggagtctctctcttttgcccaggccggagtgcagtggtgcgatctcggctcactgcaagctccgcctcccgggttcatgccattctcctgcctcagcctcctgagtagctgggactacaggcgccagccaccgtgcctggctaattttttgtatttttagtagagacggggtttcaccgtgttagccaggatggtctcgatctcctgacctcgagatccgcctgccttggcctcccaaagtgctgggattacaggcatgagccaaactggagatatttctctcctggatctattagtagaagttgtacaaaagaatatacagcatggatttattcaagttttcttttgtaatgtgaaggctaaacttgtgttgtctatgttacaaatggtagagaaagcaagcaaatgttaccatagtaaagctaaatgaaagataggatagtagcctgattagtcaaaaagtcaactaatctaagtggtaactatccagtgctgaaagaactatcactacgtttagcagaatttgtaagacaataatataaattgcaatgacatgttggtgttttattggctattattgcaatgattgacaagtttcagtctatgaccacattggacgaaggggaatgggtgccaatagtaaaacctgttggatttagatttgttatctcaaaatctgttatcatctggagaattagtttttgagaagagttgctagtgggagagaagacagcatgttgccagtgtagctgcagatgtggtacagacagacattcaagtagtcagaaagactggagtttgcttttataaagcaaacggcatattcctttttttttttttttttaagacggagtcttgctgtgtcgccaggctggagtgcagtagcgcagacttggctcactgcaacatccgcctcctgggttcaagcaattatcctgcctcagcctcccgagtagctgggactacaggtgctggacacaatgcccggctagtttttgtattttcagtagagacggggtttcaccatgttggccaggttggtctccatctcttgacctcatggtccgcctgcctcagcctcccaaagtgctgggattacaggcgtgagtcaccgctccaggccacaaatggcatattctaatagaagcaagtcttgtccaaatcccatttgataagattgctacttaaccaggctactcatccatggtaccaggatcttgactgaagttgtatttgggtccctctagtttagacatcattctcgatctccgtttctttttcttttaatgaatacctgaaaatttctcacaagaaaagatttcttttacccctgccctaccccaggaagatttttcatccataagaactgaactcattctgaggaataaataccatacactttaaatagttgagcaaaatagaaatttatttctttattcattttgaggcagagtcttgctctgtcacccaggctggagtgcagtgtggcatgatcgtggctcactgcaacctccacctcccaggttgaagggattctcccacctcagcctcccaagtagctggaattataggcatgtgccaccatgcctggctaattttcgtatttttagtaaagatggggtttcaccatgttggccagtctggtctgaaactcctggcctcaggtgatctgcccgcctcagcctcccaaagtgctgggattacaggtgtaagcctctccacccagccagcaaaatagaaatatatttaaacacatcaataaacccctacaaatattctagagttcttctcttaatgccagttccttctcactaaggaatttgtgaattttctaggtggatataactacagaaaatgcttgtttctatcttctcctttaggattcccaattacggagcagtcattgacttttttcctttgggtataagttgtttcccaccccacattgccttacataaccatgatgtctttgtatctaaatgaaagtattattttttctgctccacttcgttaatcagagaaatgcaaattaaaaccgcgatgagataccatctcacgactgggcatggtggctcacacctgtaatcctagcactttgggaggccaaggtgggtggatcacaaggtcaggagatcgagaccatcctggccaacatgtgaaatgccgactctactaaaaatacaaaaattagccgggtgtgatggcgcgtgcctgtaatccaaagctactagggaggctgaggcaggagaatcacttgaaccagggaggcagagattgccgtgagccgagtctgcgccactgcactccagcctggcaaaacagcaagactctgtctcaaaaaaaaaaaaaaaaaaaaaagagagataccatctcacaccagtcagaatggccattattaaaaaggcaaaataacagatgttggtgaggatgcagagaaaagggaacagttatacactgttggtagcaatgtaaattagttcaacccctatggaaaacagtaaggagatttctcaaagaacaaaactactgtttgacccagcaatggatatctacccaaaggaaaataaatcgtcttatcaaaaagacactcacactcatgttttctgtagcactattcacagtaggaaaatcatgaaattaacctaagtgttcatcagcggtagactggataaagaaaatgtggcatatatacaccatggaatactacatagtcatataaataatgaaatcatgtcctttgtagcaacatggatgcagaaggaggccattatcctgcaagaattaatgcagaaacagaaaatcaaatactgcatgttctcccttataggtgggaactactacacatgggcataaagatggaaacagtagagactggggactctaaaagaaggggcaatagagaaaggagaaagggttgtaaaactacctattggatactatgttcactgtttgggtgatgggttcagtagaagtccaaatcccagcattacgtaatataccttgtatcaagcctgttcatgaaccccctgaatctataataaaaaaattaaaattaaataaaaagaattattttttttctctctgtatataactgcctggagctcattaagcacagactccccctcttacatttagctatagctattcctacttctaatagctactttatatatccttgcaatatcagctattcctgccttttgcctgagaaaacaaaatattctgttaataaaacctgatacactgacacttttcaagggaaatatcagcagaaattacaaagatagttgggtttcttccatattgctcttcttgtgataaaggtgtctattttagtatttataaattttctttctgaaaaaggaatacaatgttttgaaggtgcttgctttctctttgccttccatttcccttgccatgattgtaagtttcccgaggcctcccagtcatgcttcctgttaagcttgtggaactgtgagtcaattaaacctctcttctggctgagcatggtggctaatgcctgtaatcctagcactgtgggaggccgaggtgggtggatcacctgaggtcaggagttcaagaccagcctggccaacatgatgaaaccccatctctactaaaaatataaaaattacccgggcgtggtgatgcatgcctgtaatcccagttacttgggaggctgaggaaagagaattgcttaaacccaggaggtggaggttgcagtaagctgagatcacgccactgcactccagcctgcatgaccagagtgagactccatctcaaaacaaaaaacaaaaaaaccctctcttcttcataaattacccagtctcaggtaactctttacagcagtgtgaaaatggactaataaacctgtgaatgtgacttatttggaaaaaaagtctttgcagatacaattaacaatcttggctgggcacgttggctcatgcctgtaatccaagcactgggaggctgaggtgggtagatcacttgaggcctggagttcaagaccaacctggccaacatggtgaaaccctgtctctactaaaaatacaaaaaaattaggcatggtggcacacgcctgtaatcccagctactccggaggctgaagcacgagaatcatttgaattcaggaggcagatgttgcagtgagctgagatcacaccactgcactccagcctgggtgacagagtgagactctgtctcagaaaataatactaataatcttgagatgagagcatcctggatttaccagatgggccctaaatccaatgacacatgtccttataagagacaaaagaggatactcatatacacagaaggccatgtaaggggactgaggcagaggttgaagttatgcagcccaagtcaagaaacacgtggatccaccagtagctagaagaggcaaggaaggagtcttctctagagcctttggagggagaggagtgcagccctcctgacaccttgaattggaacttttggcctccagaattgtgagaaaataaatttccgttgttttaagccaccaagtgtgtggtagtttgttatggcaaccctgggaaatgaatgcactcagattctgccaagaatcacacctatgcttcttgagtgcaaatgccatagaggctgataaaccaatattacgaagatccacataattttcttattttactctacttacccttataaattgttttttacctgttcttgttttgggagaaccactaacttttttcagcctatatttatcatccttcactggaagaaaagggtagctgtatctcagaatagcttctattttatatcctattctgttttgttgcttgtccagacattgaatttaaaaaaaaaaaaaaacaggtatggatcagtatttcttgaaatgcctgaccctgagaatcacctgcagcaatgtagaaaacaacaataacacagcttgccagacatctttcagaattcagattcagaagacctgggcttgagaattagcatttttaataagtgctccaagtaactttcatgattagtttcagaaaatcttgtcttagcacaccactaatgcagtctgggggtggcaatgtgagccctactattgctcttggctctccagttgtccaaccaatctgaggcaggatttggatacttccctattcagtgccctttgattacttcccatttcaacactgaataagcctcaggcttcccctgccttctagactttcttactcttaacttcagtttcatttttagcattgtctttcactgtgtctctctctgtacccattcttgccctctttatccggtctacttgtagcctggatactgtagctttctttttaaaaagctgagttgagctttgcacggtggtgggaagattgcttgagcccaggatttcaaccctagcctgggcaacatactgagactccatctctaaaaaaataaatgaaaagatcaagctgataatatccctctgctaaggccctgctggccttcccatggctcctggaacaaagaccaactcttgcaggcactgtgttttttaaaagcccctggctttcattcacttctcccttgatcttcctgctctccctctctctttatattcacatctttggctcaaatattccctcctccagtggcacattcttttctttttttttctttatttttattttattttattttattattattatactttaagttttagggtacatgtgcacaatgtgcaggtttgttacttatgtatacatgtgccatgtttgtgtgctgcacacattaacttgtcatttagcattaggtgtatctcctaatgctatccctcccctctccccccaccccacaacagtccccggagtgtgatgttccccttcctgtgtccatgtgttctcattgttcagttcccacctatgagtgagaacatgtggtgtttggttttttgtccttgcaatagtttgctgagaatgatggtttccagtttcatccatgtccctacaaaggacatgaactcttcattttttatggctgcatagtattccatggtgtatatgtgccacattttcttaatccagcctatcgttgttggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttttttcctgactttttaatgatccccattctaactggtgtgagatggtatctcattgtggtttcttttttttttttttttttttttttttgagatggagtttcgctcttgtcacccaggctggagtgcaatgacgccatctcagctcaccacaacctctacctcctgggttcaagcaattctcctgctaagcctcctgagtagatgggattaacaggcctgtgccaccacgcccggataattttgtatttttagtagagacggggtttctccatgttggtcaggcttgtcttgaactcaccacctcaaatgatccacccgcctcggcctcacaaagtgctgggattacaggcgtgagccacagcacccagctccagtggcactttctaacaagcattgcttgtttcacattctcataggacctaacagctctccttcatagccactcacatcaataaccatagatgtcgggcaggtgtggtggctcacacctgtaatcccagcactttgggaggccaaggtgggtggatcgcttgagaccaggagttcgagaccagcctgagcaacatgacaaaacccagtctctacgaaatacaaaaaaattagctgagtgtggtagcatgtgcctgtagttctggctacttgggaggcaagagatgggaagatcgcttgagcccagggagattgaggctgcagtgagctgtgataaaacaaaaaataaaataaaaataaaaataaccataattttcattgcataatatccagttgcccttgctacaatatcatttccgtaagggtcatttttctgtttcattttttacttgttagaggctctaaattgtagttctttttttaaataacacaactttattaaggataaaatttgcatgccatatggttcccccaggtaggtatatgattcaataatgtttcataaatttactaaccatcacacaatccagttttagaacacacacagttttaaataatttccatcattccaataagatccctcatgccctcctatagttaatctccattctaccccatccccaaacaaccactcattcctttctgtttctataaatttgcctgttctggacatttcatataaatggagtcatacaacatgcagtgttttgtatctggcttaggatgatgatgattttttttttttgaggtttatccacattgtagcctcaatcactatccctttcactctttttaatgctgaataatatttcatttaattgatatgccaggctgggcatggtggcttacgcctgtgatcccagcactttggaaggccaaagtgggtagatcactagagcccaggagttggagaccagcctggacaacatggtgaaactgtgtatctacaaaaaatacaaaaattagctggatgtggtggcatgcatctgtagtcccagctacatgggaggctgaggtgggaggctcacctgagtctaggaggtagagagtgcagtgagctgtgattgtgtcactgcactctatcctgggtgatgacagagtatgaccctgtcttaaaaaaaaaaaaagatatgccagtgtcttgggttttttgttttttttttttaacagcccagaggtcttttatttatttattttttaaacacctattatgccatgaattcatagggaataggttccagcagttcaggctccttcccattggttctcacaaagtgtgcttctctgggtggagcaggctggcacttcagttgaacccaggtacctttctctttggcttctttctttttctgatcattttccttcacacatttcaggaagctatctcggctcagagtgcttaatgtgctcaatatgcacattaattctcttggcaagaatcttgcccttaacttgtttgtttacaataccaacagcatgctgggtaacattgtagactcttccagttttgccatggtaacacttgtggggcattcctttttgaacagtacccattcccttgatgtctacaatatcacctttcttatagattcgcatatacgtggccaaaggaacaactccatgttttctaaaaggcctagagaacatatgtcgggagcctctcctctttccctttgtgttcgtcattttggcgaattactggaagatggaggttccgcccgaaaggctttttttttttttgttccttcacaagttgatggattttgaggttgtttctaccttctggcagtaagtattcttgctatgaatagttgctgctttggatagtcacatgtaagcctttgtgtggacgtaggtcttcctttgtcttgggattgtacctaggagtagaattgctgggtcatatggtaaatctgggtttaactttttaaaaagctgtcagactcttttccaaagcatctacaccactttacacctcaccaacaatgaatgaggcttccaagttttctacatcctagccaacacttactactgtccatcttttgattataaccatcctagtgggtgtggagtcgtatgtcattgtggttttggtttgcattctcctggtggctaacgacactgagttattttcatgtgcttattggctatttgtatgcagttaatttttaatggcttgatttccttttttgccatagtttgttcaattattaaattgaagcactctctcattgcagctgcccagtcagtgttttctgagtgagggaccctcttcttgactgtggcaggagggtgcactcaactcacacttcccctttaagatcactgccctctccaccactacgtccctctgcaggggttgcatcaatctctcttctttctatttcttttctttctctcactcttttatttatttctttctttcttttagacagggtctcgctatgtcacccaggctggagcacagtgtgatcatggcttactgcagcctcaacctcccaggcccaagcaatcctcctaccttagcctcctgtgtagctgggactataggcgtgcagcaccacacttggctaaatttttattttttgtagagaaggaggactccctatgttgcccaggccaatcttaaactcctgtgctcaagtgatcctcgttcctcagcctcccaaagtgtgagattacaggtgtaagccatcacacccagcgattatctctcttttctattttcccttcacatcttagccttttttctttaatttttttattagcctaatcaatgctattttttattgtggtaaaacagatataacatttaccattttaagcacttttaaagggtacccgtctgtggcgttaggtacattcaaagtgttctgtaaccatcatcgtcatccatccttctccagaactttttcaacatcttcttcaaccaaaactctctacccattaaataccagccccccattctctcctactccagctcctgtcaaccacctaaatgttgcattttacacctaaaatgtattactatttaattgccttctcaaagggatttttaatacattatgttaatagtaaaaagccagtaaggccaggcgtggtggctcactactgtaatcccagcactttgggaggccaaggcaggtggatcacttgaggtcaggaattcaagaccagccttgccaaatggtgaaaccccgtctctactaaaaatacaaaaattagctgggtgtggtggcacacacctgtaatctcagccactctggaggctgaggcacgagaatcgcttgaacccaggaggtagaggttgcagtgagccgagatcgcgccactgcactccagcctgggtaatagagcgagatgcagtctcaaaaacaaaaacaaaaacagaaaagccagtaagatggctacccctcagaaataaagtaggaagctgctacaagctagatttttaaagatattgctggttacaaaagttcctttcttctgtggcgtgaactgtccaggaccctcatactggaaatgtcttggccttatccagctggtgccttgctgcaagtcccaaatcacacctgcttggctgtgcatcattttcttgaattttgtttatccaacgactggataaaatgacatcaagtaatccatgttaaagaagtatctctaggataaaaattttgtgatttggctgtcatttccatcaaatacaccaactaaatcgtagatgctctctttatcttgccctcttgtccatatatactaagactaaaaactaagtgtttgcaaaaaagaatacaaaaaattttagcacagcagaattttcctcagaatgaagtctggtattcttatttacatgttcaatatttctcatttatgcttgaacaagaaacaaggttggtagcccttaggcaaactagagattctggctgtaaaaccgtttgaaaagggtacatttctattcaaggacatgggaaagccacatttaaaaaaggatgttgcttctctacacgtaaaacttgttggaagacagattatcctcctagaagagcagatgttctctattacaaaagaggaaaagcatttagactcttccggtggtgaatagaggccacaggttacagctttctttggcctttgcttttaaaaaaacattctgctgaaggccttttgttgccagtggtgtccagccggttgccctttgtatttgatgatgacgacattgaaaggattgttttgtgcagggactctggacaaaaaagagacatttgggacagaaaacctttctacattgtgtatatacataaagatcgctctaaatttggttccttgccaaaggaaatattttcgaagattttttaaaaatccttgaaactattcagggtagtggatctcagagggggtttggcattggtgagtaggaggcatatcggtactatatgggtcagtttttataatacatgtctttgagaatcattgtcttgaattttctttaaaatgaatatgaagagctctgttgtaaactgtaataaactatattattaatggttatttattgttcctgtgtgctactccctatttgtcaaataaaataaatgtgaaagaaatgaagtcacaaccattgacagctttcaataatctatgtgtagataaggaatattcgtggcaagtgaataatctcaggtaccttcttctttgccgttttatttcttcgctgtgttctcttgccaacaataatagctaacatgggttgaacgtttgctttgagctgagtactgtgctacacatacaccatctcgtgtaatcctccagatgactctgctaaggagaaactgttattaatcccattctacagatgtggtggctgtggcacagtaaagtaacttacccaagatctcaaagtgagtgtgtggtggagccaagctttgaacccagatggaaggacactttgtagcctctctgtttgggttttaataagtgcaggtttatttttttttaattagctaaagcaggggagctccaatgacagggcaagggtagcttagccagataaaatattagatgtccagttcgatttgaattaaattgcatgggacatacttatattaaaaaattatttgttgtttacctaaaattcagattttactgggtgttctgtatttttatttgccaagtccagtggccctaggcaagaggagtgttgcaaaggaaatgaagggaaccgcgtaatgtgttttgattattgtcctttgggattatttgtggttttgggttctttttgaaaaaaaaaaaaaaagacttttttcattttaaacatgacaatgtattttattaagctttaaaccagacagatgtatattttaaggacttgtaatatgctgataacctatcaagggacatcccttgatatgcttctttgctaggaatccaaatctgatccatgccaagatttgtacctcattggtttctctatgaagtgaaactatgagaaacactaccctctatttgtttgtttgattgttttttcttttgaacaacagcaacaacaaaaaccctttacctcaatctgggtatatcatgactttttggaagccttattctaggatcttctttttagttgggatatcagtgttagcctaatttcattttctgcagatagcttcatcatcccaatttttaaaatgttgatgaaatactcttgtgcttttatcaactcctacttggtaaaatcccctatctctgagtggtcaccctaaaatacatgacatgggcatggatattcccagcaaaagttctgacacattcacaaatgcttcctgaggacatctgtctgtttccttctatgcacattttgaacattccagcagtgagaatgactaatgatgctaaagctctagaaactgtcacgtgttgctgttcagtatgtcagagcctgtctgcagataagcctcatttcttaagaataatctgtcccaatcaagctagttttgcaacaaggctcatttgcaagtaccaaagtctatgacttgtgaaagaaccaagccacgcaaaccaaacacagaacccagtgacagaaactattggtctttagtgcgactggaaggtagccaacctggttcccatttaggcagggaaccagtttgtctctccagttaatgtctgaataaattaccattcatgtccctgagggtttggaatgattgcaaattatttctgaaatcctgggtagaactcatgtggccacttacgataagccttgtccttctgcaactggtcaggtatcagagaggtctcataaatcaagattgtagttatcaggaaaagttgttggattcatagagtaggggccaagggaaaactttccctttgccctctgaaatttcgttgaaaaatcaattgacactagacagattaacgggagaaatggcatagaagtttactaatgtgcaaagagagaaaattacacacaatggggtacagatggttatatacccttcttcttagaggaaacggagataggaagtgtggagataggaagtggggggaagggcagtaaatgatttttacttgaagaaccaacagtgacctgggacaaagtctgttgggcccacagaacagacaacaatttgtgacagaagtctgttcagatgtgttgacagacttcattcagtctttcttcctgctatatgagttgctaatggcaactcaaggaagagaccagaagtaattgttttcttctctggagggtaagattttaggtagataagggaacttcacagaaccatttcatcctgtgcgtaggggagagacagaagattgagagacaggagtgaggggaggtcagagagaccttgagccttcttcaggttcagaatatcaaagcatcatatttggggatataggtttctgagccctaacaatgggaagaatgatctttctgtatcatatgaatactgaagattgttgaagtgagcatctagtgctcctatctcgataaattatccaatgcctttcccatctctttctcctacccattctctagtggcctgcccccttgccctttttattgtagtgaaaacttagtagtaaaaaatacacttggtaaaaatcatgacatcatgtaaattgtatgtaaaaagatgacatgctcatacaagatgcttgattcattgcctagcagagcaggccactggtaggtctgcataccacgagctggtctgtttcgaggtcacttatgcttactatcattgcaacaactacttcttcctcagaaattagtcagtggagatgtgacatttattttatctcagaatttttatgtctgtttctgaaaagaaaaaggtaccagcagctgcagttcccactccgtctcccaaagggatctgggctagagggtagggtattggatttgtcatcatattttccatctgctcacagattgtgaggtttattattgtttctgttattgttttttgagacagggtctcaccttgttgcccaggctggagtgcagtggcgccatcttggctcactgcaacctccacctcccaggttcaagtatttcttgtgccttagcctctagcctccctggtagctgggattacaggtgtgcgccaccaggcctggctaatttttgtatttttagtagagacagggtttcaccatgttggccaggctggtctcgaactcctgacctcaactgatccgcccacctcagcttcccaatgtgctgggattacaggtgtgagccactgcaccccaccagagtgtgagttttgatctccaacagtatgcattttctagtgaaattcggtttaataaaatgaataatgagataatagctaacatatattgagaacttcccatgtgtcaggtagtgctctgggtgtttagggtattctattatttaattcttaccacaaccctatgaggtgggtactaggatatctccagtttacagagaaaacaaggtgcagagagattaagtaacttgtctaaggtcacacagacaaggagtgctggagcctaggtctaagccagacagcactagatcttcatgactttgtcacagtgcttcaccttggagaataatgagatgatgctggtatgtagacatgctaaggaggtcttccttgcctcacagtcctgatcaatatggaggcttttatgtagttctgtttgcgttcattcttccaatgcaaagctggagtttacctagtgggataagatttgattttcatccttgagaatgagttgttcttcaggctggcccatgagtcttcatcctgtcagcattctgattacatttctcattatcattctcctgcagtgattcatgagtatgataaaaccgaacagccttctcagtaaataagcaaagcttagcttacggggaaaaaaaaaaaaaaaaaaaagtagagctttccttgaatctggagaaattaagcacacaggtgtcctgcaatattagttaagagactactgcacccatcatactgtagcttaagacagtttcttcttttagttttttctaaaatgtctccatgtctgtgttatgccacaaataacacagccttggttaacttttggactaaaaaaaatcaacttattggccaagcatggtggcttacacctatgattgtagcactttgggaggctgaggcaggaggattgcttgaactcaggagtttgagaccagcctgggcaacttggccagacatcatctctacttaaagaaaaaaaaccgccgggtgcggtggcttacgcctgtaatcccagcactttgggaggctgaggcgggcagatcacgaggtcaggagtttgagactatcctggccaatatggtgaaaccccatctctactaaaaatacaaaaattagctgggcatggtggcgcgtgcctgtagtcccagccactcgggaggctgaggcagaagaatcgcttgaccccaggaggaggcggctgcagtgagctgagattgtgccactgcactccagcctgggtgacagagtgagattctgtctcaaaataaataaataaataaataaataaataaataaataaataaataaataaaataaaaaataaaaaaacaaaaaaaataaaaaaataaaaaaacaaacaaactagccaggtgtggtgtgcgcatgtcgtctcagctactcaggagacaggtgggagaatcacttgagcctgggaggatgaggctgcagtaagccacaatcctaccactgcactgtagcctgggtgacagaaggagaccctatttctattataaataaataaatttattgaatgtcgtattatatgtagcataccatatttaagcagggtcaaatttttggtctgacttttcaaattaatgtgaataagtcactttgaaattttggagacaaaaccttatttaagttgagaaatagacaaacattcatccactaagaattattctttttattatttttagtgtgtttgagttggttcttgcaaagaaaatataaacaaatcccaaatatgaaaaagtttctaagtttatattaagtgtatcccatgagtgacacaggaaaatcccttttaagagaaatggtattgcaaaagacacagcaaatctttttctcttttaaataaaaatatgcattctgtgtctaagcattttccaaacctttctcctttgtgtggcttttactaaaccttcaatcctataacagtcattgacttcttcctactttcttttcctctctttccttctctcccttcactccctttctttttcccagtgtttactgtgggctaggcactgtgttaaacactttacctgcatttctctctttaacactcaaaatgacaccatgagataggtaccattttttgtcccattgtgcagatgaagaaatcaacactttgagaaggtaaagactttataaggtcacaaattctggaagagcagagtcagaattcaattccaggtttgtcatatttcagagcccacagtttattgctttctgtgtaatgagtaaatatttcttttagaatcaaaaaatattttaattaaaatgtaatgacaggaaaatagttttgatcctgggagcaagaattagtcaagaatggacctgatctaagaccactgtagttttttggacaggctatgagccagtggactggcacagatgaatacaaataacacatagctaatactaattgagaatctaaaaggtgtattctgtggcctttataagcatgaacttatccaatgagttccatgaactcatgatatagatactatacacttgttcttattttaaagactaggaatctgaggcacagggagataaagtaacctatggaaggtcctgctcagaatcagtggaagaatgaggattctgccttcattcctagcattcttcatgtggttagcatagtcccctaaccacagtgccagggcacctcttgcctgtgatccctaagtgctcttctgcaggtttctttctttcctttttttctattgtttttttgagatggagtttcactcctgttgcccaggctggagtgcaacggcgtgatcttggctcaccacaacctctgcctcctgggctcaagcaattctcctgcctcagtctcctaagtagctgggatttacaggcatgtgccaccacgcccggctaattttgtatttttagtagagacagggtttctccatgttgttcaggctggcctcaaactcccgacctcaggtgacctgctcgcctcggcctcccaaagttctgggattacaggcgtgaaccaccacacccagcctcttttgcatgtttcttggggaatgcagagccagttaactttacaactagccattcacttggaattcacatccacagcatagaaaagaccatagcgtatgctttccctatggagagaatccaataactatcaagccatatattcccctttttttttttttttttttttttgagacacagtttcgttgcccaggctggagtgcagtggtgcaatctcagctcactgcaacctctgcttcccaggctcaagcgattctcctgcctcagcctcctgaatagctgggattacaggtgcccaccaccatgcctggctaatttttgtatttttagtagagacggggtttcaccatgttggccagtctggtctcaaactcctgacctcgtgaactgccctcctccgcctcccaaagtgctgggattacaggtgtgagccaccacgcccggctgccatatattctttgtataagtgacaggtctgaaaatagctgtgtttatgattacggagttaaagggaaaagaatgccatagctaatgggagagaaaaatgaaaggtcaattgaattcgcccatggtaaatgttagaaatttaagggtcaatgtgatcctttcatatgaaatactaagttcttggaatcaacttacgggaaaatctagtatgtttagtgttttacaagtgcttttttttctgcctaaaatttaagaaatactttacccaatgtactaaatatatatgtgtgcatgtgtgtgtgtgtgtatatatataaaaaatatatataatataatatataattatattatatacacacatatataatatataatatacatattgtacatatgtataatacatattacatacatatgtattatatgtataatacatattatatatattatatgtataatacatattatatacatatattatatgtataatacatatacgtatataatatgtataatacatattatatacgtatattatgcgtataatacagatatatgtatatatatgatatgttgtgtgttatatataacatatatatgatatgttgtgtgttatatataacatatataggatatgttgtgtgttatatataacatatataggatatgttgtgttatatataacatatataggatatgttgtgtgttatatataacatatataggatatgttgtgtgttatatataacatatataggatatgttgtgtgttatatataacatatataggatatgttgtgtgttatatataacatatataggatatgttgtgtgttatatataacatatataggatatgttgtatgttatatgtaacatatataggatatgttgtgtgttatatgtaacatatatatgatatgttgtgtgttatatataatatatatgatatgttgtgtgttatatataacatatatgatatgttgtgtgttatatataacatatatatgatatatatattgttttggtgagttggtacttttttttgttattgttgagatggagtcttgctctgtcgcccaggctcaagtgcagtggcgtgatctcagctcactgcaagctccacctcccgggttcatgccattctcctgcctgagcctcccgagagtacaggcacccaccaccacgcccggctagtttttttggtatttttagtagatactgggtttcaccgtgttagctaggatggtctcaatctcctgacctcgtgatccacccgccttggcctcccaaagtgctgggattacaggcgtgagccactgcaccaggccctgtgctttgtttttttaaaagaaacttcctagaaaccctgatcaagtgggagtttttttgaacccgttaataagaacactttattgtaatgaaaataagaagtatttgggcatgcatctgataattatgtgttgaatgccttctgagggcaatgctttgtgccatgtgtcatgtgcctggtgcagcttccacttccaattatgtctggaatctgatttcaccattgatgtcaccactccaccattaccattctgctttcagccattatcatctcttgcccagattattacaatagcttctaagtgctctcccggccactcctttccctttctgtaacacagactccacccagaaacagccacagtgatgttataaaaatctaaaccaaatcaagtcatttttctgcttgaaataatgcagtggcttctcatcttattcaggaaaataggtaatccaaagtgcttatcaaggtttgcaaggaccttaggatctggctcactgccagtcttctctcacccctcctttctcagctctgaagtcctcctggctgctccaaacatgattgctcagtgtccccacacctgctgttccctatgctcgaatgcttttccccttgatgtctccctggctcacttccttccattctccaggtctctgctcaaatatcacctcagtaaagagtctgttcttgaccattacataaaatagtactcacctcctactgccatcaatatctatccctttaccctgttttatttttctttataacaattaccgcctcctgacacaaaatacatttcatgtatctgcatgagtgaattcaattggccttttattttctttcctgttatctatgacattcttctcttgcttattgtttttcttacctcattgtccatgccatattaggttgtaagctacatgaacatggggactttcctttttttttttccaacaaatattttttgttgtttgtttttttgaaacagagtttcactcttgttgcccaggctggagtgcaatggcacgatctcagctcaccgcaaccacaacctctgcctcctgggttcaagcaattctcctgcctcagcctcccgagtagctgggattacagacatgcgccaccacgcccagctaattttgtatttttagtagggacggggttactccacgttggttaggctggtctcgaactcccgacctcaggtaatccacccaccttggcctaccaaagtgctgggattacaggcgtgagccaccgcacccggcttcaacaacaaatatttaatgagcacctactctatgccaagctctaggcatctagaaattaacaaaagagaccaggtcttgtacttatgtagattacacttcagtagggtgagatagacaagaaacaagcaagtaaatactatcatatgaaagatggtgattaatgctctggagaaaaatcagaatgctgtagaatatgggatgatttggttagggctaaaaggatgacctgtctttaacaaggtaggcaagactataggaggagcaggttttgagaggaaattaagaatttgcaatatacttgttaatttaaaaatgccttctaggcatcccgtggagaggttaagtatgagtctggagttccatggagaaaataagctgacatataaatttgggattcacctgtgcacagccattgactggatgagatcacagagagaatggcctgagggatagaagggatcaagcccaagtcattgctcatcccaaattaaagatttgtaaaatgagaacgaaccttaaaagaggactaagaaagaatggtcagtgagactgggcacagtcgctcatgcctataatcctagcactttggaaggccctcaaggtggcaggatcgcttgagcccaggtgtttgagactggcctgggcagcatagcaagacctccctctctacaaagaacaaaaaaattagccaggtgaggcagcacacacctgtcatccaaggctgaggtgggaggattgcttgagcccggcaggtcaaggctgcagtaagctgtcattataccattgcactccagcctgggtgacagagtgaccctgtctcaaaaacaaacaaacaaacaaacaaacaaacaaaaaacaaaaaggtcagagagcactgaggagaatcaagaaacagttgtgaaagccaaatgaagaaagcagtttaaatgtgactgactgactgatggcctgtgttaaatcctggtgaaagatcaggtcgggtgagtttggagaaatgaccactgggtttggcaacctcaaggtcactgatgactttgacaagtgctgtcttggtgaaaaaaacatctcttttaagaacttttgctttgaggggaaacagggaattgaggtggtaggatcaagagaatttctcttaaaaaaattattgtaggctgggcatggcggctcatacctgtaatcctaggactttgggaggctgaggtgggcagatcacctgaggtcaggagttcgagactggcctgtccaacatggtgaaaccccgtctctactaaaaatacaaaaaaattacctgggcctggtggagggcgcttgtaatcccagctacttgggaggctgaggcaggagaattgcttgaacgtgggaggcagaggttgcagtgagccgcgattgtgccactccagcctggcaacaagagcaaaactcggtctcaaaaaaaaaaaaaaaaattattgtcctagaaaacactaataacgttggcctggtgtggtaaaccagcaatttgagaagccaaggcggggaattgcttgagcccaggagttcaagaccagcctgtgcaacatggggaaagcttgtctctacaaaagatacaaaaattagccaggcatgctggcacatgcctatagacccagctacgcaggaggctgaggtgggaggatcactcgagcccaggaagttgaggctgcagtgagccatgatcatgctactgcactccagccatagtgacagagtgagaccctctctcaataaataaataattttaaaaagaaaattcataatatacaatctatcctcttaaagtgttcatttagtacagtattattaactgtgagcacaagaaaaattttttttgatagaagaaatcacagcatatttgataaagtgaaagaaaattcatgttttgggaaggataaaattgctggaacaatgtcctagaggagataagaagggagggatggcgaggctgagcgattttcctaaggtcacatagccagtaagtgacaggtcaggattccaatccaggtcttctggctctctgttttttactgacattttgctataccgtaaaatgagaaaaatggcttgggcaacatgtaactttcctcctagttctaactttcatgtctctaacattttgatatgccttcacccatcccaagcatgtaaagaaaattccgaagtcaaacatagtagcagcagcagcagcagcagcacctatctgaacccacagttctcgtctaggtgctcacctatctcatctcaaccactctatgaattgcttagcagtcagcacttggactcatcaacgcctgagccctctgtgggaatcacaaactgtttctgatacctggcagctttactcatttatgttatctgtctggcttcctaaggtatttgagtttgcaatgcttgctcctaaaattaactaggcagtggtctaacaagaaaaggaaggaagggagggagggaaggaaggaatgaaggaaggagagaaggaaggaagacaggagaatacaaagaaaggaagtacaaatgaaggaaggaaggagaggagaagagaggagagggagagggagctataaagaaggtatttacttaatgagttggaaaatcttcaaaaacaatatgggtataggtactttagttgattgtattataagctattgtggtttctaaagtgattttatgttggccatggtcccaatccaacagaggcttttaatatgctatagaagctattattattctccgtatttaaatgatcttaacaccttataatcgtaatagttacttagagaagtaattaatttattctgtgtatataaacataatatgccttcataatattgtcccatcatcttcagtgaagtttacgttaatgctaggaaagccatttaatatgttcagtatactagaaggaaaaagcccatttctcagtggatagttctcaatactaaaacatttgacaagcaaatcaagactaccgcaaagactatctctgagagaatcagaattcttaaaacttaaaatctcaagatttggtctttttccccctaatatgactggaaaatcttatggttcttcccttaaattaacagcctgtgcttaaaagttctgagggaaacacttgcaaattactaggaaaatgttacagtcgtattttttttaacaaaaactaagaaataatttcctgttttatccaaaattgaaaagaagttaagcaccactggaaaagaaaaatacatttgcatctaaaacacaggtccctaatgagaagaaattcgcttggttgactcagtaagagctgtcttctgggactccacactattggcactgttttccagcattctatctgtgaacaagctgtgtacattccaagtatattaggcatattttatgttttcagtgccatgcttaaagagtaccttgttgtatgctgtctctctattacagcatgaactctggagtgtttactagattttttaaatgcttcagttgctaaatgagataaaagtctcagccaagaaccaaagaacttggacctcataggactttgctcctgtttattatcaaagtgatacatggctacattcatgtcattattccacaagatttgaggcctctggaatcaaggtgccatcttgctttcttcaccaggggactctgtcctctgggctctttctcatttcccaactctgtgtttctcctacatagatacccacttttcactctttccaacacaggtcttcccatgctgcttttttgttgttgaagattttagttttgaatagtgttttttttttttattagtatactggtgccatttacatgtatattacaatgggcaatttgggtggtacaatgttatgtcaatgtcgagaaggcacagcccagctacagtctggaacacagtgtaaacaattccatggggaaatgttgcttgggttttggaatgtttcttatgggtgttttaaaatgtcttttaaagaggctcaagcagctgcggtgaatataatcaggtcaccatttccttatgtttaagggtttggcggaggagaggccaagtgcgaggatgcagggaaaggaaataaatgtggaacaggcaggaaagaaacttacttgggcacaggaagccagagaccctggagaggaaataaaggaaaagcaggaaccacaaactaggctaagaaccacagtaaacacagtctgagagccaagtgttctcttatgacaccatccctgtttctgtgtttggttctctgtcctttcttcaagtaagggcgactgtgtccacctccggtggttcccaaatcaggctgtcacagaatcagatggaaagcttaagcaaacacagattcctgtgctctggatcacctagagaaaggaacctggaaattttcttttcttgttttccagctactcccaatgtaagccaacttggaaacaactaatttataacatcttaaaagctgaccaccttatcttagggagaggtcaaccccttggagaagagatggtttagaagggtgtttttaattgtataaaacacaactataagtcaatgcaaacaagaccatagactaacatatgccagtcttggatgtgcattccgaaagttgatggttaaaatagtctatgggggccggatgcggtggctcaggcctgtaatctcagcactttgggaggccgaagcttgcagatcacctgaggttgggagtttgagaccagcctgatcaacatggagaaacccggtctctactaagaatgcaaaattagctgggcatggtggtgtgtgcctataatcccagctacttgggaggctgagggaggagaattgcttgaatccaggaggtggaggttttggtgagccgagattgtgccattgcactccagcctggcagtaagtctatggatggatcatgcctgctacagaaaagccaatgatgcttaatccagagatgacctttttgccattaagtaagaaccagagatcagtgagaaatgtcttactttggaaatccgtaaacatacaaatcatccatatggatggtgtaaaaccactagttgagctagagtaagcaaatgatctttgtggattctaggaattaattgactaaatatcccatgtcctcctgcttacactcctaccaacatagtattggaggttgtctgatgctcaccccactatttttatggatttttatcttgaggcacaatgggttggggttagttctcctagactcttgttgttctgatttcctatttcttctgaattatttttttaaaattcttttttaatttttgtgggtacatagtaggtggcatgtaatgtataaataattacatcagagtaaattgggcatccatcacctccccagtatttttcttttgtgttacaaacaacccaattatagatttagttatttttaaatgtacaattaaattatttttgactgtggtcaccctgttgtcctagcaaatactaggtcttattcattctttctattttttggtatccattaatcatccctactcctctgcctccctgctacctttcccagcctctgataaccacccttctaccctctatcttcgtgagttcatcctctgaattcttacttgttacatccattttgcctcctatgcctggtcttcaccccacaccaactcacacataaaccccttccttccctttggtgtcccagttttcaaatgctgttatcagaagtatagggggttacaagaagtgtttacatcacaacataacactcaaacaactttaaaagtgtatattaaatattttcttttggccctctctgtgatctggaatttcttgtttactgactcctccccaccactctggtctttcatccaatttgagagattttgtaaacttctgaattccaaaaatgaattgcaggtgcaagtgtataaacattttctatctctagagttatcaccaaattatctttcagatttaccaatttattatcaatctgtatgcccatcaataaagtataatcacttgattttcatcattcccttgccaaaaatacatatttgtattttatatatttactcatattgtaggcaaaaaaaaattagtccaatattttacttgcacttttttaattatgaagagtttgagtatctcttcacaagttcaagggtcatttttacttatttatctgtaaactacgttttttttggtgttttttttttttttttttttttggagacagtctctcactctgtcaccctgctggagtgcagtggcacgatcatggctaactgtagccttgacctcctgggtccaagcaatcctcccatctcagcctcccaagcagctgggatcacaagcatgtcaccacaccccgctcattttttaattttttgtagagatggggtctcaccatgttgcccaggctggtctcaaatttctgggctcaagtcatcctcccaccttggcttcccaaagtgttgggattacaggtgtgagccaccacatccagcccaggtttgttttttctattaaggagttggtagttttcttcaattttcttattgatttgcaaaaactcttcacatatgaggagtagtaactcattgtcatatatgttgcaaatatttcccccagtttgtttcttctctgaaattttcagtggtgcatctgatcccatgaggatccccctgggcttgggattactgctagcttttcagtgaggtcacccactgtttggtgggaaagccccagggacatagagctatttgtttagtgtgagcgagtctttttgtttctgttgttgtttgcttttcctgctttttctttttctttctttctttttttttttttttttttttttttgagatgaagtctccctctgtcgcccaggctgaagtgtagtggcctgatctcagctcactacaacttctgcctccagggttcaagtgattctcctgcctcagcctcccaagtagctgggattacaggcacctgtcaccacacccagctaatttttgtatttttagtagagacggggttgcaccatgttggccaggctggtctcaaactactgacctcaggtgatccacccgcttcggcctcccaaagtgttgggattacaggcgtgccaccacacccggccttccctctttttcttacttttttttttttttaaattttcagccaacttttattttctgtaggacatatttagcacttgtgaattactcccagctgatactttttggtctttcgccttgctaggaggaggaaatagtaaattcccttttatgatgcactgtcttgcccccaccttctggttttcagatcagttctctgagacacttctaagtctatttttcagcttctactgttctctaagtttgggggcatgtgtctactgctagaccattattatttgctggatttagttcattttgctcagtttggggagagagggagaagagcttctctcaacctgtatctaggctaacttcctccccagaaagctgttctttactttgtgtgtttttctagaaagaacattctacttcttgggtcccctggctcaggggtgtagtttaaagtgggccagcagcatgggagaggcaaagtgagtaaaaatgtacacttaggccacagtgaaagaaatcttcatctcctctccccctaaaaaaatttccatggaagattttgtgcccttgatggtatagggcctgtgggaacatgtaacatttacacgttcgagttatatttctctcacataattaatagccatttattttattcaaatatgctcctaaaatacatctaggagagtaaatatgcttcttttattataaaatattctcagctctaataatcattattatgttaacacacgtatgatgtgatgaaccacaagcaggcagtgggtgataaagctaaccttgcccattgccagtgtttcccaaactttcatgtttttaagaatcatctgggagctgttaacgcagtttccttggccctgccccacacattctgattcaataaaggtggagcccaggaatctgcctttcttttttctttctctttttttttgatgcagtctctctctgtcgcccaggctggagtgcagtggtgcaatctcggctcactgcaatctctgccgcccgtgttcaagcgattctcctgcctcagcctcctgagtagctgggattacaggcttctgccaccacgtctggctaatttttgtaggtttttagttgagatggggtttcaccatcttggccaggctggtcttgaactcctgacctcgtgatccacccacctcggactcccaaagtgctgggattacaggcatgagctaccacaccctgccggaatctgcctttttaacaagcactatctgtggtctttagtactggcttcgaaaaattctggggcaagatatctcaacctcagcattactgacatttagggctcaataattctttgttggtggggcgctgtcctgtagatgccagtagcaacccccctaatcgtgacaataagaaatgtctctagacattgccaaaatgtcccctggggagttcaatcaccctcaattgggaaccactggcctaggagaaaataaatgagaaaatgttaattaaaaacagtgtttacttttgcatgcagccattcatactcttgcatggatttcattgaacaaattaaacaactatttctgagcatctggtatgtaccaagccttttatattaaaaatgtttaatcatggctacctctttaataatttggaaggtggaagaaaatgttcttataaattaatatctattaagcatatatttttcctaaattaatattcctaatagttttctgaagaatattctagaactttaaaattaatattaacaaagcattgacgttgttttagtaaagaagcaattcagaataaagttggtatgattgctttactttttttttttttttttttttgagacggagtttcgctcttgttgcccaggctggagtgcaatggcacgatctcggctcactgcaacctctgcctcccacgttcaaacaattctcctgtctcaccctcctgagtagctgggattgaaggcatgcgccaccacgcttggctaattttgtatttttagtagagacgaggtttctctatgttggtcaggctggtctcaaactcccgacctcagatgatccgcccacctcggcctcccaaagtgctgggattacaggcgtgagccacttcacccggccttgctttactgtttctaataatgaaactaattttgtttgtaaattttacacttattctaatttaggaaaatatgagaagggagtgatgaagtacctgccatgatattgtttataacatctcacatctgatgtaattctaaaattcttccttagagagtctatggtccatataaataaataagtgatatccaagcacactcattttaatgtgagtttttcacatgatattaaaatgttaaaaatagatcagtatgtagggcatccaagcatttaattccttaaatcggagacatgaggagaaaaaaatgaaaaggaagaaagaaaagaaggaaaaggaaggaaggaagaaaaagttgagtcaaggctgaagctctggcatctctaaccactggtcagtaaattctattgaaattcaatagtataagagacaaacaggcaaaaaggatcgtgaaaccatttccaaataccaagataaaggaggctattgacattcaggaaccctgagaacagctgatgtcccattgtagacttcatcctcttccttgggtgaaagtgtgaatagcgctcaaggcagggaagaagtcttttctctgaaggtgctatttatggtgcccttggcctggatgggctttctgggtagttcccaagggtatcatttctttgtattggaaatcagggacctttgtgggttaggaaagtagaatcaggccatggctattgtctttccctgctgtgtttcacatgtaaaattgactcccagaagagcatcccagggccttgtcaaggagtggggaaaatagcagactgccctagggtggaaacctaactgagagtgcaagggcgacttgcaaagctggggagagagaattactgggaaaatcgtgcctagggcaaagctgaattcaagaaatctgacttttgtgatcttcctctgctgagaatgaatgcggccacctacagcagagtaagaccacagcttgcttttgaaagtgttgctctctaggtggggtgtttgtttgtgtgtgcctgtcctctctcaggatttctagacggttcattttcaaagggtcattaacattatttaaatattcatggtggaggaggggatgagagactgaaatttcagacatctcaagagtgagggatggctggccacccgcctaatacagccccagtctgcggatcagctgcctccttcccctccgctggctttgttagcacacgcgctctgacaccgggccaccggctgccactacacggagggcagcaggaaggctctggcgagccagtgagctggaagcatctctgtccacacctcagcctctgaaccccatcgggggagtcctcaaacacgcggagacaccattactgccacaaagacgcacttcgcaaccagttccgggagtcgctctgaccctgaggacagtcgtggtgctaggtaagggacgaggggctgtttccccgcctgagtgggaactcagcggctcctggcatttgagcgcacacaggcactcacacacttccacatacgctcatgcgcacatatgtgtacaccaacacacacgtccacatgcacacacagcgacacgccaccccgctccaaagccccgtgcgctaacaagtatccatatacccagacacagcgctcccctgagttaggaaacactcagctttgcccgccccatccatccctccgtctttccctctctccagtctctgcattcattcatttcttcgtttgtgcatcgattccgccgaagccactgagaggagaaggtgtgggtagatggggaggggaggggagggaggggcggtccgtgggcgctgggctactggaggggaagcgaggaggcggggaaggggcgggccccaggagcaggcgggcggggctccccgccctccagcgcgcccggaggctaccactccctgcagatgcgctggccccagcccggggctgccgctcgccttcccccggagtctcctggacccccggagtctcctggacccccggagcgggaggcagcggccgcgcggcgctggactggagcagaaccccaggactgcgcccccgggagcgggcgcccagaggtgggtgtccaagctggggaggggaggggctggagtgtcctcgagtgtgaggaaggggtggccgaggaaggggttgccgaggaagggctggaaatctgggagtcctcggaagcaccgcgggcttttaaagggctttttgtggtccttgtcgagcggagcgtgtgctgggagagggcccgggtggaggggctgtggccatgtggatttgaattcctaggtttgtgggagggccaagcctttggctgctttgttcaatgcttatcatttatatatgctttaaaaactaaacgcaggactccgcttctccctgtatacacacagagctgggctgtgtgtccttttcaggaaaagcagtgaaatcaaatgtggtcgtggccgcatctcctgccccgggagcaccgggaggtgcagccgttccttctagctcgcgaggaaggcgcgggtcctgccttttgggtggcagagccgggggcattttcgcaagtcctgaacttttcagagagactgaagtcagggagggccgggccccggccccggtcccggccccagccagagtctttcgggatagggtccagggagctgaactcaggagatgatgcaggaggagccagcagcctcttctgccctgggagggagaacgcggtccgggtccgagctgagccagaagtttggcctgaggctgggacctcagcagttagaatgtggtatcttatccgagataaagccggagtttgcgtctctgtgggcccttcttggggacactctggggtatgggaagagcagaccgtgggggagagcactgggcaagccgtacctgtaatgtccgtggaggcgacgcgcctgcaagaaccagagcaaggagacactggtggccccaagaaatcccagagaaacggagtggataggaggggagtaaaacggagcccgggagagccggaagcccgcagcagggagctgtggcgctggtggccgggtgaggactgaaggcaaagggcgaggcggcgtgcagccgggctgccgagctctccaacgcggatgccaggcgctcgccagcctgagggatccctcctgacccacaaagagggcgtctgggaggtgactcgtttagagagatggtggattccctttccagacccaggaaagcccgtttcccgtgtggggtagcatgggtttggctctgataggctgcgtggtcagatcagactttgacatatcactacccttccccgtagcagttttaaatgcagcacaggtgatttgggaagacttcctaaatgtataatatttctttttgaaaagaaacttcacctactcatacgtctatacacctctctctgtattgcatcttggaatctgtgaacaagcccatgtctcccgggaagcgctcttctatcccaactcccgtttcacaggctcctggagactgcatgaatacaaactcctctcaccattgggatcccagggaatttgcttccttgtcttttgttctgattagagttcatttaagcatcacacttttctttctggaaatgttcttaatttaaatttaactaagcttccctttcttccagtctggcagcttccccaacattcatgaatacaatttcataataatatgtctagaaatgaggagtatccagcaaggagttttactctgtttctttaaacataaagacttggcctaaagagtgttttaagcaatgctccgctgccggttgtctcctccccagttttgacccttggccctttctctgtttttcttttcttttctttttttttcttttcttttctttcgaagttttgctcttgttgcccaggctggagtgcaatggcatgatcttggctcactacaacctctacctcatgggttcaagcaattctcctgcatcagcctcccgaatacctgggattacaggcacccaccaccacacccggctaatttttatatttttagtagagatggggttttgccatgttggccaggctggtcttgaactcctgaccttaggtgattcacctgcctcggcctcccaaagtgctgggattacaggcatgagccaccacacccggcctggccctttccttaaagggcatcttctcctttgagtggaggcacaccaagtttcctgcaattatcttggacagcaccaacaaaattagtcctgagccagggacaacaaaagtaaggctgcctgtctcccagtctttacttaaccaactctgctggagagttcatttcactttctttctgggatgctgagatgctaggatgagaggaatagctgggctttgagatgggacaaacattttgaaatactcattatctcatagttctggcatgacagttggcaccacttcctgcctgcagagtctgaagttatttcactttcataagtggcttattctgactcagtagcctcaggacctctggctaataaagtgaagtaggttgtcttaacttcgttgtcaaatgaagggagaatgaatccactggctttatttctgaaagtttgaatattttcttatagaactaacattaaatattacttccaaaaatgcaaacactttggtctttctagtcattgtaattattgtctagataattacaataatccaaacaataaccattacggatttggtgagctcttaaaatacccatgtcccagatttctgtcacggttattaccagtctctgcttattaaggtaatgagaaatgtttcaaatgaagatgaaattgaatttggatggaggttgtgttgagggattttaacagttgaaacaggagcatgctaaaaagttacttctgaagaccaaggatagactgtttagttccagtctttagctttatacatgactcaacgccagtagaattgatgctgtatcttgaatcagcttttggaatgattgttttttgatcttaagaaacatagtactcactgcttagattgttgatcagggattctgtgtcagctattggaagtttgaagtaattgattagtatcttgatgagcttcaacaatttcagtaagtttgggtagcaaattgcacccttttttttttttttgaaatggagtctttctctgttgcttgggctggaatgcagtggcgcgatctcggctcactgcaagctccgcttccccggttcacatcattctcctgcctcagcctcccaaatagctgagactacaggtgcccaccaccacgcccagctaattttttgtatttttagtagagacagggtttcaccatgttagctaggatgatctcgatctcctgacctcgtgatctgcccgcctcggcctcccaaaatgctgggattacaggcatgagccatcatgcccggcccaccattttctttatactgtgcaaactcaacacccagaggcagaatttctgtaaagctaaaaataaaggaacaacttcaacttcagtttctctcattggcatgagcctcacccagcagcacttcgggtagcttgggcctcagggaagaatgttaccatggaccatgatgggagttaaggtaatccatatacatgtatatcttactttgtaaaataatcccctctatgaacatgtaagactactgttcacaatttggacattttcctttcaaacacatttttcatgaatatattataggaaagttaaaaccatctctattctaaaaggaaaatctaccatttggctcagagagaaagttactgagtttgtctatgtgattttaagtagtatttgattagagtattaaagaaatggggtacttcaagtaacataacacctgatatttaaatctaagttttaaaaatgtatttcacccattgttaatgaaagtgtttctaagatgtaacccctggttagctattccgtcttcttgccttgatgggttgactggtggtgaatgtgctgttgtcattccattgacagttcgggattttgtggtggtctcagcatattagcatagatgtgagttgtaattttataggattatggaactgtaattgtggaactcctgcagggcagactctggaggctagctttttagaaaactgaaacctccagtataaacttaatttctgtcatttgccccattttcttgaaagttaagtgccagaaaagaaaaggatcgagtctctcttttctttctacaataaaacagaatatactttctccagggtttggtggtgggttcctttttcctgttgaggtggattctgagattgaggaggggctggagaagacagagcatgagggaaagagactgagaacatactcaggctgccctcgcctccttttccctttcgtgctcctgtctcccatctaggaggaccagggctaccagtccttgtggggacaagtttgagtaggatcaagagacatgtaactgcgccaggcgcggtggcttacacctgtaatcctggcactttgggaggctgaggcaggtgaatcacttgaggtcaggatttggagaccagcctggccaacatggtgaaaccctgcctctactaaaagaatacaaaaattagccaggtgtggtggcaggtgcctgtaatcccagctactcgagaggctgaggtaggagaattgattgagcctgggaggcagaggttgcagtgagccgagatggagccactgcactccagcctggtgacagagcaagaactctgtctcaaaaaaaaaaaaaaaaaaaaagaaaaaaagaaagaaagaaagaaaaagaaaaaaagagacatgtaacgggaatttgttcccatcttggtgacagtttcagagtgccccgcataggccgtgcaactggagaaggtgccctgtggaggcagaatgctgctgctggggtccttaaccaggcagaggttggatatgaagatgagatgatgtagcttcttttgagtaggtttgaggggttgggttttttgtttgttttttcttctaagccttggaaggatgcatgaactcgttgaagggggtgtgacatgaatgccagggaaggagagagacctgtggaacttactggggaaggccactatgctttgaacccttcttttttcttagatatgggcaggggctttgtggttgtttttgatgcctgattggagcagatggggtggcaaggccaaatacgcagatattgtggtgcgccctttatccagaaccagggcatggccaaagcaccctagtgcctcagccaagttctctgtgagatcttggtctgtcacataaacaaaatcttagttcattcatctataaaaatggagataccaggctgggcatggtggctcacgcctataatcccagcactttgggaggccgaggtgggtgaatcacctgaggtcgggagttcgagaccaacctgaccaacatggagaaacccggtctctactaaaaatataaaattagccgggtgtggtggcgcatgcctgtaatctcagctactcaggaggctgaggcaggaggatcgcttgaacccaggaggcagaggttgcggtgggccgacatggtgccattgcactccagcctgggcaacaagagtgaaactctgtttcaaaaaaaaaaaataccaaaacctacctgttcaaaacttgtgtaaaatcagatggttatggaagcaccttgtacatgtattcctcctaaagttggttgttcttaaattaaccaaagccttctttcatcttcattacagatgcaaatgataagtaaatagtttttaaattaattatttttattattattttttgaaacagggtctcactctgtcacccaggctggagtgcagttgtgtgatcatagctcactgcagtctcgaacttctgggctcaagtgatcctcttgtctcagcctcttgagtagctgggactacaggtgcatgccaccatgcctggctgtttttctattgtttgtagagacagggtctcactacatcgaccaagctggtcttgaacttcggggctcaagcagtcctcccacctcggcctcccaagcagttccacaattacattcccaaagtgctgggataacaggcatgagccgccatgtgctggcctaaagttaacacttaaaatgctagcaattgtgcagcagatcaattgttcatccttcacactgattaagtagctttgaacatggaaattctctaagcctgactgccccccgcccctacccgccagctgccattctcacccctgaagcacttgcactattgagaattcttctatttttcattagttgatccttctttaagctttgagtaattcaggaattggtcttcattgggacaatggaccgcaattttcagaaccataatcctagttttttagtttttttttttaaatttttatttatttatttatttattttttgagacagagttttgctcttgttgcccaggctggagtgcagtggcgcaatctcagctcacagcaacctccacctcctgggtttaagccattctcctgcctcagcctcctgagtagctgggattacaggcgtgtgccactgtgcccggctaatttttgtatttttagtagaggtgaggtttcacatgttgtccaggctggtctcaaattcctgacctcaggtgatctgcccaccttgggcaatcccaaaatgttgggattacaggcatgagccaccacgcctggggaaggggcctcttttggtgaaaaggcaagggcactactcctattcattagtgttctacgcttacgacctaatcacctcccagaggacccacctcctcattccattgtattgggaattagtcttcaaaatatgaattttagggagacacaaacattcagaccctagcagggaccctggaaaggattctcattgtgcagagtatggataaacagtgatgctagggcagtttttccagggttgtcagaaagggctgaactagaagtttccccactgtgcctggagtgccctgggttggttgagtgtagggtttcgaagataattttgtcaggactctttagtttttagtcttttatgagttagaagagtgtgcatatgtaactgccaccataccacagcaagttccagcaagagagaggattcctcaggtggccatcctatccaaactccatggctctttccagggcgtttgtgggaaacctgtggggctaggactgagctagactttttcagtagctgagactggtcctgcagacccatgaaaggtgccatgccgtcacccagtagggggcagggagggaccctcatttgcccctcttcccgcccaacagttgcctgacttcagccttaatgcatagctcatccagagtcctcctgagctcccacctggtgaggtgtgtgtagaaggtgtgaggaaggccaaaccacattttcctggcagtggttaactgaccgttttcagcccgcctcccagtgcagctgactgcgtcagcttacattaccgtgatgtcattcccatggtgggataatatagcatcttactttgtctggagtggtgcctcccataagttttttgataccgcctacaaatggagaaagacatcattgtttagccatttttatttgggtgggttggaggaatgactttcccaaaggaataaatcttagttaatattccagaaaattcaagtacttttcaaccctaattgaaaggcactctgtgtgcgtgaattaaaatcaaggtggagtccatgtgccatgtgctgtgtgattctaaagccatattttagcttggcctattagtattttgcatcagaacattttatacttgcaaaggttagcaagaattttcctcagacacattacagatgagcagaatttattcattttgggggaaaaaatgaacagactgtatttggaaacttagatcatatccaaagcacttgatgattcctgtttggaatcatttttccttcaaagaatagttcagatcagtgttaaatgcagggcagagatggactcaagagtgggaggcattgcttttgaatggaatcacaatgtgtatatcattttaagtattatttttatggtatgtttcattatcaaaaccatctatagcctccaaaggatgacaggtgttatagtgtgagtggcgtagagggtgttgagatagaggaatgaaaagagaagagatcgttccctttccactcaccattcatagaggaactaagttttaccttctagggaattccctgtaattcccagggacgccttgtccttgcggttcccaggcaggatggtaggaggagctaagtgggagggaattaatatttcttgagtgtcggctggtaagttggttgctttacctccacttttttagagacagggtctctccgtgtcacccagatggagtgcagtggtgtgatcatagcttactgcaaccttgaactcctacctacactattttacttaatctttatagtcaccagcatttttcaaatggagatactgagacatttggaagtcacataaccatccaggggtcccacagctacataatgtcaggtcagttttcctacccagctccttctctgttttttttttttttgtttttttgtttttttttttgcaacagagactcgctctgccatgctggagtgcagtggcgccatctcagctcactgcaacctctgcctccccggttcaagcgattttcctgcctcaacttcctgagtagctgtgtctacaggcgcgtgccaccacgcccggctaatttcttgtatttttagtagagacggggtttcactgtgttagccagggtggtctccatctcctgacctcatgatccgcctgcctcggcctcccaaagtgctgggattacaggtgtgagccaccacgcccagccctctccttttcttactaaaccagtgctgtaggggcttgctactccaagtgtggtctggggacctgcagcattcctgtcatccaggagcgtgttaaaactagagtatcctgagccccatcccagacctacttaatcagaatctgcattttagcaaaatccctaatgagtcctgagcatgttactgtgtgaggaagctctgcttagaggaggaaagtctgacaattacaactatgcatcctggccaagactcaggacttgaatccatggactggacccgaaacattggtctatctcagtgagggaggaagggtgctactagaatctgatgggtagagaccagggatgcagctaaacgctctataacacacaggacacccccttccaccaacaaagaattatcctgcacaaaatatcaatggtgccaatgttgaaaaaccctggtctaattgtctagatgtagaattcacatcctgtagatatgtttcgtagcctcagatgtatgcaaatctctaggaagtagatcttaaaggagttgatacaaattgcagtgtgctatgcaaatgggaatatttttattgggacttgaaaagagaaaaagagcttaaactgaagcatgaaagatttccattagagttttgagagtgtcagactctcaaacaataatatcagggatgcagtggaaaagtttctaagcatgtactgagtacccaccattgagggtgctacaaggcaacattccctcccattcccaatcctgcctggcaacagtgccttctgtttcttcattttattcctaagacttgccctggcctttgtcctacctttccgttctcaagcaggatatgctgggtcagttgtgccacctggaggctgggggaggaacgcaaataatgaataattggtaaagggaaccaaagcgctgtttctaccatcttttcctccctgcctgcgtggatccacacctcactgtttcttactcaactccttcaatgccacgacactgtagccacttccactggtggacacatatcctctctccctccttccttcccattctctttagatcctggcccagaacatctgaaaagatctgtcctccctcccctgtctctctccctttttttcttctctttcttccttttctgagctgaacagcaacctgtatcaatactgggaagtaaaatgagtatgcttattgtatactgatggaaagttttttggttttttttttttttttttttgagatggagtcttactctgttgccctgctggagtgcagtggtgcaatctcggctcactgcaacctccgccccctgggttcaagcgattctgctgcctcagcctccctagtagcagggattacaggcatgtgccaccacgcccacgtaatttttgtattttgggtagagacagggtttcaccatgtttgccaggctggtctcaaactcctgacctcaagtgatccgtctgcctcggcctcccaaagtgctgggattacaggtgtgagccaccgcgcccagccgatggaaaatgttttgaagtgaaattatatccaataaagagctcctgtcattcatccagttgtgagagtccctttgagagttgccagaaatgtctgctgtcttgtttttactcttaaattaacttgctctttctcgaagtacagaattctaaaacagagttggtgtttttgttgttgttctattatgtcctcctgctttctttagttgttggtactagaatagtcattttctactactttttcatggacattatccttgaaataggttattctagacaagttttggaacccaaactggatttaagaccaaggcattccaagaaaaataaaatctttttgcaatttctatgcatcatctttttataactttcattctcctttgcaaaggaaatgtggggctgtggatgtgaaaggaggtgggggcagtgaccggccagctgcagaacattcaagcctggcctttggactcagagactagggcagaagaagccagagtgctaggcttctggccagagtggaatgtgtcttcccaggagtgggaagcctgtgtttttccaccttaccatctgatctgctccagagggctctgcattagaaaaatagggagctatggggaatgactagggggtggagatcatgagagcagtgtctatggaggattatcagttatgctcagaaagggaagatttggcacctggtcatcgatttttagtacagtaattgtcttgagaaaagtatttgagaatcaatattagaaacaatttttaaaatatatcagtcttaaaggtacataaatgagaggaagaaaatcagagatcagggtgtctgcaagatggtctactaggctttttattattgtaatttgtgattgaatgccctctgtggggccaggtattttgtttttgtttttgtttttgtttttgtttttgttttagatgagtcttgctgtgttgcccaggctggaatgcaatggtgcgatttcggctcactgcaacctccgcctcctgtgtttaagcgattctgttggcttggcctcccaagtagctgagacaacaggtgcgcaccacaacatccggcaaatttttgtatttctaatattcaccatgttggccaggctggtctcgaactcctgacctcaagtgatctgcccaccttggcctcccaaagtgctgggatgggccaggtaattttattttagcctgacaactactctttggggtccttggatagtttttaattccattttgaagatggaaaagtgagatgaattggtcaaggtcaggcccacaggccctatttttttccccttgcattgttactgtgctgggtgacaactggtgctgagacagctgctgtctccatcactctcatgaggaaagagggtcaacaggtccaggagtttttgtttgtttgtttgttttagatggaatctcactctgttgcccaggctggagtgcagtggcgcgatctcggctcactgcaacctccgcctcctgggttcaagccattctcctgcctcagcctcccgagtagctgagactacaggtacatgccaccagggctagctaatttttgtatttttggtagagacgggatttcgccatgttggccaggatggtctccatctactgaccttgtgatccacccgcctcagcctcccaaagtgctgggattacagcaggagtttttactctaaatattaagttaagcttacaagttaagctacttgtaagctgtctgaaggtctatttccctgactttgcagttccttaattttgaaggcaatctctgcctgtatgtcttcttccttagagacctttgtcccgttaaggtaacctcctctcccagcccacaccttctaaagtaccttgtcacgtctcatgaactccacaagggtcctcttgggcatgataatgtgtgtcacctcttgcaagatccactaaaccctctttgccacaagttatgcttttcaaagtccgcctgaaaatatgctaacaagaatcattgtacaactgacttgcaaatacttgaacaaatacaaattaacaattactgcagctttatgaagaatgcatccaaaccaaggacagagtggaggaagacataatacaatgtatgggtacaatttaataaaaccttgaacctttaacatgggcccattttcatgcatgcattgtgatcaagttttgttcagaagggtgtaacttaactttgaaaaaaactatacatttttatgtgttttcagtgagtttaaccttccataagcacagatactctgttataaaagtgagtttaagctgcttcttgataatgaatgttgactgaaagtcaggccctatttccagtgtcatatgtggattgtcatatttaacccccgtaacaacctttgatagagataccattattttatatatatatataaaatatatatatttatttatatatatatgtgtgtgtgtacatatatatatgtgtacaacaggtacacaccaccacgcctggctaatttttgtatttttagtatagatggggtttcaccatgttggccaggctggtctcgaactcttgagctccagtaatctgcctgcctcggcctcccaaagtgctgggattataggcataagccaacatgccagacaaatattattataattttttgttacagatgaagaaacagacacaagggtttagggcaagggtacacagctagtggcaaagccaagcttggaatccctataggctagtggttagagacagtctcttaatcattcctgtttttactatgctgccttcttagtgcttaatacaaactaagcttgttgtctccttttactatggttgggggtataaatctcagtccataaacaaaggcttacaaaaaaatagcattaaaaaaattttattttaagttccaggatacatgtgcaggacctacaggtttgttacataggtaaacgtgtgccatggtgctttgctgcacctatcaacccatcacctacatattaagccctacatgcattagctagttatcctgatgctctccctccccaccccctccaagaggccccagtgtgtgttgttcccttccctgtgtccatgtatactcattgttcagctctcacttgtaagtgagaacatgtggtgtttggttttctgttgctgcattagtttgctgaggataatggctttgagctccattcatgtctctgcaaagtacatgatctcattcctttttatggctgcatagtattccatggtgtatatgtaccacataaaaaatagcattttaaaacttatgtaaattaattttatctccaagccttcaatctgtccaactataagaaaatgtaccccattatttttagacacacccaccctaggattacctgcaggacctaaggttttagaatgtgctaggttgtgggaagtggtccatccaacacctatctacaatggtttcaacagtgatttctagcacatgtgttatattagtttgctaaggctgccatagcaaagtaccacagcctgggtagtttaaacaacagaaatctattttctcatatagttgtaaaaggaagttaaattttgggaccccaaactcatttagccaaagggaaaagtcaagctgagaactgggtcacgcaaacctgcctcccctctttggttcctaaataagatggctacaagatgaaaaaatacctgccttccctatattttgcccacagggaaattcctggtgagctgttaaaacttcaccatggcaatgcaaattgatagtttatcttatacaggcgcagtcacccaggccctgccagactcaaaagcatatctgattgttcccctaccccattttgtctgtgctatcttatgtaaaatgcagattctccacattttttcctctgccccttttgtttatgtgaaaactgtgtgcttctcaatatcccaccttttctcctttaaatttggaatcctcaaaatcatctctggagaaaggcatacatctgtctcccaggcatgttcttaactttggcaaataaatctaaaatgattgagatttgtcttgtcattttcttccattgacagaggctagaagaccaagatccaggtgtttgcagggttggttgcttctgagggctgtgaggagaggttctgttctaggtcttggcttgtagatgggtgtcttctcccagtgtcttcacatggtctctcctctgtgtatgtatctgtgtccaaatttctatttttttttttttttttgagacagagtttcactcttgtcacccaggctggagtgcaatggcacgatctcagctcactgcaaactctgcctcccaggttcaagtgattctcctgcctcagcctcccaagtagctgggattacaggtgcccaccaccacgcccagctaatttttttttgtatttttagtagagacaaaatttcaccacgttggccaggctggtcttaaactcctgacctcaagtgatccacccacgttagcctcccaaactgctgggattacaggcgtgagccaccacgcttggctcaaatttcctcttctgtaagaacaccagtcatattagactcatccactctaaagacttcattttaatttaattacctctttaaagaccctgtatccaaataccatcacactcagaagtattgggggttagggcttcaacataggaagtggagcaagggttggggtaggggtgcacacagttcatcccatttgaggctctttaccagttcatgcaggcatgggacaggtcagggaaatccttggtaagtctgggaacctggagcccctcttctctgaagccttgccagttcccttaggagcttccacggaccaaagtgaaacacccaggggtggagggggtaaggagcttttctagaacaccttgcaaatcttgttgatggcttagatgtttacaaaactctagaaaaatcttatctccttgatatgagatcctggaagcaaggagttaaaagcctggctgcctacctaaggaggaggaggaaggagtggaagtaaacgaagacattgattatgatagaaaaaatgttaatagaaggcgatttttggaagccaaagagaaaattcagcttgaatcccctagtagtgtgtatgctcatcttcccaagacggaagtgcctctcctgtccgacctcctagcccagcctcggtctggaacacattgggtcctaggcacccagcagtgaattggctcagaaagtgtttgagggctcaagtgagtccaggaacgatggctcacgcctgtaatcccagaacattggaaggctgagatgcgaagattgcttgaagccaggagttcaagcctgtgtagttagtggtatgtcctcagcagaagccacaggactgtgatttgaagagaaggatatggggttgaactgcttcttactgccacggcagctctctggccccggaactggggcagttccttcattgtcccacctctgtcatcgcaggaatcccaagctgtcacacttctcagtattgtttcctttgcaatttgatgtggacttggcacatttccaaggtggaaacgacccctcattcattatttttgggacctcggtggccccgtgataagggaaatgatggatgcctggacttgtcttctggcattgcgcaccagatatcagggccctccacaggaccagcctatgagacaggaagaggctgaggtcttaaagacatactttcttgggagtttgatgtttcctcttgcttccacagctgtcagaaagggcttgttctgagggtgacctgcaggttgcaaggctgtggaaacatagcagtgacagcgttgaatggcttgtccccatcagtaagctttggtgtcacaccagccggatgactttctggtggagggccagcttcctgcacttccgtgacagcagcctgacagccccatggaggcatggctgtagacattaagacatttctgtagacatttgttctagttgttgtccttttttgtctgttatttattatttatttatttatcattatttatttagagacaaggtctcactctgtcaccaggctagagtgcagtggtgcaatcatggcttattacaaccttgatctcctgggcccaagcgatactcccacctcagcctcctgagaggctgggaccacaggtgtgcaccacaatgcctggctaatttttaaattttctgtagacagggtcacaccatgttgtccaggctggtctcaaactcctgagctccagcgatcctcccaccttggtgtcccagagtgtggggtcttaggtgtgagccatcgtgcctgccctgtttttcattttaattgtgtgacataaaatgtaaaatgtaccctctaaaccattttttagtgtccagttttgtggtattaagtacattcacattattgtgcaaccgtccccaccatccattcacagaactctttcaacttgcaaaactgaaactgtatgcattaagcaataactatcccttccttctttcctcttccccagctcttggcaaccaccattctactttctgtctctatgaagttgtctactctagtaacctcatataagtgaaatcacgtatttgtctttctgtgactggcttatttcacttagcataatgtcctcaatgtttatccatgttatagcatgtgtcacaatttccttcctttaaaaaaattgaataatgtcccattgtgtttatatgccacattttgtatatccattcattcattcgatacttgggttgcttccaccttttgtcttgcccttgtttttgagaggttaatccatctatgaggtcctccaggcatcaaaagagttccccagttccctactttggagaagttcactatccctagcaaagatgcaaagaacagatacatgaaaaagtaaatcatggtgcaaaagttgtatgagacaacactttaagatgtatcctatgagcgtaggtgtagatttgcaaaatggctggtgtggagtttctggaagaggatggcttagagagagtatggacttaaagcagagttaaggagcccaagctgaaatcctggctttgtgacttcctgtccttgtcactttgggtgaattattgaacctttgtaagctttagtttcctcatctgtaaaacgcagataatagtacttacctcatagagttgttgagaggattaagtgagtaaatgtaagtaaaagatgggcgtggtgattcatgcctgtaatcccagcactttgggaggctaaggcaggaggattacttgaacccagaagttctagaccagcctgggcagcatagtgagaccttgtctctaaaaacaatttaaaaacttagctggtcatggtggtgcacacctgtagtcctggctgcttgggaggctgaagtgggaagatcccttgagcccaggagttctaaggtggcagtgagctatgatcacaacactgcactctagcctggggaacagaccaagacattgtctcttaaaaaaaaaaaaaagtaggtaaagattgaaacaggctggcacacggttagaactcagtactaaaatataaaggagataacatattgcccactaacattttggctatttttaatatattgttcttgtctttttaatgaccacagatactctttagtatctgtttgctgcagtttttgcaggtattcatgatgcctgttatgcctttcctattttacctccttttcagattatgatagttttagcaaagaagtattcagttctagagactcattatcaaggaaagagagagctcttcatttggttttatcagataatagataataataaatatggcctggctttctttgcactgggaagatagagaatgaggaaggagaatgactattagtcattctaacgttagtctgttttatcgaactgaggagggagttagctttctccaactctgggcagattaccgagagtaggatgccaggttacattctcttgggagaacagtgctatcatggctgatctctcaattaaggacttcatatttagattatttaaatctcaaatattgaaatactctcatttttctaacaatgataattaagaaaactttgtaaagttacaaataaagtgaaattgaaaaggtttgctgaatgaagtattttactattgaaaggtcttctagaatgtaagtttcaaacacatcgtctggttggtgcattacttaatctattcctgtttggctgctgcttggtatttcccacgcaggagttcattgacttcaaggcaattgaatgcattattagccagaagaagaaaacatgtgagtctccttcacccaacaatagattttttaaaatacattgtgcacagtcctcttaaaaaaggcatcaatggcaggtgggtgtgaacagaggaatttcctcctccaccctggctgttgctgagctgtaagctgtaaacattgtgagagacaaaaagtatcaaggtctcaactttctttcggatattgctttgtatttctgtttactagtatgaatgaaaattttcctgaaaatgctggctaaaactgaattttggtgttgtctttctaatggaatttctgatcaacaatttcctttatgttggcaattgcttaatctgctgaagtaggtaaggtagttgtgctgccttaaaatttatttttatatttgtcattaaaaacaaacatgaaacttggaggttaattttgtctgtttaaattttgatgctttcattttgacaaaatcttttaagaataatgacgaggctgcagtgattgaaatacaatttgtgtggcttttaggcaagtgagcatttagcaagtaagaatttcccagattgggtttagagttgtatttgcttatgttccaaactctttttttttttttttttggtaagataattttgaatatcagtagaacttggggcagatagaatgacagaacatggaatgtgtaatccttttgggatttgtatcttagttaagtaaactttcatgatggattaaggaggacaaagtctccagcagatttcacttggctgattttgtttttctgttctttttctgttttcctgatgaggcttctgtacttctccctttaaggaggcaactgaatagcatgaaaataaggggtatgggtggtggtagttgctgaggggaatgacaatggatttggtaacacagcatgctaatatcatgcaaataatgagatgatataggaatctctgctctagtggtgggtctgaggtttgctctagtggtgggtctgaggttttctctactgagggcaaaattggagcttttttaaaaaaaaaaaaaaatttaatttttttttgagacagggtctccttctgttgcccaggctggagtgtagtggtgccatcacagctcactgcagcctccatctcccccaggctcaagcgatcctcccacctcagcctcccgagtagctgagaccacaggtgtgcgccaccatgcctggctaatttttaaattattttgtagagagagagtcttgccttgttgcccagactggtctcgaactcctggcctcaagtgatcctcctgccttggcctcccaaagtgttgggattataggcatgagctgccacacccagcctggaactttcttaaaagagaacttctttcttggtttgccacacctctgggttaacaaggtgccagagataattagcccttgattgggagaatgtgggactgttcactatggaaggatcttacagtatagaaatgaaaccctagtgtaggaagggagctgacatttttcagtgttaccttgacttaatttgcaaaatgttttattttctgaagccacagtgtaattcacagatgcaccaagatcaaaggtctctaagaagaagaggttgtggggaaagagcccagtagaggtagggaggccacaatgaacccattgagttattccacctgtcaaaaccttggttttgtaaactgcaaaataggaccagtaatacctatgattagctgctgctgttacgaattaagttcagtaacaagtccgacatggctggcgcatgctgttttcaataaatataaattctgctcccaaccattcaacatcaaatgagttgatctgcaaaaagtgttttgaaaactacagatactaattttcatttgtgtatgcctgttagttgacttcaaaacatttgtttgtcccaggaacagaagagaaatatcctttgatcatgagacaggttcatttttagtatgttaaggccactccatgtcattcttgtggcttgttaatgtggttaattgaaacccttccatattcttgatggggcagaaccttcagctgttttcatgttcatgttcaggggtgtaaatttctagacgatcttgtgggcctctgtcagctctgagattaaatgacgtgtgcatttgcttatcggattcttaactctaaaaccctgggatgaggactaggaaggagaaccaggaggcgctgagggaacaacagcttccacatggcccatctgctttgcagaacctgtgtctttggggtacaagtgagctggaggtggagctgcaacagagtgagtccccgtggtcagtcacatgcaccggcttccgcctggtatgatttatcagcagtgatgcaaacatgattcagagatagttttataagaatttttacttcggttaaatcataatcaggcggctatttccgtttttctaatgtcacttgattagctcaagatgcccaacccttattgtcctgactcatggagggaggctgcttgctaagtaatcgtgagacccaggagaggaagagggttggcggccatccccactggaggggcatcctggaaaactccagagagggaagcttgtgaccatgactcctagcagagcggtactgacaacctagtacaaaacccatagtggaaacactttcacctactctcatacattcatcttcccctgagaggaagcagagctgacattgtccagtcccattctgcactcaaagaaatgcagtctcagagaagctacgggaatggttcaaggtcacatgcttgcatatggcaaaattccaaatgcagacagaccactgaaattaggggagaggggagatcttctctttctactttaaactattttatattgtttgggtagtttccaaagaacaatgactattttaaaaagaattttaaaaagtaaatttaaaaactaaaaagttttagaaactaaattttaaaatctctgtttatttgtgattattcaaattttagaaaatgaaaaaagagcctcaccaattctttcagtcgatcctctcatttttacagaccagaggactgagaaaagtataagttggtcaattgtgataagctgggtattggcagaaaatctgttttaaaacttagtaggctcactgggatgattgaagctctgtgttctgcttaatacatgtttagctgcctgaactaactcagatgactccatgctgtaccatagagagaggagcctgacctttggctttgggatctatgcgaccccagtcagaacatggcacttttgatgtcttcatgacctttggcgtgctactcttcctctttgcatttctgtttttttcgtctgtaactgggaataatacccatccggcaagtttcgaattagaaattagaggccaggtgtggtagctcatgcctgtaatcccagcactttgggaggctgacgtgggtggatcacttgaagtcaggagttcaagaccagcctggccaacgtggtgaaaccccgcctctactaaaaacatacaaaaattagccagacatggtggtacgtgcctgtagtctcagctatgtgggaggctgaggcaggagaattgcttgaactcgagaggcggaggctgcagggagcccagatcatgccactgcactccagcctgggcaacagagcgagactctgtttcaaaaaaaaaaaaaagaattggtagaacccatctgaaattgccacttttataggtcaaatggtcgaatattagaaatttcatgtagttgaactcaacatttagagagtctgataggtactcagtaaatagttactattagagatgtaatagaggatacaaataaaattcttatggttgctttagcgaggtcccaaatgttattttcttctcccaaggaaatgactaacaggaatatagcttttcacttttttacattggtaaagatcttctctgactttggaaagcctgccacttactgagggccacctctactcatggctcccaggatgtagtctatcttattgacgtctttgacagttcataactcagttcactttctccctgtctatgcttggtcacttggatggatacatgtcctctgtaactcctccttctttcagttctctttcaatgaagatcaattatttttcatttaagaatcttcctgtgcaatgattgctctatgccctgatacatagaaaatgggcatattttccaattagcactaccattgtttcttgtgggtaaatttcggctaaaattatgtctataaaattcccttagacttaagtagtattattgagtgataggagcctgagggtgatttgggagatacttgtgttctgcccatcactgtgttattaactaaccttatatagtcttcgtaggacttgttcatatatgtacaaggtcagtaagatcattctaagtcaaacacttggctatctgtgattttctcaccattttgtgtttatagatagttcagacagtgagtgttagggaaacagtgaaaggtgagttagtagtagttcatattattaactcattttattggaatttccaatttttccttcccaaaatttttctctgaaccagtataaccctaaacctattggtaaaatatagaatcttaagcctattggtaaaatatagaatcttaactacattccaatataaagcaaactgttgatgtgggcaaaaatgagggggaggagagggagaaagaagtggaagagaaaatgagaaattctaagtcttcatcactttccacaggactcggccataacccaaactcaagctgcccactgttgcttgggatggcgggctctctctggaccagctctgtggctaagggtggcaaggggcccatcagaatggagcagtccctgatctatcagaggtctcaaaaaactgcctgctactaagcttggatctttccagaatcatgtggatgatagaatttgcctatagtgtcatgcatggaaaaggaagagaaactaaaggcagactttaaaggaattacttatctgtgccctctagcatctctgagaattgtgctaaggatttgttgcaaggatggcggtagatgaagaagccattggtttgagtgagatttggagttaggcgtagtaatccttgggtgctggagtagtgtcttgtttgagggagcagtgttcatagggcataaatgctatagaggtgtctgaaccacctggagccacaatctgtcctcatgatcttgcccttcaaatgcagccgcatgcccacataacccaccttggggagtagccaatactcaggctactctgtgggctggcattcttggtctcctgacttctgccccagctctaccttggttgataccccaaatgccccttttcctctggcctacctagcctgctttctccccttcttccttggttaactttgcacgtgaccattttgattctctaaagagaatcattcaattaggaaatggaaatctgaggcaatgagagagaggagacatgcatcactatttatttttagaaacttcacacaacaccaagcccaaactgttaagcattgccttaggagaggtttctaccattgtgcttgccaggtataagaaaagaaaattacaattgattctgtaatttcttttgtaataatcatcatagattccaaaacacagaatgagtctttagtgcgaagccctgaagcctctgtctgcaagtccattttaatgacagtttttgttctgagcaagaatgcgtcattgctggtcttgtgttttcagacaaacacaaagcttttaggaaataagaagcttaagtaaaaagactacaggttgttctctcctgggagttcctggacaccctctcaactgggacacttgaagtgagcctcatgacctgagctgagaattgccatggctgaaacagcttttatagggtgttttacatggacacttgacactctttggatcacattgtgtgtgatccagactcaagccagggttagcctagcttgttgttttatctcagttaaaagccttttgttaagagaacaaacaagaaagttcagataggtcaagaaagccagctctgaggatatatctagagggcaagtcatatttatttttcaaagtttccccaggaattaaaggttgcacatctaaatgtcaccacttctgtgacttttgcagataaacattagatttacctttggcaaactgcagtgtctacattatgggatttccctccccagagtcttttctctggggaagttctgaaaaattgtttcagggatactatagttcttaaatataactaacaaacatattatgaaatgctgttagtttttttctggaggctgaatattgattgctacttagtataccttttttaatgattatattgtcccaccaggatatttacacagcttcatgtgtcttcccacaaaatacacatgaattgcaaagggaatatagtaacttggcagtagagaaacttggcagataccaccctaatcaaataatcaaatctaacaccattagtaattggacaaattggcagtgtgcaccatttgatgagatgcacagaggaaaacacagcatcgcttctgtgatattcctgcacaaatgcatgagttagatctaatcatgaggaaatatcaggtaacctcaaattgcgggatgttcaacaaaataacttgtctataatctttagaagtcccaaattagctgggcatgatagctcacacctataatcctagctacttgggaagctgaagcgggaggatcccttgaggccaggagtttgaggccagtctaggcaatatggtgagagcccatctcaaataaataagtaagtaaaagtcatgaaagacaaggaaagactaagaaagtaccccaaattgaaggagactagagacatgagacatgggagcctagattggatcattttattagtaagaacatcattgggaccaagattgaaatttgcatgaggtctatggtttacatgtagaattccatcaatgttaattacaagattttgaggctggactgtggttaggtggaaaaagtccttgtttttcaaaaatgtaccttgaagtattaggaataacgaggcattatgtctgcaaaaagactccaatagttcacaaaaaaattataaacacacacacgcacatacacataccatgtagcattctaatttttagaaccagaaatgagcttttaaaaagtcaccataggctgggtgtggtggttcacgcccgtaatcccagcacattgggaggctgaggcaggtggatcacctgaggtcaagagttcgagaccagcctggccaacatggtgaaaccccgtctctactagaaatacaaaaactagctgggtgtggtggcgtgtgcctgtaatcccagctacttgggaggctgagacaggagaatctcttgaacccaggaggcagatgttgcagtgagccaagattgtgccactgcactccagcctgagcgacagagtgagactccatctcaagaaaaaaaagaaaaagaaaaagaaaaaaaaaagtcactgtaagagatgaattagaagaatgtgtcttgaatgcgggcacaatttatttttgttgtcaattgacaatcttgaaaaaattctggccgaatgtcggtgtgccagctgtttcatgcaccagacctgtagttcacccctactcttttacctgtagttcatccctactcttctaaggcttgaatggaaaataatttctaatttgttgtaaaatttaccaatttggtattgctgctgtaaacaggattttatctagggtttagatgccttatcttcaaattccactatcaagctagtacataaaattgtttgaaaactgaatcagatgtttatgtaattcataaaaacatataatttccctctaatatttcatttttcctaattataaaaataatgcatgcttattatagaaatgtagacataaaaaactataaaaagaagaaaagaaaactcaatccaaatcttaccactcagaaatgacgtgccactggtaacatttagacttatttcctcctaatatgtatattttaaactgccctcattctctttttttctttctttctttttttttaacctctatagtcgctcctgtaaaagctgcccctatgcttgtaacattattctacaatggacttttggatcctaatgtttttactcactttagcataagcattttcccatgtagcaaaatttcagatattttacctttttattttaaaataattttaaacttagaaaagagttgcaagagtagtacaaagaatttttgttttctcttcactaattgttaacatttctcatatttgacatgttatataatttatatatgtctatattatatacagatgcataatttttaatatttttttctgaaccttctaaaaataagttgcagatatcatgcccctttatattactttatatagtctcaaaagtgttaaaaaaattcaggaaatttgacattgatacaatactattacctaatataaacttggtttttcaaaatttgccagtttttgcaaagtgacctctagcatttttttaccccaacaccaggatccaatcctggatcacactttgtattttgatattgtctctttatcaccctctaatctgataaagctcatcagtcctttttctttgtctttcatgacattgacatttgtaaagaatatttttccttccatgtgaattagtctggtttctacacgtggtccttaatagctataaaatattccaccgaattttacctagataaatgctttatgttggtgatttgatggtttctagtgtttatcttcataaataaggctgcagtgaacatccttgtatttatgttttataaacatccctggttattttctctctgatagaatcctggaaataaaatactgggtaaactagcataggtatataggctcctgaggatatataggtatatcatatatattctacatatatatatatatatataggtatatatacctccaaaaggatgcttttcaaaaggatgaaactggcaagaataaaatctcactagttgccaaatgaaacttcatttttgaaacacaggagtataaaataaaaacttacagaatatatcctatgttattatttttcagttatctgtaatattttggtcagatgtgctttattaagtaaaaatatagggtcccaaatcatgcacacatgatgtttagatgcatatggaagaccagctagacaaggccacctccgagttttgtgtgttgagccactttttatgggttacttattcatttgaaattgatcctggcatctgtcaaggtaacattacagtatcactgcttggggctccctttcacttgcctgtatggatagagctttaatgtttatttcgtgggcaattcataacctgtagcacatgaaggaggctgtcacgcaatgtataccacccctgtggtaggcccaggaccggcgtttgtctcaaacaattccagtaggccttttattcagtgaagtggatagatttggtggataccactcagtgagtcagagttttggaatcaatgttctccatagctcatagcataagctctggagcctgacaatcctgggtgtgattctcagcttaactacttgctgtgtgacaacaagcaaatcccttaacctctctgagccttggttcctttatctgtaaaaggaagactgtagtcgtactcctctaatagggcgataccctattagatgtggatgaaatacaataacaaataggaagcctttagcatgttacttggcacattgcaagtacacattcagtgatagctttcataattactataatagtacattcatttcgaggttgtacattgacagtgagcaaaacactttaacatcttgtgacgtgggcaagttctcccatttgacagatgagaaaccttagacagaaagcgggttatatgaactaacaaagccatgtgtcaggtaaacggtgaggctgggcattaatctcacgtctctgactcatgggtcagcgggtcagggctctctcttcaggatatccagtgactgttccataactcgttacctggaagtccaatgctgtttgggcaaattttgaataaacccagtggttctcctacagatacatcttgatttagaataggcattagcaaatgttttctgcaaagggccagacagaaaatattgtaggtcttagccgagtgcagtggctcacgcctgtaatcccagcactttgggaggccgaggtggtcggatcacgaggtcaggagttcgagaccagcctgaccaacatggtgaaacgctgtctctactaaaaatacaaaaattagctgggcgtggtggtgtacgcctgtaatcctagctactcaggaggctgagacaggagaatcgcttgaacccaggaggcagaggtttcagtgagccgagatcgcgctactgcactccagcctgggtgacagagtgagactcagtctcaaaaaaaaaaaaaaagaaagaaagaaaatactgtaggccttgcaggccatatggtctctgttataactacatttctcaactttgctgctcaaacttgaaaacagccttagacaatatgtaaatgaataggcgtggctgtgttataataaaactatttactagaaccagcggcgaccagatttggcacatgggctgtctttatcaacccctgatttagacagggtgtattctggcagggggcacatgcatttcattatattagttacatgacaaccttcttttgagttcttagacatagtgaagaacactccagaaccttgagtctggcatgtagtaggtatttggtcactgtttgctgaatacaggaaagcttctctgtctatattttcctatggtgaatttttctgaatttatgtattcttatctatttttaaataactgttttattttagcacttatgaatttttaagttttgtttttgtttcacattgttctgaaaggacattaaaagcagatcgggaaaagagcatttagccccaaatgtaggtttaaacatattttcagatattcttagtgtttgtcgtgtatcagtttgttattttattttcattctcttgcactgagggtaatttccaataaaaactctggagaatttagacagcttttgttttaattaggaagctatttcacttgcactcttgtactactgttgactcaaataattaacagtaatggctgaataatttgttctttaaaagtaaacaacctccctttgtaatctagaaaagaatcagctggtgatacacatggagtgtttgctccaagaacatttctcatggtgtggaaaatggcagtggtggcctcctggctttcaggctgaaatacatttagctgatctttgtcggcaaaggtgtccaacaatagcaactgcttatgacaactaattttaggaaacgtgtgtagttaatttgaaatatcgccctgggccgttcaaccttggctgaataaggatgttttcttttaaaatcagtactttgcttccctcagtgattattccctattagcctgccaagaaatattatttcccttttgtatgatttgatgaagtacctcaaaaatctcctggttatggtcaacatttcatctgataggaagcgagtgtatctttctggtatacagtgaggcatgaggacacacagcttattttaatcttcaagctcgcctgtaatcctagcactttgggaggccgaggtgggtagatcacctgaggtcaggggattgagaccagcctggccaacgtggcgaaacctccactctactaaaaataaaaaaattagccaagcatggcggtgcatgcctgtaatcccagctactcgggaggctgaggcaggagaatcgcttgaactcaggaggcggatgttgcagtgagccgagatcgtgccactggactccagcctgggcgacagagtgagactccatctccaaaaagaaaaaaaaatcttcaagttgagatgttaggttaatcttcagtctccctgtgttttcccacaaggaatagtgtggaaaagacttggggaaaaaaaaatcatcatgattcagccaatgaccagggcagaggtataaatggagcatgattctatgtatctgtctagaaggcatatatggagcatgattctatgtatctgtctagaaggtatatatggagcatgattctatgtatctgtctttctgtacttgttgcctactgagaaaatacagatttttattagaaggttgctgggcacggtggctcacgcctgtaatctcaccactttgggaggccaaggcgtgcagaaaacctgaggtcaggagttcgagaccagcctggccaagctggtgaaacctcgtctctactgaaaatacaaaaatttgctgggcgtggtggcaggatcctgtaatccaagctacttgggagactgaggcaggagaatcacttgaaccggggaggtggaggttgcagtgagctgagattgcgccattgcacttcagcttgggtgacagagcgagactctgtctcaaaaaaaaaaaaaaaaaaaaaaaaaatagaagattaaggatccctatctgaaaaatcaactttgttctttctcttcatcagttttgtcagtgtacattcagcagctactacacgctaggcatagtgccaggcagccctggggatataaacatgtaatctatcaccgctgttaacctactggtgatttgaagactgcatcccaggagaccaatgatagtgatggaaattggtagggaaggttgctttaaggtctttagtatcttctatttgcctaagagaaagagaacttttgggagaagaaaccatacattttatctcttttcatctttatgccttatgttatcaggaaaatatttaataggagttgccaataaggttgataattctagaccatcaaaaccatagaggtgtgatgtcaggtgtaggaagagatgggaaacacgatgtaaaatgtctgcgtggctcacataggaaatctgtgcttagagtgctgtggcagaagtagaaattgctgtcagccaactgattttctgattcttctgtctataaaagctgtgcccattgttaacttaggtgataagttgaatttttagtttttttaggttttttgtttgtttgtttgtttttgaggtggagtctcactccgttgcccacgctggagtgcagtggtgcgatcttggctcaccacaacctccgcctcccgggttcaagcgattctcctgcctcagcctcccaagtagctgggattacaggcacccgccaccatgaccagctaatattttgtatttttagtagagatgaggtttcatcatgttggcaaggctggtctcaaactcccaacctcaggtgatccacccgccttgggcctcccaaagtgctgggattacagacgtgaggcactgcgcccagccaaatgttaaaagtatttttgagcttctcagaggaaaccaatgaactgaagttcaataatctgtggtttgtgttacaatattttgaatccttccggagactgaatgaaagatacatatttaaagtgaatgcagtaagtaggaagaggcactgcttcagcctggtaacatgcagttattgctttgagggtcttgcagaaagaatatgcacattgagtaagtaggagaaggtgtgtattttggaaaaatcaatcaacttagttcaacttgaaggttttcctatctgaaaagggatgtatcaaaagatattttttcttaggaggaaaaaatccacaactcgcaccagagcatttcattgagaattactgttatttacgttttggaatttacattgttaaaaagagagattttggaaaggcaggggtgggactagaattgtggcttgcatgttgcctataaacatagattcctttttttagatgtctgtgtttcttagtggattatgttcttaaaatagaacataccacattactctctggtttggcagggtgtggtgttttgtttactgcttgggtcaatgttctatgaacatgaatcttttcacagagaatcccagggctaaaagaattcttagaggtgagccagtcgaggccccagcacccgcttcccaaaggctcttcctgccagccaccaggcctcatgctccagtggcagtccagcccaagcgacaggaaactctcccttcttttaactggaatctcacatccagtggcttctctgcttgtgctgggtccctgctggggcttcccagaattctgtgcaactcctctttcctgtgagagccctcacgatgttagagatttggggtggggttctcatgctcactccaaagcccctacctctccaaaccttcctcaccatgctaaatagccccagttcccccatatgtgttcttatttgatagttaaagccctttgccactgatttcaaccttttaatgtgtgcagtcaagagagaaacctgtgttctggtctagaacatcacctatctggttctttggttcatacttttctgaatatatcccaaggtagtgcaagcagtggctttttgttttgttttgtttttttgagacagagtctcgctcttgttgcccaggctggagtgcagtggtgtgatcttggctcactgcaacctctgcctcctggatttaagcagattacagtagtgtgccaccacacccgactaattttgtatttttagtagacacagggtttcaccatgttggccaggctggtctcaaactcctgacctcaggtgatccacccacctcagcctcccaaagtgctgggatttacaggcttgagccactgcacccagccaagcagtggcgtcttaacataagagggtcaggctctaaaacaccgtaggaagtgaaatctgatatggtataaaaatcacccttgagatcacctataaaataaagtatataaaaacaaccagtagttttgtgtcagaaccctttgtaataattcttacgtacaataaagtttagaactgctgatctggcctaaagagtagaaataaggggaaaaatctcatctacaaaagacttctgcataaagatagtggattgaacacaggcatctacttgcgcccaccaccaaacaaaacatcatttaaatgatacaaagagaatttttggttttggttttgtggtaaaatgtatgcaacataaaactttaccattttaaccatgttaaggtatacagttcagtagtgttaagtactgaacatattgtgcaactgttgccaacatttttgtccagaactttttcattttcccaaactgaaactctgtacccattaaacaatgactctgtagggctgggcgtggtgactcacgcctgtaatcccagcacgttgggaggctgaggtgggcggatcacctgaggtcgggagttcgagatcaccctgaccaacatggagaaaccccgtctctactaaaaatacaaaattagccaggtgtggtggcgcgtgcctgtaatcccagctacttgggaggctgaggcaggagaatcacttgaacctgggaggcggaggttgtggtgagtcaagatcacgccattgcactccagcctgggcaacaagagtgaaacttggtctcaaaaaaagcaaaaaaacaaaaaacaaaaacaatgactttatattcctcacttcccccagcccctagcagccacccttctactttctgtctctacggtttggctactctaggtaccttgtatcagtggaatcatatagtatttgtccttctgtactaacttatttcacttaggggagttttttttaaaaaggcataagtctataaacacaagcataacagaaaacgaggcaacaacagcgtggtttttggcattaggatacaggggtgtgtgtggctaaaataaggaggcctagtctgttttaataatgttgaaacatttctgagcctttgcacttctttagatgaatcagttggttctcagccttccccattgacagcctaggatactgttttgtttttgtttttaagtctgcaaagttttttgttttttggtttggtttgttttttttcctacttatctgtctgctttctatcttgccaagttttgttgaaaaattccattggtagcaaagagaagatcctacctataagcttccagggggataaaatagatcacatacaaagagtcaagaataaaaatgggcttgacttcttaacaccaacactggcagctagaagacaatgggaacaaggcctttgatagcatggaagagcatgattttaaaactagaattgtatattccatcacactcttgtgagggtagaataatgcatttcacacataacaagttttcagaaagtaactggagaagatggtccactgagatgagggagtaaaccaggaaagaaaactaccagcggtagagcaaatgggatatccaacctgagagaggcagaggaaatttctagatgcctagggcgggaactcccagctgaccgctgtgctcctgaagcatgccagaggctcaggaagtgacttcctttgtaaggtggagttgatagaatatgtgaggcatcttggtgtcatgagaagagatttagagatatgatggaaaagtttaggcttgaattagcaagagctatataaaacactaagcaaaggtggggaaatactgttactaatgctgaaaacagtaagatgttcaggaaaggaaaactgaccatcattcaccatgtggcttagctgaaagtaatgttatgttattataatactgatcttcaaaagtttccatataattatattgggaagagtaccctcatatggtgagggcatagataggaaaaaccattaaattatcattctccatattgagaagttaataaataatgccaacaatggaaaaatcacaaagaagcaatgtaaattgttaccaaaaattacctaaaagaggttaaagtaccaaggatatccttggtaactatgggggggttggttccaggagcttcctcagatacccaaatctacagatggtccttaatatagaatggtgtagtatttgtgtataacctctgaagatctctagattacttatgatagctaatgccatgtaaatgctgtgtaaatagtttttatactgtattatttagggaatcatgataaaaaaaagtctgtgggtgttcactacacgtgctaccatactttgtttgtttgtttgtttttctttttttttttgagacggagtctcgctctgttgcccaggctggagtacagtggcacgatctcggctcactgcaacctccacctcccgggttcaagcgattctcctgcctcaacctcccgagtagctgggactacaggcatgtgccaccacgcccagctgatttttttttttgtatttttagtagagatgggatttcactgtgttagtcaggatggtcttgatctcctgaccttatgatctgcctgcctcggcctctcaaagtgctgggattacaggcgtgagccaccgcgcccggcctagatgcaaccatactttaaaaaatatattttccatcgtggttggttgagtctacagtgtgtaaccacagacgcagagggccaattgtacttactcttgggaggaaaaatcggagggaagcaggccgaagtggtgacccgtaggaattgttgttttctgtactattaggcgctttaaactatgtaactgtatgtctttaataaaaaatagtaattaaagttaaagagaatgtgtacaaaggaaagggaaaggtactggaggatatggtccagcaaggtgaaggggtaagttgaaaaagtataagaggtgggatacaggaaaccagggatatagaaactcaagaaaatataaagtctagcagtcaactaagcaagactggagcaggaagacccatggctgtgggacacaatggaacaggtggatttcttgatgtatggatgtagaaaatactactgtgatgtttcaccgatctggaactttgggccgagttagcaatatgtaagtagaaaactaagtaattgaggaatatagttaacttcagaggaaaaaacctcagaaaattagacaagaaaacatagtatactctgtaagtcttcagtgcacaaaatttatatgaacctaataataaacactgaataataaatttgtgaagtaaataaaaatattgggaggacaagttgagggggatgccaatggataatgcctaaaactgataaatagaaagcaagatagcctaaacatcatatttagaaaagtgtggcaagtaccaaaaagaaataactacagcccatgcgaagtggctcacacctgtaatcctagcactttgggaggccgaggcgggcggatcacctgaggtcaggagtttgaggccagactggccaaaatgttgaaaccccatctctactaaaaatacaaaaattacctgggcatggtggtgtgtgcctgtaatcctggctactcgggaggttgaggcaggagaatcgcttgaacccgggaggcagtggttgcagtgagctgagattgcactactgcactccacctgggcaataagagtgagactccatctcaaaaaaaaaaaaaaaaagaaataactacaaagagttgcaagtggtataagactgagaagtgggagggtgtggggcacttgtttgacaatttaactcttaaactctgtttgatttttaaaaactatgtgcttgctatttgcattttaatctaatgaaggtaaaaatggattaaaatataaaaaagaaaagccatctatatgcagatgtctgggcagtataaaaggtctgagagatgtgcttaatactatgattattaaagaagttaatgtctatgagagcacccagcacatagtaggcactaaataaatgtttgctggatttgaatctaaagcatgcttgatcagacctacatagaggcaattccttgaaaagctgcagagaatgacttgtaccatttgctgactttccaagatggcatttcttgctggggctccactgattattactgttgtacctgtgggcattgggctcatgaccccataggtgcgtgtgtgtacatgcacatgcattaagttgcaaagtcagtctaaatgacttgactatcaacctgtctttggcagccatatcacttttggcccagttggcaccatcaggtttctggacacagaggcagtattttccatccctgtcctacagagtgtatttgtctcaagtgttatgtacttttccagtttctttgcccccagtaaatctctagggtcatgaagatcattacaaaacagatagtcatttcatctctcttcttaaagcctctcacccattgccctaggaagaagaccccaaatccttggcattcaaagcctaggtggtcaatgatttgaccccctacccattgctctggctttatttcttgccactccagacttcactgtttacactcaagtaaaaccaaagtaattgcaattctctgtaaacactacgccattccatacctcaggtgactttgctcttgctatccttcctgcctggactaactatctcacatctccctgtcacacccaactcccaattctctccaccatgctggtccttctctctaacatggctaactctaccccactttaagactcagctttatcagcccttgctatgagaagcctttgttgatcaccccaggaggagaaaggtgtccccttttgtgctctccatcaagagcatcacagaactaatgcatcatcttaatactattaatgtgtctgatgtgtcggagaggccccaaaggtttgaggaccatgtttgtcttgatcactgcacagtacctgacccagctcattcccagtagggctgggactaatcttgcaggtcttcacagttgcaatcatttgttcagaggtggctcttccccagtctattacagaagcctcatgtctattcttggagagtcccaagaccatggcctctaaggttccagccttatcgtggtttggaggctccttcagttccttgtcatttgaatgcagaactggatgctgtgaatgagttctagaacatggttccatggggcagagttctgactttaaaaaagccatttactaaccaagctgcatggatttctcttttcccatttcatcaaggaagcaccccggctaggtgagctggttcatttcattcattgactcaacaaatatttactaagtgtctgccataggccagttactgttctaggcatgtaggagacagtagtgaggaagatggatgaggtttctgtcctcagggacctgagatcgtagaggagggaagcaaacacagagccatttggagtggtaataagtgctgagaagggaagaaagggaatgtgggatgagggggctgcttagatgtgctgatcaagggaggaggtctctgagacaacagcatttgtattgtatggttctgaattgcaaaaaagagctgttcaaattgttatcagtggagggtgtccaggttcttggcatcttgaacaaagaattggacaaaatgcacaaacaaaggaaggaaagaatgaagcaacaaaagcagagatttattgaaaatgaaagcacacaccacaaggtgtgccttcacaagcagcaagcagctcaagggactggttacagaattgtctggggtttaaataccctttagagatttcccattggttacttggtgtatgccctatgtaatgaagtagtggctcatgattagtctgattggttgcaggaggggaccaatcagaggctgaagttacaaagctacaccctatgcaaacatctgattgtggaaagcaaccaatcagaggctgcagtgaagttacaaagttatacttctatgcaaatgaagatttggcccaaggccaacctgattggttgtgggaagggagcaatcagacataatttcaatttttcatctgccacacaagaaaagggtgggggatttgcaaagggagtagttctggtccttttgttactttggtgtggaaagttgaggttttccttttgattcagttctaggtagtcagcgtgaattggctttaggttccctgcctctagaccctattctcctgcctcaaaataaagagctatatagctgcactctccagccactggccacaagtagctattaaagtttgcatttacgtgttttttttttttttttttttttttttttttttctgagacagagtgtcactctgtcgcccaggctggagtgcagtgatgcgatctcagttcactgcaacctccgcctcccgggttcaagaaattctcctgtctcagcctcccaagtagctgggaatacagcttcaagccaccacgcccagctaatttttgtatttttagtagagctagggtttcaccttattgatcaggctggtctggaactcctgacctcaggtgatccacctgcgttggcctcccaaagtgctggcatttcaggcatgagccaccgcgccggcctacagtttgcatttaagttaactaaatacaatttaaaaaatcagatcctcagtcacactggccacatttcaagtagtcagtaaccagcctatggctaggagcaccataatgggcagtgcagagcaatagggagaaagggcactggggaggcggatgggagaagcagtaagaaagggaaactagatcacttgttggagagcacatgtatgcatttcaaagaactgcctcctttaatttcacttgttgaaaatggggctgaagccaagactagttatgtctgatagaatgttttaaagtggaattaaaatgatctctagagataatataaagcaggtaaaaaccagccatgaaaagatctttattaaggaatatggcatggctacagcaagtcctgagatggagataagtactagttgattccaggggccagtggatgaggtcacagttaccccttggccttagaaggaggaagccagacatcctaactctgacaccaggagcatactttacctaaaatcttaaagacaggacaatgtttaaaaaaatcccttcttaacacaattcttaacaaaaataggattttgacttttgtgtcttaggaggctagaattgtattctcatgccattaccaggaacggctgtgccttgacttcattttgtatcgtgtttcacaagatgctcatccctttttgcacctgcctctttgctaaacaggttttcttcctctctgtaaaggtgcctttgtttgaaccaatagtgttacttctctttactgtaaacagtgtccagtgactcttccttatcgtggagagccagcagccttttacaggaggagaaaagtcttgaaggtcactttctgatgtttacattataagtcatcatgactttaaaagatgaaaactaaaacaacaacaacaaaaaaccacaactgcctactgcttacccagggcatgttatcctattacatttgaattcaagtaacagctagtatttgtcaaatcataattgatctgataaaatgtaatctgatcattagtagctgtgtaaacgtaaatacactcgactcctgtttcatttgcccttgaaggctgtaacatggttccaaagtgtacctttgaaccggagaagtcgggccggttcacattgcagcctgtgtgcttcctggggcagcgtccaccaggtgtgtgcgggcaggtacaggatgcgagctcagtcctgcttcccctgaaatcctgtgacctggcagagggctgtgttcctgtgtccttacatcggatgtcctactgaagaaagggaaactgggacgaagctgtaggcacagtgggttctgaagatcagatataactgagggaaagttaggtcatgattgccacctggatgctgttctctctcttcacggtaggtctcagttacttttactgtggacttttgcttgctgcagagggaacttacacctttcatgcctcaagctcattaaggcacatttctcttttattcttcagggacattgcatttatgaactcaaggcattgagtcacccagagagaaaaagcatatcccaaacatttcagtttctgggagttctaaaaagctaatgttgtgttcccatggccaacatttctttaagagaggtaaagcagaataactctaggtctataaaaatgctgatctgcttcaagttctaaatttattgtgaattatttatttttccctagtaattactgtaataccttagtaccttcaacttatatagcatttttcaaggaggcaaagcatcagtagaaatgttctctgggatttttttacctgatgttttaatgctgtgatgatttctcagccccttagtaataatgttagatgcactgtggaaaaactaggcacgtagctgttaagctgggaatgtatgaacggtatacatgctatgctttaaaatctagctcaatttttttttttttgcattgaccttgaacatgctgacaacataggtcggcatgggtaaagctaaagaatggccttagggtttgaaaacaactacatgagctctgtttcagacctgctgctagtcgggcacttggcactttgcagggatttggggcaggttttatgtttgtgtgcttctcttagaagtcaaagagttggtgaggtaactgcaatcctgtctatatcagtgtagtgataatgcagtagtgtaatgaagaatggagctgcacgtgtgaggtttttcaagtccacaaagatcaggtattgtctacggtcaataaagatttttttaaaaaaccctcttaactaaagagaggtaacttccttttcaaaactctgaaatttacatgtgctgacttataatgtgtgtgatcctcgttgcttttctgatccttggtggttggggtgtgtgtgtgtgtgtgtgtctgtgtgatgggctttttaatctttgagatttattctttttttttttttttttttttgagacagagtcttgctctgtcgcccaggctggggtgcagtagcacgatctccgctcactgcaatctctacctcccgggttcatgccattctcctgcctcagcctcccgagtagctgggactataggcgcctgcctccacacccggctaattttttgtatttttagtagagatggggtttcaccgtgttagccaggatggtcttgatctcctgacctcatgatctgcccgccttggcctcccaaagtgccgggattacaggtgtgagccaccgcgcccagccaagatttatttattttttacttacacatagtgaaattcattctttttgctgtacatctctatgagtttagataaatgcttacagttgaggaaacatcaccacaatcaagataaagaacagttccatgatcccctaaatatattttgcttcaaatttctattggcatgtttgagtatcaagtttactaccacttctgaagatggagccaagcccttttgtaacaaatagcacagctgtgtctgacacttttcatgtgaaaggttgcctgagatgtcagaagtaagatctggccagttgcagtggctcatacctgtaatctcagcactttgtgaagccgaggcgggaggaccacctgaggtcaggagttcaagatcagcctggccaacatagtgaaactccgtatctactaaaaatacaaaaattagccaggtgtggtggtgcattcctgtagtcccagctacttgggaggctgaggcaggagaattacatgaacccgggaggtggaggctgtagtgagctgagattgtgccaccgcattccagtctgagtgacagagtgagactccgcctcaaaaaaaaagaagtaagatctgattgacttatccttttctcaaagttataaatgggaaaattgtacaatctgaatattgtttccttgtattttaattaatgaatgtagaactgtgtaatgtattatatgcttttttaaacccaaagaaatttgtaataaatactttagttagtaaaaagaatatactgaaagtgaaaaaagtcaattttttgcactttagatttttttttaagtgagcttagttctgtgtggttttaagggcagtgaaatgctgtagaaggactgtaatctgcataactcaaactggcttaataagtggaatttattggctaatatcactgaaaggtaaaggtacagggatagacttgaggcattgtgggatctagaaattcaaacgatgttatccgcctctctttccccactcagctgtgtttccctctgtgttggttctattctctagtagactcttgcttgctgtatcaaggtgactgacagcagcttccggcttttattctactttctcaattccgtacagttccaacaagtctcagaatggggtctcatgggctctgattgcttctcctgctccttatgacccccagggatggggtgggggtgagcggcagtgctctgattggtcagacttaggtcacctgctcactcctagagctgaaggagtgagagctccccctagaccacggtgcagaatgaaggtagagagtggcagaagaggtggttctttaagggaaattgagggacatgtatgtcagatcaagaaaacacatgtcctctgcagggacgttcaggccatgtagccagttgttgtctttgtttttaaataatttttataaacacctaccctaggctaaccttccaaataagcaaaagtttcagaattgatagttgattgattgattgttttatggcttatgagatgacaactgtttactggatgtgagatgtaatattttgggaggaaaatagtggaaattgagtgactgcgggactcggctaagatgggtagatggggcatgaggagaactggtcctgtgtctgtcaagggatcaatgagtaaggaaaaatgggcttcaaggacaaaaagccaggagaaaagaaaaagaagataccagagattggcaattgaccaaaaatttagcaagattaccattgctgaaatagcagaaatattgtcttggatagaaatgctatcagggacatttaatgagaatttatgaagattcaaggctggcatagctactctaatcatgtgaagagtgattgcatctagaataaagcccagattcccaaacctgacatttgtgatctggggcccatctccctctccaggctcatctcccctgctgctgccttgcaccttacaacgagctgtttgtagtctggaaggcatcacactaccctgtttccttcactattcatgctctctcctctgcctggaatccctctcccgttgaccagactcatcttttaagactcagttcagatgacagtttctctgagaagcattctttgattatgcctctctggcttaagaattcctcttctatactctcgtgataccttgtgcgtctttcccagtggtctcaactgagggctgttttgtctccaaggggacatttggcaatgttgggatacatttttgattgtcatgacaggtgagcgctactagttggtggaagccagggatgctgcttaatatccttcatacagcacacaggacagccccaacaaagaggcacctggccccaaatgtcaatagcaccgctgttgagaaccctgcttaccattgcactggcaacattgttggatacatctgtttttagtcttatcttcaccactaggctgaggcccatgtgtgtgatctgcatctttgtatgtctaataccacaatgcaccactgtagggtagttcctcaggagagaatagtttaaagatgattgtatacattttcttaggatagtgaccaatgaacaaggcaactggaggccgtactcgtctttgcgctaggtagccttaaacttgaggctctctgtattagttagttctcacattgctatgaagaaatacctgaaactgggtaatttataaagacaagaggtttaactggctcatgattccacaggctgtataggaggcatggttctggtatccgctcagcttctggggaggtctcaggaaacttacaaacatgatggaaggcaaagggggagtgagcacttcatatagccagggcaggaagaaagggagtggggaggtgctacatacttttaaacaacaagatcttgtgagaactctattatcggaatagcaccacggggcgggggggcgggtaatctgcccccatgatccaatcacttctcaccaggccccacctccaacattggggattacaattcgacatgagatttgggtggagacacagatccaaaccatatcactcctttatcttgccatgcctttgtcttctcactcttctgcaaaaagagctttggggtttactgtagcaaataatggaaaacattaaagaagtattgttagcatagttcttttgctttcaatttttacctaagttattgtccaattttacattctgaatggtgaactgggtggcctggccacactatttggctgcctctggcaaaaacttctgccctcacttctgaccattacattttccccctaccgtatgtgtagtactctggattggtaacgtttgatgggaaagaaaacaaaatcagaaagcaacgattctgagagcaggaataaggaatgttaagtcccctttttgacggctgggctttttttcttatgccaagtttaagtgcaaagcagcagttcccttgtgccctgggacttttgcctaggaacaagggactgccagaaaacctcagaaaatccccatggagatgtctctgaaaaccatgtaaacagggacattgtctaagtgggtcatcctgaatatatgatgcaggatggaaacctatttagttattgaatatttcagattaagaggacaccgcagccttgctttgcacaatcttgctagctttgtgagtttcactggggattggaggggaggcccgccttcaacttgagctgcttgtgttttggttggtggtaatgccttagaaacagaaaggagccagctccccttcagccactcaggcttctgcctgggtttccttttaaccctggaatttcatgtggaccctcagctatgaaaacagatcacatatggcctgctgtcaagcataagaattgcctttttgttcttggggaattgcacaaagcaagtaggagacggggaagaagaccgttctaagcaggaaaatatattgcattaattcttcccttccattgcctcctccccatcttgtgctatattctggtactaggacttttgcttttttctaggctgaatcacatttggccatagcagaggaaaagtgatagctgttaggggtcttggaaggagtattgagttcctagagtgggaccatcttggccaggccgcttcttgtcctcttttggggctgggactggtatgatgttgaagtagcccatctctaagtcttcccctcctccctgccagcttaattgtgcaacattgttcaatcaagtcactgaatcatcagccctgtgatatctacaagcgcatgcatgtgtctgagtgaagtgagctgggcagttccatgatacccttttctatgtatggagggtgaggtgtttctccttggtttaccctgaccaatttattattactgttccaaaaaggaaactgcatgattaatgtcagaatcaggtccaaaggcctctggctctggtgatggctaatgtgatttggatctagattctgtttaataacctgccaaaggcacctagctctttctctttttttgctgttttttgtttgttttgatttttgtctttataagacagggtcttgctctgttgcccaggttggagtacagtagcaggttcatatgtcactgtagcttcaacctcctgggctcaagcgatccttccatctcagcctcccaagtagctgggactacaggaatgcaccattatgcctgaatttatttatttatttatttattaagatgggggtcttcccatgtttcccaggctggtcttaaactcctaggctcaagtgatcttcccacctcagcctcccaaaatgttgggatgacaggcatgagccatcacgcctggccttggctctttcttctgtccccttggtggggacgttggggtgacccatatgtggtacatggcaggtaatgttcttttcatactagccagtcttctgttgtgattccactgtgtgtaagatgtgtccaaaatgaggagatgcatccccgcacctagaggtgtacagtctagtggtctttctgctcttcctgcttttttctgggaaagagactttttgtggggggttgggggggggtgagtccaggacagcaagttcatcataaatgcaaatgggaaggctattgatatttttattcatagcatgaatgatgtaataaatgagtcacgatgtcagcctcttttaacagaatcacagaattttctttttatttatttatttatttatttatttatttattattttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaccagcatgctgccttcaagcgtctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacatggcaaccatccgatttctcaatcttttccccacctttcccccctttctattccacaaaactgccattgtcatcatggcccgttctcaatgagctgttgggtacacctcccagacggggtggtggccgggcagagacgctcctcacatcccggacggggcgacagggcagaggcgctccccacatctcaggcgatgggtggccgggcagagacgctcctcacttcctagatgggatggcggccgggaagaggcgctcctcacttcctagatgggatggcggctgggcagagatgctcctcactttccagactgggcagccaggcagaggggctcctcacatcccagacgatgggcggccaggcagagacgctcctcacttcccagacggggtggcggccgggcagaggctgcaatctcggcactttgggaggccaaggcaggctgctgggaggtggatgttgtagcgagctgagatcatgccactgcactccagcctgggcaccattgagcactgagtgaaggagactccgtctgcaatcccggcacctcgggaggccaaggctggcggatcactcgtggtaaggagctggagaccagcccggccaacacagcgaaaccccgtctccacccaaaaaatacgaaaaccagtcaggcgtggcggcgcgtgcctgcaatcgcaggcactcggcaggctgaggcaggagaatcaggcagggaggttgcagtgagccgagatggcagcagtacagtccagcttcggctcggcatcagagggagacagtggaaagaggggagaggggagaggggagagggaatcacagaattttcaaactggtttagcatgctggctctgcagccagactgcctgagctcaaatgtcagttgacttttctgtaaaatgggataataatagtaccagtttcatagatttgcaggagatgtgagattacatgaattcacttataaaaagtgcgtgatacttaaagccatgttacctttaaacttccaatccattcattcatttattcaacaaaaactacatactgtgatggttgcacaagcctgtgaaaatactgaaaactaatgtattgtatactttaaaagggtgaattcaatggtatgtaaattaagtatatctcaatgaagctgttttaaaaaaattaattgattacctattatgtgctggacacagctcttttaaactgaggcctagagcaggtgacttgctcaaggtgagtgaatggcagagatagttctagaactcaagtcctctgacacatcagccaagctctttgcaaactgtcagggatccaaatgaagatcgcaatccagattggaaactaaagtcactttctgtcctggtatagaaccaaagtttaacttaagaaagaatcgtgacgtgacctaaggaccttggcattctacttcaccacctctctctgcaggtattctcatttccacgcacctccacattttcgaagacttcagacaaatatatcacaaataacctatataaattcactatatgaaaagcaggccaacatttccaccccatccttcctctttcccccagctctggatataaaacacatatttttcagttagattttttcagttaagtgattactttcaattcccctgtttttggcatttaaaaatgttcacttcttattgcaagacagggacagtctttaaagatttttctgctcaccaccactaccaaaaactaataacaaattttgtcttcatggggaagaaaatcttactcattcttgagatttcacagccatgtctaaagatctaggctatataagaagagaggaatgccttagaaatgtaatgctgtttttcctacggaatcaatttctgtagaaatagaaaccatggtgcatccagagttaccctgcagccttctgctcctggcagcttgctgtgtgttctctgccacatgctttcttctgggatttcttccttctactgacatctggtacttaggataagggaaaaggctttccctgaaccagtgaaattgctatcaggaaaaaatgactcaagtttccaggcagctatgaatgaggtgtttttctgggcggtctgagcaactatcttttggaaggatacataagaaggtacaagctgccagcccatccatttccctaagatgaacttgaagcacgttttctttcagcagcccagacagcacaggcttttcctagcagatgggtggcattacctcactgacatttaatgaataggttgcccccagggggtggaattgtagcaaagtctattatgaaatctcatttgctttgcatgaatcagtttaggagtcccgagaaaacaaaatttgaaaaatgaaaagtggccacatagcttgccctgtaactgcttggacatggcaggtaataatcatagtcagtttgcgcttttatgatggagagggctttcaattgatttgtatttcttgtgagtaggaacaaagccagttgtaagtaccttttagctttgttccctcctttctcattttctaggactgtagcatctggggcatataattgagctctgagagccgagagctggagggggagggggtggtcagaggaaaattattcaattcacacatataacatgcatatatatatgtgtgtgtgtgtcttaaacatatatgcatatgtatgtgtgtctatatatatatatatatatatatatatatagaaacataaatattttatcaagttgagaatgggagaatagatttctttcagcaaacaacctcaagcctattatacatctgatttatgaagggtaagaaattcaaccttaacccaagcaaaggtttaaaaaggcagcatgggtattattgggcttaggaaaaggtgaaggctgccttgctgccgtcctggaagattgagacagtggtaacaacacgtgcagcaaccccctgcacttctagaaggaagctgatatctgtctacatgtttcagcgtttgtctctgaacctagtcttttcttggtcacataggggaagcaacagaggtggcttatcatagcaatgcaaaagcctttaatgaaaaatgggctcaggttttggttcctataagatggtgattcccttcccccacaaaggcctttgtgtacatggggtgaggtaggggtctgagaaaggccactggaaatggaaggcttaacggccagtcctctgctatgtcccagatggaaagctccttgtatctaagaaaggcaggaaaccatgtcacctggcttctgatatgtaacaaccccaaattattctccgaccccttgaaggccagctgggctcttttgcatcagggggattgtgtttagaatttgtgtcaactgtctttgtagagatccttctggataactactacaattcctgggatattcttacagtgggcacatgacaaagacatgtgacattggcccaaacccccctcaacttggaaaaggggtggattcccccagctgacttgaagattctggtctgtggattcagcaagagtctgaggcctctgctgagtgagccaagggtggcttccggggaggtgagtgcctggaggagaatgttcccagagccaagatgggatgcctcctggtatcaaagtgatgttcagattttttctggaaatctagaataggataaatgtgaatagagattagagtgaacatcttctaggatttgaagcccttgagagcttctaggatttgaagctcttggtcttgagaccaagcctctgcaatgcatctggggtccgttgcacaagtgtgtgtctttttaccaggtcttatccccgcttcagccttttctctcctgttagggatcaaaacttgccaaaacagaaattttaaaaagacacgcaggatgtggggctgctcctgggaggtttgctgtgtgtgtttggggtcctgcaccctccactccactcctgagtgtccaagggtggatgtccagaaatttagccacctactcccatcagtgtagccagaacctttgctgggagttaatctctctccctcattactttctgatctgcttgaaagacaaatagaggttagggaaatatattaatatcagtaagtctccatggatggcccaggtcaaggcagacaaaggtagtcacacgctttcaggggctgaaagacaagtagaggttagggaaatgtatcagcgcatctccatggataacccaggccaaggcagacaaagaaagccacgtgctttcaggtgcaaacagcggccgccttttttcactggacatcattgggcagctgttgctgtcatttcccacggcctctctggaggggaaacacagctggcttctgtgggccagcctgaaaccatctgcagctgcttgcatgctttcaaatgtaagtaagggaatttcagctgaggttaatctgggaaatcctctgtatgaaacattttccttttcactgttccctttccttttggatataacatatgacccacttacgaggcagcctgttggatcactggtccccaaggagctgtggatgtcttcccagattactcctgccaccaccaatgcgtctaccaccatgagagctgctgctgatgggcactgcactgtgcatgttgcatatgtgatctcatttagcactgtgacactccaaggaccacactcttgtctcattttcggataaggaagctgaggctccaagaggtccagcagcttgtcttaacagtgaacaggtgcaaaaccaagatttgaaaccagtttttgatcttggtttgatcttgatgccacatcccagcctctttctacctctgtaggacggctttgtgtctcctctgcattttcagcctccattgctaatctgacaccatctaaagcaggaatatccttattaatggaatagtgcttaatgggattaggcttacttctgtattctagacaatatttactgagctgttagatgtaatgtgttcagaaataatacagggatttatgaatatgtattaaatattagagtataaactttatcaagcagagaatatatttgtcctccagtgttgttgaccttgtatgttttttgtttgtgttacctccagagctggattttgaaagattaagccaagaaaaaaagatgagacattcaaaagtaaataaattagtttaggcctggcttttctggggccatggagttgttatcccaaagtccttgcttggacctctcctcctctccactcctcccctcccctcccctccccattgggcactgccagggcccagtacaagtgaaacagatgctcaactcctagacttgtggaggcttaggtagaccagcaagtcactattaggacagaaaaacaagaccacgtcattccccagcccaatcccttatgctttctttcaatgacacttaaaatttaagacccaaacctacatgatctggccccatctgccttttcagactcttcttcctcctcgagccccttaccccatcctagccaccgaagccagtgatgccacatcccagcctctttctgcctctgcaggacagttttgtgtgtgctctgcattttcagcttcaattgctaattgtcctctcttgtcctcacttctttcactcccatctcagggtttctgcatgctggttctcctgcctggaacagccttctacccaccctttgtgacttagttcacttcccagatttcagagggcagctcagctttcccttcctcatggaaacctcccctgacctccctgagtagcccaaactctcctattgtaggcactctcagagcgcttctcatagatgcaattttacgtttgttcgtaattctgttttgttttttcacaacaataaattttgagagggcagctctatgcctagtctccaccctgtgtccccgatgcccagcacagtgcctgaagcacagtaggtattcagttgccttggtgaatgaatgaataaagccaagccaagcacagtactcagatctcaagctcatagtcactgcatagcttgtgctaaccttgcagcaagtgagacactaagcaagtgaacagcttacatttcttagtggtggtgttaaatttacaaggagagcatgtcacctctcacttcaagtttccacacttttaggccattcttagtgttaatagcctgtggaggactctttgaggagagaagaggggaattccaaagattcagcttgataaatccttcatctttgacctcatgtgtattctacttaggaattaaaacgtagagtatggctgctgctacaaatcttctttgcagtttttcctctggctgatttttctactttacctggaatttttatcctgaatttttgtccttttttgaatccatgtggcacacatacattgccctaccaggtttatttgtgtttgagatttgagatgctatctgaggccaagacctccagaattagatgggcctttgttcccagagcctctttgaacagagagaaattctttgctatgttggcaaaagatccttcatatctatctgtctttctttcttgttcagacttctcttttggccacgtgaacgtggatccacctgccccgtcttctggcctatgctgtgatccctggaacatttcaggtttgagtgtcagccacatcttctttaggaccagtcaagggtttgcctccaggaacagtggaatctattgagtgccccccagggagttccccatatgctggtttgtttgtcacttggccacacagttctactttttcctctttgtctgcaactgaacagcctaggaaacttacaagatttctgcttttttttgggggggcgggggggtaaggtatcgtattttgagttcaatctggtcgcaaactggattctgtccagatttttgttgggatttcagatgtttagccccaaacaaattgaaagttaaattgaaactggtccagatgaggtcatgcttaagatttctcccacagcacaaatcgtaccttactggaagctactgtaagggcagttcttgaatctctgcattcccaatacatactcatggtaaaaacagttaacagttaattcgcttgtgttccagtgacttgaaaaataagcattagcaccctggagacctcgtcttatcaagttctgaaggatggtttttatagctagtataaacccttagtttatcagcttcactggcctagaaacccctcagacctgaatatttgggatcagcagaatgggccaagcttaggaattccaagaaggcagactcaagatagagggctgccaaagctcacagatgtggaatgaaaccagtttcaaaacctgattcttcgctcagttggaatgtgttttaaaacctggactcacttgagatgtttgcacctggtaagaatgtttcaaaccttgaattctactttgtgtaattatctgtgaaacgtaatgatgatagctccaagctatctcataaagctgctgaagtcttcaaagcattcattctatcttcctggagttacagaaacacaaaatggtaacaggtgtgtcatatgcatccagagactacctcgaacttttctctctagaactcaagctccagacttgagatattagttaatagattgataaattgactcaggttaagtggtattatttcttagattatatagtgtcatcctacagagtaaccccattttacaggagaaacaaagttggccagaggacgaggctagaacccctttctagactgttaattcaggcagagctctgtatatgttttaatggttagttttctaaagagttttacctagaggccaaataaatcagaagctcaaacgcatatgttctctgtcttctttttagactggcttgcaagaaagcccttgggttactttttgccagaaaagagcatgcagagtgaacttgtgacataatacattccttgaagctcccacgttatagtttcctggtaacatagagttgtttatattattgctacttaaaacttggttgctttgtagatcctacttgggaattgaattaacttcagtgaacttgatagaagctgcatctttctgtaaagttttgggcaggttttgtcactgacattaggtggtgatgattttaaaggactcccattacttatccaacatgtgcacgcatactgtatatatgtcattagaaataattaggagttaattttcaataaggtccatttggtggctacaaattaatccatttaaaacccctgatatttgaccctattaattatatcctgctgttcattggtgcttaacccacagagctaatgagatgcctaagtaccactatttttcattgctctttactgtagggaagtaggtctctctttttctttttaatgtgagtggacataaaatttatcagcaggcatatccacagaaaactgactttattacaagtatccttttagacttgcaagctccctcagctagttaattttgcgtttaagtctatgtgattttcattctaatgtcttttggaattaaatgtaatgttgtaagaaaagaagcgtctgaccaataaagcaaggcagtctaggctgttttatatatatatacgcactttatcctgtctaatgtagtgctcctattttctttttcatattctttctgttagagccaaattcactactctgactttgcataatataaatacagatatccttactcattaagaggctgtgttgttttagaaattagtaagtggctacatctgcataattttgcattggtaagagttggcttctttagcgaacatgattttgtatttttggagaggaaaaccttgggcccatcaggttagccttttctgagatggagactcaagtgggaccacccaggatggtcacagcttcaactcccacacaatgagaacttgtgactatagcctgggagagctgactatgcaggagacaagaaatcagagagttgggtccagaggtagctggcagaaagaagattctattaatattttaacctcagaagagcagcgtctaaatatgtgaaatgagtgctggcctagaggggaagggccatactcttaaccacctcaagctggtcttatcattgttgctgggggggatgtgtaaggctacaaccttcccttttaggtagagggaagagaggactcccttgtgggtgtgcacaaaggagtatgatgagaagagggtggtgatgggtgcttagcttgatgcttacattgtcccagtgcagctccatgattgcaggtaccttgagaggacccatgtgcagtaaggtgggaggttaggaaaagcagagaatgccagccagccatgagtggatttgagaggtctgaaggacaaaggcaatgttgctttgtatgggtgcacaaggggatatgtgcatttaaatccgtcaacagtccagaaattggattgccatttcagttcccaaacaaatggcttgtttattaaactaaaagcccctatctccattaggaaatattcaattccagcaattagccccagggtgaaagaggtctccctctctccagtctgtttttgctctgttcccaaacaatgctttgatgtgcaaggcactcctaatggaagataagtcatcaattagcccgatggaaggttaagctgaaaacagacttttcagggaagggattatcactgagctgttaatcactgattgacattatctattggggatatattcttatgggagacttactctccacccaggcagaaggtaacaaagatgcaaaaatattctagttgtttggtttttttaaaaaatgagttttagtgtcctatagcaccatagaataactgtagttaacaataatatacagtttcaaatagctggaagatgggcactgaatgttccccacacaaagaaatggcaaatgttcaagatgatgaatatgttaattgccctgatctgatcagtatgcattgtatgtacggaaacatcactatgtaccccataaatatgtacaagtaatatataataagtaaattttagaaataagagaaaagaaaaaatgtgagtttagaaataggatcttagatcaattgagtcggggtggagatgataatagttttctttctaaacaagtatcttttactttctttaagaattgttggtcataatatgattacattgctaatttatgaaataaaaagtaaggagaacctctaatttttttttagagtggggagacagtgtctcactctgttgcccaggcaggagtgcagttgtgccatctcagctcactgcaacttcctcctcccgggttcaagcgattctcctgcctcagcctcccgagtagctgggactgcaggtgtctgccaccatgcccagctaatttttgtatttttagtagagacgaggtttcaccatgttagccaggctggtcttgaactcctggcctcaggcaatctgcttgcctcggcctcccaaagtgctaaggattacaagcatgagccaccatgccctaccagaacctctatttttataagagtaagttgatatgaacaatattgtgaatgtaagcacagtgcacatgaggcaaatttgtaattctgtgcttgagttttacaagtgaaataagtttattttttaaactccaagtagtggcagatgagtgttaatttacctacaacttttcaggaaaatatcaattgcatacattaagctattttgctgttattttttttttttgctttgtgccttttgtttttctttttttcttttttttttttttgagatggagttttgctcttgtctcccaggctggagtgcaatggcgcaatcttggctcactgcaacctctgcctcccgggttcaagtgattctgtctcatcctcctgagtagctgggattaaggtgcctgccaccacgcccagctaatttttgtattttttagtagagacaggttttcaccatgttggccaggctggtcctgaactcctgacctcaggtgatccacctgcctcggtctcccaaagtgctgggattacaggcgtgagccaccccgcctggctgccttttgtttttctagtacgctgatgagaccaaaaagaagatataataaaattaattgccaaaaatttagaaaatggaatagggtagttattctactaccctaatataatcaataactattgtactgcctaccactcttttttctcctgtttgctacaggggtgcaatccatttacctagattctgtttcctaattagcctcatagaatgtttcaaaaatcgtgacccatatagcttaatgagtacagagtttctgtctaaggggtgatgaaaaaatcttcaaaatagtggtaatggttacacaacattgtgaatataattaatgccactgcattgtacacttaaaatggttaaaatggcaaaatttaagttatatattgcacgacaataaaagaaagtgtatcaaaattatgcccctgcatttaaaaaaaaatttttttttggtagggggaagtaaaggattgacagatttcagagtctgtggtgctaggagaaaattttagggtggagttattctccatggggctcaaaacccaaaacttttcaatactattgaatattagcaataataagcttgtaattcaaagcagcagggtggtacgttgttaaaacttcagaaaccggtccggcgcggtggctcatgcctgtaatcccagcactttgggaggccgaggcaggtggatcacctgaggtcaggagttcgagaccaaccttaccgacatggagaaaccctgtctctactgaaaatagaaaattagctgggcatggtggcacatacctgtaatcccagctagtcagaaggctgaggcaggagaattgcttgaacccgggaagtggaggttgcggtgagccgagatctcgccattgtactccagcctgggcaacaagagggaatctttgtctccaaaaaaaaaaaaaaaaaaccagaaagaaagaaacatttaaaaaaaaaaaaaagaaaaacttcagaagccttctgaggttcagaggtcatgtttcggaggtcatgtttcagggtgcggtatttggagccctcccggaaacacaaaagcctccctggtgacattcttagcccctaggaagggcagtaatgacagcccacaactgacaagtactgatgaatagttcttgaaggcaaaccctgccctcagggagctctgccatagcttgacatgtcttctagaactacgtgcaaggggtcgcagagcagctaattctgccgcggtatgggcagtcaccaggaaacttcaagggggagcaggtttaacctgaatccttgctgaaaatagatgaatttgcctgggagtgagagaggaaagggcatgcctatgtggaggtaccagcaaggggacagatacaggaaaagggtgccaggccccttaattccaggtttaggagtttcttttaaaaaaaaagttcagtctcaaaaaactaaaaatagaagtaccatatgacctagcaatcccacttctgggtatagatccaaaggaaatgagatcagtatgttggagagagggactggctggaggggagggggattggggagatattggtcaatggatataaaatttcaattatgcagcaggactaaattcaagagctctattgtacaacatggtgactatagttaataatgatgtattatatattgtacttgaaagttgctaagagggtagattttaagtgttctcctcacacatatgtgaggtaacatatagtaattagcttgatttagtcattccacaaagcatatgtatttcaaaatatcaagttgcataccataaatgtatacacttcttttttcttaatcagaataaataaatagtccgagggacatttattgagggcctagttgttgggcagcatcttaggcttcttttggtttctaaatggtgccctagtcagggcttggtgagtttcagatccccagaaaaagtctgttcttagctttgatgggggaaggaagacccagagcaaaccacagtggcactgctgatctagagcaccctttagggtggctgggggtcagattacagactggaccacactcctaactttctttacccctgagacctctggagtcctagatgtggacgtggtgtttatggtgcattcatgtttctgaactcttttttttttttttttttttttttgagatggagtctcactatcatccaacctggagtgcagtggtacgatcttggctcactgcaacctctgcctcccgggttcaagcgattctcctgcctcagcctcctgagtagctgggattacaggcacctgccaccatccctggctaatttttgtatttttagtagagtcagggtttcacaatgttggcaaggctagtctcaaactcccgccctcaaatgatccacctgccccagcctcccaaagtgctgggattacaggcgtgagccaccatgcctggcctatgctcctgaattcttaaatactccaaatgatgcgatccaggcttacaagagaggaaggagagttagatctatgaatctaattaggctaaatgttttaaacagctcttctctcaggatattgtttttgttcatatcccaattctgaaattcattagccttatagaaatttattaagcctgaattacagagtgaaatcaagaagcatttttttttccttttttcttttctttctttcttctttttttttttttttttttttttgagacggagtcttgctctgtcacccaggctggagtacagtggcaagattacggctcactgcagtctcaatggctcaggctccagtgatcctctgacctcagcctcgtgaatagctggggtcacaggcatgcaccaccaaacccgggtatttcttttaattatttgtagagatggggtctcattacgttgcctaggctggtcttgagctcctggcctcaagtaatcctcctgctttggcctcccaaagtgctggaaatataggcataagccactacacctggcctcaagaagtaatttttaaataatatttttcataagaagttgagccatgttactgaaatgatgacatgctgaatggtgcattgcagcattgcatagtgaaattgaggggacttgactaagttgggagctggcaaaccccttgccaccaccacagcctttgcagataaagtctttgccttgctttcccatcccctaacggcaaaatgaattgctaagatgagaaaaaggaattttgcaccatctgcaccaattctgaggttttgcaagtgatcaccaatgtggagagtatggttcagggctacatgtttatttttatttttatttttatttttattttgcatccagcgtgctcagaaaaactaaaggaaaaaaaatggaaggatgaacattttaaaatacaacaaagctgcatcatcctccagtcaacgttttggttccagctgccttctagcattgcacagcttgagatgtttgttgcttgtgttcctgcagcattgaagcccccactcccacacccagcccctgtcatttcctgttttcagatccccaccttctgccctgcatgttggggaggggtccatggccagaacggaatggcagctctctgctattgtaggatccctgctgttgtgctcgaacctgtatataagacaaacagtcattcttgggagtggccagacattatctagagaattccaaccactcagctgaagagaaagtcactcacctggagtatttagagaactccaggcatctttaagcaggtacaggtgggagacacagcccttgaagattaccatccgagatacagctaagagctcaaagtgaattcttagattcagtgagccatgacacatcatgtgttttggaagagcaaaaaggatgtcaagatgtgcttctttatagtgggctttggagagctggacaggccagggcttggctctcaactgtgcccctccttgttttgtgtctttgggcaaattacttaagctctgagcttcaatgtgttcatccacaaaatacggattagccctatttcacagagttgccatgaggatttattgagataatgtatgtaaatgtctacacattgtaggtattcaattaataattgttaccatcatcatccatatcatctatatttcctgtcaaggaaactggcataccagctaagccagcaagcacatgcaaatagttctaggacccatttagagtatatgataaagtagaaaaagaatcttgaagccggtcttccttgttaagtttctagtcgagattgtcccagtttccacctttgtatctacaagaggcaagatagtggttaaaggccctgagacagattttcctccagttcaatcccagctttagcacttatggctggagcccttgggcaagtcacttaaaactctctgaaccttggtttcctgatatgtaaactacagctatcaagagtactgacctcctacgcttgttttgaggaataaatgtaattatgcataaaaatcgcatggtctaatgcccagcatatcataaatgctcaacaaaggttatgagcacctcatcatcaactaaagttgctaatgcctttgaggactctcgggctctttgttccttctccagtttgacagggtacattaccattgccagctctgtgacaggctttgtaacctggcttctgtgtacaacagcatacatgtatgcttctgctccagctgggcagtcgataagcctgcagcctttgctggttgatatgcccttattccacaggtattctttgctgtttctgttttatctacaggtttttatttttgttgttgttgtttgtctttttgtttttgtttttgtttttttcttttttttttttttgagatggaatctcactctgtcaccaggctggagtgcagtggtgcgatctcagctcactgcaacctccacctcccaggttcaagagattctcctgattcagcctcccgggtagctggaactacaggcgtgcaccaccatgcccagctaatttttgtaattttagtagagatggggtttcaccatgttgaccaggatggtctcgatttcttgaccttgtggaccttgtgatctgcccaacttggcctcccaaagtgagccactgcacctggactttttttttttttagacagagttttgctcttgttgcccaggctggagtgtagtggcacaatctcggctcactgcaacttctgcctcccggattcaagcaattctcctgcctcagcctcccaagtagctgggagtatgggattacaggcgcctgccaccacaacaggctaattttttgtatttttagtagagatgggttttcatcatgttggccaggctggtctcgaacttctgacctcaggtgatccacctgcctcggcctcccaaagtgctgggattacagacgtgagccaccatacccggccctgtctacaagttttaaaaagcatgaatatgttggggcaacccacctctgagaaggctcgaaaaatgctataattagcctgtggccagagtagagggcaacagtgaactacctggcattgaagtcctaccatgttcccattgtggggccagctgccttcacattctgtcctcttggaaatcctcataacagcctcagaaggtaggtgtattgatttcctagggcagctataacaaattctcacaaattacgtggttgaaaacaatagcaatttgttctctcacagttcaggagtcctgaagtctgaaattacagatggcagggttggttccttctggaggctttgagggagaatccgttccatgcctttctcctagcttctcgtggttgctagcaatgtgtaacatttcttgacttgtaaatgaatcattccaaattctgcctccagattcacatggagtttcctctgtgtgtatatctgcatgccctctctttcccttataaagacaccagtcactggatttggggcccactctcacccagtatgatctcatcttaacaaattatatccgcaaagatcctatttccaagtgttacattctgaggttccgggtggacatgaattttggggcggggcactatttgactcacttcagtacttattatacccatttaacagatgatgacccagagtctcagggaggagaaaatcccttgcataagcatcacacaatcagtttatgatacccaaggattcacaaaccctgacctgcttttctctagatttgtgtacttcccaccgtatcactttaccacatataaacaaacgtagaacaaagagtctaaaacctatggcagcaaaacggtcaacagcaggcagccctgggatcaaagagggtctctggagggtaaacaggatgaagcagaggctttgcaagcaaatggcgatcccttccttgtttctggttctcagacttcatcctgtttccataatcagtattacttattggctctcaaccatccggctgtgctcctgggattccacagtcgggcagagagattcttcataaatgagagaaggtagtagtcggtttcgtttgcattaagagaaggagcacatttctttgcacaaagtaaaataccctcccacgactccccactgctccccgtatccctgctggcttatgcttatcatgcatcccagtggtgaatggagaaattccatgctttccttctcctgcagaggttccttcctggcattcagagccgtaaaagcagtggacggaaacagctgaccagccctcagctgctcccagagtctggctgcctaaacttttcccagaggatggtccagcagtgctggtccagggtgggcttgggagagcagagctataggcaagagaggtgtgaatccatgtggtccccctggttctgggtaaaggccagggctggggcagaatcacagtcagaaccagggtcaggtcgtcagtgtcaagggcaaatatctttttctttaaaccacaagtgcacctctggtaccatgctcagaatcccttgtagagagtggcatccgtttgctgcatgagatgggagaaaaattagcggccctggctcgagtcttcattgccccttggctgcctgccgtgtcctatttctcatcaggccagtgtccccagtgcctgtcctgatccagaattaccacttaaccctagtggagcaggactctcagactgaccatctggactttcctcgagttctcttttcctgccagagtgtgtcagagtgaattggattagagttctgtttgctgcacagcctggcttcacatgaggctttgtgcttttgaagaaacttgagacaagactattcatgagttcccagagtgggtggcaattcacagtgatgctgatatccacgatcgtgggggtggttctgtgcagggatctctaaaccttttagaaccttccaccagtttccctgcaatcaataggtagctgattccatcagatcaaaccattttcctgttggaaagtggtaggtccttttgttaagtgttcttagaactcaccaatgatttcatcgaaaaagcatctctgatggtttttctttctcctctggcattgtgaacattgtcttggagaagtgaaggtttgccatgtaacacctgcctttgagcagggaagaacatggtgggtaaatctacgagagagacctgttctgttccctggactcagctcccatagagtccaccactgaccttagaccctcaggctccaccggatggataggaattgagtaacagaagggtaggaatcccatacataatcagtatggaatttgggattgcctaagtgcagagttacattctgttccaagccccagcattcactttaaacattaataagagatatggtgctttttgcctatggaagactagattgaacaaacccaaaatattatttttaaaactactcaaaattttaaaatactaaaagaaaaaatgggactcaaatttaatgagcccgtgtgtgcgtgtgtgtgtgcgtgtgtgtgtgtgcgcatgtgtgtgcgtgtgcgtgtgcgcgtgcacgcgcaccttgtaggtaggtgaggagattactagattgactctcctgtacatttaagttaaatggaacaaaaaaaaatgactattgcttagaataatggataagccggcctcctattttttgttctctacttgactgatcagtccttgggaaattcttcaatgggattttcctatgacatattctgtctgtgacatagttcatgaaattctacgacatttgattcccaagggggaatctggttactcacagcgtgtttcacaacttttctgggaacaggcagctcttggaaggaaaatgtctatgtatagcagtgagccaataactcatcttcagtgaaaacggaaggtgatattgtcatacagctgtgtagagtgagagtactcctaaacagataataaattacagccagaaagcaaaacctcctcaagagatggccaagttttggtacacatttgttcactgtggctctatgaaagacctcactttttaatatgtggatggaaaatggagatcagaggtgctgtaaaacctaacaagtagatgagccctggccgtttaaaagtctaaatgtatttaaagcttgaatttgtaactttttaatttatgtatgatactctcaatccttgcttttccaattacaatactaatacatgctcagtcatatgcatctttgtttgtttttgttttgtttttgtttcttgtttgtttgccttttgagacagggtctcattctgttgcccagactggagtgcagtgatgtgatcacagctcactgcagcctcaacctcccaggctcatgtgttcctccggcctcagcctcccaagtagctgggactataggttcatgccaccatgcccggttcattttttaaaattattttttgtagagatggggtcccactatgttgcccaggctggtctcgaactcctgggctcaagttatcttcccacctcagcctccccaagtgctgggattacagacacgagccactgtaccctgccaataatccacatctctatgaaataaaaaccatggactccacttcagcttttcatcacccctttagcactgagtttccccattcctattctccagggttaaccactgtctttgtctaatttctgctgctgaaagagtatacctgagtctgagtaatttataaagaatagagatttggttcttacatttctggaggctgtctcatcccatagaagaaggtcagagggcaaaagagcatacagcctgtgagagacaagagagagccagtcttactttgataatgaatccattcctgggttgaccattcgtgaggtcagagccctcatgaccttatcgcctcttcaaggtcccatctctcaacactgttgtatttgggattaagtttccaacacatgaatttttgggagacacattgaaaccacagcagccacagataagctatatatatatagagagagagagagagagaactatagagagagggcaaactatgtatatagaataaagtgtatatatatagtgtaagatacatatatatatatatgtcgttttgtgtgtgtgtgtgtgtgtgtgtgtgtgtgtgtgtgtatgtagttctacttccaagaatttctactacagccatggaggcacatgtagaaaatgatctatattcaaggatctccaatgccacaatgtttgcaacaataaaagactagaaataacctaaattaatagggaactgatctttttataaaatggaatatatattatatatatatattccatgtatatatacagaaatatacacacacacacacaaattatatccttattttattatttaatttaattttggtttttgagatggagtcttgcctatcacccaggctggagtgcagtagcacaatctcggctcactgcaacctctacctcccaggttcaagtgattctcctgcctctgcctcctaagtagctgggactacaggagcccaccaccacgcccggctaattttttgtatttttagtagagacaggatttcgcaacgttggccaggctggtctcaagctcctgtccttaagtgatctgctcgcctcggcctcccaaagtgctgggattacaggtatcagccactgctcccagccttcttgacttgtagagagtgaatttatctcctccaggtgcctaatcacccatcaggagtgccatatttccttttagtgctttcccacctgtctctctgtattttttaaatgcttacttccttttttcagaagttaatatatgcacatattctaacattggaaaggtgtagaaaagaacacagtgaatagaagcttacctacacctgatgtccagtgactcccttccccattccagagaaaatctctgtgatcggtttcttatgtgtccttccagggatagcttatgaatatgcaaatatagatacacacatacctacatatatacaaataaaaatatgtacatataagattattcatattcatgtttgttaacatcaaaggtaacgtgctctttataaaatgttccatagcatttattagtagattttgaagattgctacatataaattatcatagagctgggagttcttctgttcttttaaagttgtatgatattccatttaatgaaaacatcaggccaggcacagtggttcacgcctgtaatcccagcactttgggaggccgaagtgggcaaatcatgaggtcaagagatcgagaccatcctggccaacatggtaaaaatccgtctctactaaaaatacaaaaattagctgggtgtggtggtgggcgcctgtaggcccagctgctcgggaggctgaagcaggagatttgcttgaacccgggaggcagaggttgcagtgagtcaagatcatgccactgcactccagcctggtgacagagcgagactccatctcaaaaaaaaaaaaaaaaaaagaaaagaaaaagaagataacagttccctattaatttaggttatttctagtcttttattattgcaaagattgcggcattggagatccttgtgtatagatcattttctacgtgtgcttctatggttgtagtataaattcttggaagtataaccactgggtcaaaagcattgtgtattttaaagtggggtccacgttgccaaattgccatccaactttatggagttggatgagggtacctctctcattacatgctgataactaatatataggtggaaaacttgtagtttttgtgtttcttttttataaatgggattgagagtcattctgtatgtctaagaatagtttatatttctttttgtgaaccgtctatccatatcttttgtctagttttatgtttgggttgttgaccttttttatcgattgcaagggtcctttatattttaacaccatcaagccattataataacgtgagttgtgaatattttcctagtttatttctatttgagccaccattggttgaatcattttaccgtatggcaagccctgtggtgagcatgtcatgttttacaactgctccctaagttagcagtggtattatgccattttacagagaagggccccaggtctgtcggatgccaaagttgattcttaacttgaactctacaccccttttgcacatacctatttatatagcatcatttcaggttgtcatgcaattatgataaatatccttttcacaggttgcatagcattctattagttatacaaatcaaaattttcagatgctgatacttagactacacattttcatcacctataggttttcactgttataaataagattgtgatacatttcttctaaaactctgtcctccccaatgcaacaagatggtgccattgctcctgcaggagatgagataccatgcctgaggcagacagcagagtcatcttttgagtctaagatccttgacaagggaactcaacagattcggggtagaaatggggtgcatgtcaggggatggggacattttattggcctgctagacttctcagtgcctttcccttaaatgtcaccagtagcttcacctggttctggaatgaaatacaacacacattagggcttcagaccctcttctctctgaaagcctgccctttgtttttgagacagagtcttgctctgttgcccaggctggagtgcagtggtgcgatctcggctcactgcaacctctgcctcctggattcaagtgattctcctgccctcagcctcccgagtagctgggattacaggcatgtgccactacacccggctaatttttgtatttttgagtagagacaaggtttcaccatgttggccaggctggtcttgaactcctgacctcaggtgatttgcctggcttggcctcccaaagtgccgggattacaggcataagccactgcgcccgggccaaaagcctgctttttgatcagcaatattggagacagttgtaggaaacactgaaagactgcaggatgcagtggggagggcgaaggccgggagttgacaactatttttttttttataaaatagtatttcaaataatatttctaacaggaataaatgagatcatagtgcatgacatagctgaggggtccatatgtttgtatgttcttgtggattcttctcaaccctctgctctgtagctttctatgccctgagcaccagagaagcattaccaggtctgggtgttctttaagcctttctaaagagagttgctgtttctgtttgccttttctcatcattttccccttaataaattaagggctaagtgtgtcttagtttcccacactttactccaatcagggattcctttgggtaaacaaactcctgtcttaaattgtaagtattcccatctgattcacatgtaagggcaaattgttttaaagacctggctccatgctgagatgtagggtcttttggtgacggggcttggaggaggaacctacctgaaaggtaaggagggagaggacaagactgggcatgtgaggaggaagggcggttgtgaggcccaggcttccttctctgtgtgccttgaattgggccttggagcagcttgaaaagctgccccagcttcgctaagcaccaggaagcagggaggggaaccttcctagtgccaccctttcccctgcacctgctactttgcaattccaggcaatgggctggctcttaactgtgtttgaagccagcctctctaccctgaggacctcattccttcctgaccccttcaaacctgtttttggaactttctgtcacactaaggtgactggtgactgtcacaaatgggaaagttacatttagcagaataaaatccttccgttaaagagataaagttctgacaaggggattgtctacaagctgcgcctccttctaggaactcttaaaatccctctcagcaaaagtatcacctggtttccaaggcagctgctgctcctatcctctcacaggctttcttgagactctgcccactcaaaatgagttcacctttgcccaaagttcatgctaaaagcacagaacttacagagattaggagaagtgaattgtgagggtttatgtacctgggatctcattttaccgaccagaaaactaagacctagaagagaaatgaggccttcccaaagctcctagcagctggcctacgctttcaaagtcgtctcttgctgccttacattacagacacttcttaaggttttttcttttttgatcatggctcactgtagccttgacctcccaggctcaagttcctcctgcctcagcctcccaagtagctgtactataggtgcatgccaccgaacctggctacttttcaaattttgtagagacaaggtctcactacgttgcccaggctggtctcaaactcctggacccaagtgatcgattctcccgcttcagcctcccagcactgggattttacaggtgtgagccactggtcctggccttcagatttttttcttttatttgcattagcccaaacgcttcttgggtctgctccttcctgagctgcctggtgcggcttctatgagcactgctgcattttggggattcatggcttctagccagagctctgttcctaaccagcgggatgaccctagggggtaggtggctgccattggctggggtctgcccctctgcagagtgcatgataatccccactttgccattaatgggaggattaaatagaaggtatagaagggtatgtggcacagacaaggcacacagtaggagcaccatagatattggctgcgtgatgatcataatggtatcaattgtctttaaaccccagtggctagactttcataaattgaagtttacttcccagtcaaccaggaccaagtttcaaaatggcttcttttcccccagggcaaggcaccctcagaaactaacgaaatcaggttacggcaaaacagtgcaaatttattttcagaaaacccaccccaagctcagagtctacacttaaagggtgtagaggtgtgagctgcagctagacgttacctgctggattctactctggtcatttctctccagagactccactgtcatcaagtgtgggatggctctgtttatgcttttgcagcctcagcctagcttgctggtttttcatgtctccctctgcctctgagtataatccacttttctggagtacctaactgtgactttgccatagagtatttatctaacctcaaccctatttttgcagcttgggttgaggggagactcaggcaactgtgtgaatgtgtgtgtttttgtgtgcatgcacaaatacaaatgcatgggtgtgtatgtgtgagtatatagattagtttgttagggttgccatgacaaggtatcacacattggtggggggaggcttaaacaacagaaatttatagtcttacagttgggaggctagaagcacaaaatcctcagcagagttggttcctttggagggctgtgagggaaggatctgttccaggcccctctccttggcttataagtagttgtgttccctctatgcacatctctgtgtctacatttcctcttattctaaagaccctagtcatactggattagggcccaccctggtgacctcacttaaatgtgattacctctgtaaagactgatctccaaataaggtcacattctgaggtccttggtgttaggagttcaacataagaacttgtggagatgactcaagtcaacacacaacagtgtgcctgtgtgtgggtggagcatatgtgtgtttgtgtgtgtagtggactctggcgtctctgagacaccaggtcatttgcaaacctactccttggaaaatagtactttaagagcacatacagttgtctcttgtgaatagggcagatttaaaacctttttctaaaacaaatcttcccatgggtgtggaggggcaggtgtggtaatggagtgggtcccgggtgcccctcttgcatcgctggtcgagggcacttcataatggaaagtccttccctggttcttcattctcaagcagagcaatgccattggcatgtgatttctgcctcattttacttcagatgactaagtagcatcttgaagtgcctttggctacacaacagaacattccaattattccacagggcagcataaattcggagttcccttggagctccctggtgacttgataccaccaagtcagtcattgaggaactccccaatatttctaaataaatttggaaaatgtttttagcatatggaaaatgttgtttagatgctgtaaatagttgtaaagtctacttttagcctccttttcaaaagagccttcctgggctccatctactctgattatcccttccttgactcgtgtgcttgggagggtcccaggaggactgctatgctggctggtgtgcagaccacaggtgaaccctgttgcatctttcagctgctcaccaggacaaactgctctaaaactgaccccaaatgagctggccccacagaaccatgtgtagcgtttgtcatctttcccccagtttactgtaaatctcagttctctttgacctctaaaatcttactgaaaaagtgagtacttcatggtactgaactgacctggaattctgactgactttctagttctgcccgtaagttatgccctaaattttccaggtcaatgtagagttccagggaacgaggtggacggaatctggaggcagagttgagccagtgggtgttatcaggcagggggcactgataaacacgccaactccctgttagacttagtgtagtgctgggggccctattctgaggtgacactgatgtctctactcaaggcaaatgcacatctgttttcttgatggcagaggactgttgttagccatgggatggtgcagccacttcctccagatattccttgaaattagagcactcatctcagacttcagatgcatctgtccactttggcatggactataatgtagccacttaaaacatatcttacaagggccattaaataacataaaaagtgcttgtgaaatgatatgagtaaaaaaaaagttggcacagaattgcatttactgtctggtctcaatgatattaaatatgtatttctgagaagatgacaatggaatgaaataaaatattaactttttttctgattggaggggtaatgaatattttttattttctaaatgttctgtggtgagcatttgttatcacacacagacacacgcacacatgcacataccacatgcatgtacacacgcacaagcacacaccacaggctgtcctgaaaagtctgtctaactggagatttctccagggtctttcagattttttgctgcctcaatacccctgggatatcaattccctgcttgtcccagggcccacctctgaattgccgagaagacagtggtagctgattcacatcaatgctaactgattcacctcaacgccgccagctcctgcctccctgctcagccttgagcgtgacaggagcaggccgggcctgctctggctgggaatgccgctgccctccagctccggccagccagggaggggccaggcctctccgaaggaggttaaagtccttctttgtgtgaatggccttttagggagcagagggagggcccacggtgacatcacagtcttccgtcaggaggctcaggaggaatttgtccagcttgagccagggtgcacgcaggaatctgtctggaaaaaggcagttctcactgaggaggtttgaggcgcgcgctctgggcagggtaagccaagtctgctgacttatcttcgtgtccttttctttctaatttgaaaggacaggggtctttttttgaggccagtgtctttatggaggaggttttctgagtgtgtcatgtgctgtggagtcctttcttgctggagagtaggcagccgagctcagactggtgtcttgcttctctctctcttttttttttttttgcaaatcttgtaaaactctcagcttttgtgctaagaggcaaagaggacgctcagtcctgcacatatagtgcaaagctatatgagtcgtctgtggcagatcacgctttgaagatggtgcaagtgtgtctgtgagaatctgtgtgcccttttccagaacaaaaccaagtgactcggtgattctgtcgcctcgtttcttagccatctagcatttgttcaagagactcagtcttgtggtctacagctagccttctgtttccatgctgtggaactcaccacattcacagggtggcctgggggaatatggttttggggggaatgtgtggtgcttgtctcttggaggtcccatgggtatggaaggagaccctcgccagctttgttcataggcacagaatcatctgtagacagagggttaaccacaaatgcatctggcactgttttctcttttcttggggctctgcctcaatatagtggattctgctggtccacagtggtgtttggcttttgatctctgccatgacctgctcaccaggcgtgaacccaagatctggaactatttttaaaccaagagggacacagcaaatttataaagaactgaaaaactaggcttgcttttgtctttagcagaatcggttaccctagaaatctcaccttgcaggagccagagttccctctgtggccttgagcttggtttattctggggtagggactaccttgcaaaataatctccagtgaaaagggcctttggtgagaagagcctccgagggctccttgatagggcgctcagtatccctcattgaggaaaacatgaaactcacatctctccttattcacgggaaacccggaagcctctcagtcactcctgtaagaagtgggtctccaagtaacggaaagaaacaaccctttcatcagctgctgcagaaaaggcaacagcagcttccttcctttcctcccctccccgctgctgacccccaccacacacactgtcttcagtttctttcacagaaagcccaagctgtaaatatattcatcaaataacaccttaacattttccagatgtgattggagccactgacttttcagcagggctaagaggaggattgttcataggctaagctatggtgctgggggagactccgttctatgagaaattgaccagtctccttcactaggaatgtgggtcaagacacagggaagccttgtttccagtgaaggggtggggagttccagaagtattttcatcccgtcttcagacctgtacctgaggcataagacagagagaatagcagaacagtgattactcttttgaccaataccgtagaagctctcagaaaaaaaggctggacctgcaggagcaggaacaggactcctggcctccaaagggttgagttttctttttagaactgccctagtcacattgagctgtaatggcttcatggcaggagatccatggaggcaaaccaagaagtgtttttagtatctgccccttttaaggcccacagcattgacccgagcctgccgggtccaaatttagcctgcgtttgccccaggagtgcttgaggtctggagtctggccggctgtcttccatcagccaggaggggaggctctagcctctttagggagtggcttagttcccagtttcccacaatcaacacgggcccctagttccacaggccggaagaagctctgctcgggggatggaagaggaaagcctgcacaggactggaatgtggcccaggttatcacccggggcctctcctctcctccacttcccgcttataggctcggcttagaggcccaagtctaaccctcgcagcaagcagttcccagactttcctgctgtcagtgccttcaggggagggtggaacggcccactcggagtcccagctccttctccttcctgtcgtcgttagcagggagggccagaggaggtgcagccagcctgcttagaaactttggtgcaccgcgctttcttcaattctttttgcccggcacagtttgcgccgttgaagagggctggaagtttatttccagctattgctgcagcacttccttctcctagtgctgttcgttcttcttatgggaactggtactcactccctccaagtctgtgagcgtcttgctggggatggcggatcaccttggagctctgaggacctcgcacggcccaggctgagagcatatagctctgcagggtcccaggatatgcttatggatccaaggtagtgttgacctgttcaacttctgttcccttccttatgcttcgggttccctcggtttggggagttagcctcccccagacctcctgactgcagctttgcctggtttgtccaaagctgatgaggttcagctgatgtgggcatcttttaggtttctgggcatcatccaccagccaggtgcacttccttccatcccaccctcaccccttctgcatttgccttcatgctggagacatcctgacttagccagaaagttaaaaatttaggaagaacctctctaaagatagccacacatagctcgtggaaccagttcttcatcatgattgtcattgcgtcctgcgcactgaaaacgtgacttacaaaagagaggcaggatgagaagggaaaacggagatactctctgatttcacagctatgaggaagttttgttttatagccatgcctctgttcctaggccaagagtgagtttatatttttggtggaacttataaataactggattaaaggatcgggtcacctattatctggagaaaagcatttctaatttaaatgtcatggctttagtaggaagtaatctgggttattcaaagcagagaaacctggttgtacagcctgatgtttgagtaatttggttcacactgtgcatttaggctaggagcctaggaggtcgagatgggttaggcacactgtcgagctttaacagcctgaggatggtggggcagaggggaggctgtgaacacagtgaacattgtccttgtggtgaaggacacctttctgctctccgcctgggctcaggcagacctgctaaggaaaatgcacttccttaaagttatttctgtccatgacatgcctagctgtaggcctaggtaccctgggcagaaagaacacatgggtgtctatgcccagtggggcagggatcagggccctgctgttgtgttttctgtgcaaatgtaaacaggcttctagaatctcacttgtggtgttggtgaagagttgcagccttttcccacagtgtccatcataatgacatggacatgggatcttaatattttacctctggcaagtggccagaggaaacagaaccccttcagagaccagcccagagggtgaaatccccagaccgtgcaagaagtcacatttctagctgacacgtagagcaacagatacgtctccagagagttaactctccagggagttcatctatttctgaccaagactgaataaagaaggtaaagggatcatcgacttttaaagctaaattgtgagtctcacatcatctgtagagattcaagcaagcaaaagatcaaccaaaaagccaagctaactctgttttgatccatccactcttcttaccatttcccatgtcattttaaaagcctcctaatattgagactccattttgatgtatcaggatagaatgagaagaacccaccttcaaatcctggctagggcacttactaggcaggtgatcttgggaaacgtccctctatttctctatacctcttattctgaagttttaagactgaaataaaattcatgcctttcccacttaacagagggccatttttcaagcatcagctgacatatgtatgtgcatgtactgtgaaatgataagctattagacatgtgtcaaccagaaaatggggatgccacacttacagcatgcccacaggacaggcttgtcagggctgtctcattcacttgtacatttacttggctagttgagttgtggagatggaccaggttctgttttaaccaatgtgtgacccctcctctgcttcccatgtgactggagccccaggtctgggtggttcttgactgctcattctacttactgcatttcaggacttaacttttaaggacattttgtgaaattactccctctgttgcagcacaactgtatcttcctagtcgtgttcagcttcaactaaaattcacatgtaaggatctggggttggggaaagattagggagattagagctgccatagattctgactttgagtctttcccgggccttttttctttcatcttttcttcttgatttcttttcttctaaaaatctcctgctcttttcccaaaagaaaatcagtctgctgccagaaagaatataatacctgtcatttaaacctcagtgtaaaatggcttaataatagtgaacatttgcattaaccgttttacagtttacatagtacttttaagtacattttctaacttaattctcaaaacagatttgggagatattattagtcctgcttatgaaggagttctgttctcagcagaattccataattacaaaaagtctggtaggacttttataggtagagccaagaaatgaccccagactctggtctttggacgctaaactctgaattaccacatttcctgcattctttaggtggagacataggcacctgtgttgtaaattaagccacgctaatttgctttgcaaaactattaaacactttttggtaaataaaggcgactttagttgcagcctggctaccaggttatgttaaacacaggtctctgggaccaaattctggcactcatacagacttgagttgaataaacatttataaaaaatgctatgaggaaatctcagctccctaaatttctagatgctccaaccccaccttgcctgaagacagatgtggcaactttatgaagacaggattctgttaccattttagtgggtggtaagcaaccgaagtcccctgagccaaaggctagaaacaagatcgtttagttttcaaacctcaaacaccatccctaagggtgtataaaccaaagggttcgctctattggcatatcccctttatgaaagggtgaggaagatctctaatccacaaatttgaacaccaccaatttcacggatttctaacattcattatgctaattgacaggccactaatttcactaatgaaaacctatttctcaccttaattatgccaattagcaaagcttcaggggttcttgggagttaaagggagctaagtactggaggaagccacctgtggggcgtgggatctctcattggatcctagatgaccatcccttgagtttatattcccatttaggatggttgtcagaccctggaatgtaatttaaactaattccagaagcacacagctgtattaaattgccccgatcaagtatgtgaaagtaaatggtaggcatcctaaccagctgttaactattctagaatttagtgggaagggcaggtttctgtgtcgtggtattagggctctacctggagggtgaactgggccgatctaaaaagctcccacagcccctttgcaccttagtttttctctgaccttagaaaacccagtttgatgattctttcatatcctcctgtttttgcattggggcatagttcatttcaaaaaggactttcctggtgattgaatgaatgtgcatcttatctgaatctggaatcacgttcgcctaatttgaagcatggagaaaattctggaccttcttatcttcaaagagagcaataagcatttgttggtttaaacaagacatcatctgatgataccaagcccagattcctgcctaatccggataggttagatttccagcccatttccatttacctggtgtagttgccagtggctttgattctatcaggccatcatgcatgaaggcaaattcttactgctgacagtggaactcaggaattcgctcttttgttatcattgttgtctaactttacaaaacctcaggacctctggtgcatgattgtgaatcagtaattcagagttgtttatctctttaaatacttccatgccaattagaggttaaacctgctgcttcctgagtagatggaattgagtgtcatgaagaattttctgaatttatggggaaagggggactggatgccatatagctcacaagaaggagggcctctttcctgtttacaccctccagtgtctagaggtttaaaaaaatgtatcggaaaggaatcatcccaaattacactggaacccccaaactttgacttttaacaagtaactagcgtgtgtgtgtgtgtgtgtgtgtgtgtgtgtgtgtgtgtgatggagtttcactcttattgaccaggctggagtgccgtggcatgatctcggctcactgcaacttcctcctcccaggttcaagcaattctcctgcctcggcctctcaagcagctgggattacagaggcacctgccaccacgcctggctaattttttgtattttcagtagagatggggtttcaccatgttggccaggctggtgtcgaactcctgacctcacctcaggtgatctgcctgccttagcctcccaaagtgctgggattacaggggtgagccaccgtgcgggcttcttttttttttttctttttgataccaagcctcacttcctcacccaggctggaatgctccaacttctgctctccgggttcaagagattctcttgccaaatagctaggattacaggtgtacaccaccatgcctggccaacttttgtatttttagtggagacagggtttcaccatgttggtcaggctggtctcaaactcctgacctcaagtgatccacccacattggcctcccaaaatgttgggattacaggcgtgagccaccacacccagccttttttgagacagtctcacttcctcacccagactggaatgcagtggcactatcttggctcacagcaacctccgctctccaggttgaagcgattctcatgccaagtagctgggattacaggtgtacaccaaccaccatgcctggctaacttttgtatgtttagtggagaggaggtttcaccatgttgatcaggctgttctcaaactcctgacctcaagtgatccacccaccttggcctctcaaagtgctgggattacaggcatgagctattattgcaccctgccaactaactagcatattttaaaatctcagtttgaccgatcacagaagacataactacttgtaaaataatttctgattcaaagataatggcagttttgtattttttttcaaacaattgcaaaagtatattgtcaaattgttgtcttagattttaaatatttggtaccaaaacaactatttctagttcaaaaagggtgccttggaaagagctgatacaatttttgaatcctaaaaagaaaacgtggaaagtcatctgctcattcatcatcgagcacttgaagtgtgaaacattcaacagaaagggataatgctgatgtgaggagcggaaaagtgttcttgggaaatggctttggagataagccccatcactccttcctctgtgattagcaacaagagacaaagagaagcaatttcttcacttgcctgattcagactaagaaaactctaatatagacttagggctttcttggaagtacagagaactcattttttttttaaagggtgttgtcttctggagcttattgttgctgctaatttcattatgaccctgcagaataacctcccctcatgtttaatgaacggattaattaattaaactatagaactaattatttgccttttagtttcctttactattacgttgcccttcttcctctcctcaggtattctaaagcatcttgtgtttcaggagagcagtgttttctaaccatatttcagtcctaccagcttcctactgatttcccactaccctccgcccaccccggcccccaagccaaaaaggatagaaggagagctctgttgttcccatgcagaatattagcagtgagtcattggccaaaagaagccaggggtgagggtgccataggtaatctgactcatcttagcagtaccgtgaatctctctttgtttgtcttcttatttcaataataattttccatggagtgggctaattttggcctaggtttacttgaaattgaatggcagccagtaagtttcagcattcaaattttgtgtaatgcttaatgatatatgagtagaagttactgacaatgtctcatccaacaaaaagtttagttaatagttttaaaagggctggccatgcagggtggctcatgcctgtaatcccagcactctgggaggccaaggctggactgcttgagtccaggagtttgagaccagcctgggcaacatagcgagactctatctctacaaaaaattttaaaaattagccaggcatggtaatgcccacctgtagtcctaagggagactgaggcaggaggatcccatgagctcaggagttcaaggttgcagtgagctatgatcacatcactgtgctccagcctgggcaacagagcaagagcctgtctcttaaaaaaaaaaaggaaggtggtggcaaaaactactatttaatgatggtcaaaaataaaaaataaagatattagcaattataaatattaattgtgttaagtatcactccttaacaaagaccagacctagactggaagaaaatcagagaatggaagatgttgacaaaagaggaacactcattatttgtgcctgttaatggagaagacatatacattacttgaataatttaagtctgaaaggaaatgtggaaagtgaagagtgaaggaaaccccccagttcatggataactcagagagtttttcaacattctgacagcagtgtagagcacttacgatgaactccagtgttttcttaggtctcaagaacaaatccataattatccacttttttgggaaggattttgaaattaatttcctgagaatcgtcctaaggtggtgttttaatattctaagcatttaaaattgttgaaaccttagataaatgaaaattacactctcttgcaattttgcattgtcctatgtcaataataccaggcacattataaacttgagacagggaaacaaagccaacctaggtgttgtaaggtccttgatggtaactcaaattaagtttatactttactggaattctttgagataagccagagtcctttgatatgaaaaagaaaatcatcttataatttgaaaattaatgtttctaatgccaaataacaaaattacataggctagataactggtagaaaaataagatggatgggttgggtgtggtggctcatgtctgtaatcccagcacttcgggaggctgaggcgggcagattacttgagtacaggagttcaagaccagcctgggagacatggaggaactctgtctctacaaaaaaaaaaaaatatataaatatatatatatatataaatcagccaggggtgatggcacacaccggtagtcccaggaggtagaggttgcaatgagccgagatggcacactgcactccagcctgggccacagagcaaaatcccatctcaaaaaaaaaaaaaaaaaaaaaaaaagccctcaagacaaaaaacctccttccttaaaaaaaaaaaaaaaagaaaaatatgatgggttttaaaacattaagaagatagggttttcttattgaatcacaaactgaagatatcacatataaagcagttaaaaaactggaggagaggtaccattggccattagtttttcaaagcagtgctgacttcttaactaaagagtattattttgatgcaatcccagaaaacagagctgtgcagtcagtggctttggtgatggtgttcataaggcacatggtcaattacagccatggcagtgaggcactgtagcctgtgtgctgccattaaagggatctactgttttccagtattttattctgcaaagattttccaaaaagtttcttgtctccagaataactgcattacatctggcagagagtcatatgttttaaagatctgttcatacaaaaggaccttctttttgcaatcctattaatagtcgtattgcacagcctgcaatcatttgccgcaaaatacttgggaagactctggtacaataatgatgtaatctcttccaccttagtagataaaatttaaaaatggcactagcatgtaaacaaaatggaatccataaattagagaggattgggcacctgttactacaagaaaatgaacatttaagggattattagaaaatatctattcaaaagaatttgtcactgtggtttccattttccttcctcttaattatgagtcagtttgtcagcattcacatccataagagatgcagtatttaaccctgacttttgtttactctttattccagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccaggtaagtgaggtgcctcacatgagagacagatgccacagcagtctgttgttgttgattccagctcatgggtttctatgtggagcctcctctgtgtgtgtctggaataagtgttggggggacactggcatgagaattccagcatacagggacatgcaacaaaagtgtcaagagtgtcctctagaagaaccctgagcttgcatggagtttgccactttccagaggatgcaatagctccttctttgttgttctgctttggccttggtttattataaagaattgttctcttttacttgaaagcctgcctcttgtctgaaggagaggctgtttgtggcatagaaccagagtggacccatgtgtggactatgttggaatcagtagcttgaccctcagtatctagttaaacccatctgatttgggagttgtcctctactaactaaccccttctgaatgctggtttccttcccagcaatgatagtcatggcatggcattgcagactggtccatgcaaaatgcttttgttcatcttccgtgtaactgggtttttcttcttaagtcaccacaaagcaactactttggaatcaggagtggacgcatctgttcttgtcatgtgacccatttggaaaagttgaattactcttcacaaaggcaggtctttaatcccttcatattgcctgggtggtcccttttttgaatactttgtatagatggttgatgttaattagagtgctaattattattgctaccatatggataacagtgtgaccagttgtttttattttccatgtgaatgtgatagcaatcagggatccacagatcttcagctatggaaaacgctgctcaaagcgtggtccaagctagtccaggaatcatttgctactggttcattctaagttcagacatcgagagtaagcatttgaaaactcctattgcaatgtgatattgtcctgaaatccaagcgtgggatttttgtattttacaaaactattgcttcataatggactggtggggaaaaactgatgcttcaccagagaaaatttaagaatcgttaccctaaaggataattgttgacacttatcttggtccatccatatcttaatcttatcttgacacttggcttccatcaaacctacaatgactcaaggtcactcttctcattaactttttaaaattggaaagaatctccaacctaaagaaaagttcccaagtacagtacaaatgtctttctgttttgaatcatttgagagtaaattgccaacatgatgccccatcacccccaattttgtagactgctccctaatgtgggtctctgatgttttcatatgatgattttcaggttgtgcatctttggtaggaataccaccaaattgatgctgtgttctcactgtatccaaacaggtagcacgtggtattagtttgtcccattatggtgacaggtgtcaactctgatcacttaatattgattatgatcactccattgagggagtgtctgccagccttctgcacagtagttacttttttcttttgtaattaatatacattttgtagggcaatactgtggtattctgcaattttcaccccatttcttatcaaacttcatttatttatgtcggtatgatctcatggattcctgtgatattcaatggattcctgtgatattcaatggattataatccatttcttttattatttttatccgcaacttgttcagttacagctcacgggagccctttctggctaacttgtatgtcctttggagatgtccccgttttcctttgaatgcttcctcaatttctggcatcgcaagatattccagtttcatcttatactttcccaaccctgaaatcggtcgtctctctgaagagcactagtttctgatgatggagaatggtatttagaaacaaagatctgagtgctagctgtgctcattgttattgcattgtcactagccccaggcactctcagtggacagaattagaaattacacacatctctcttgaaaaccatgagtttgccctgatgctttttaattcttatttaataaaaagttcattcatactttctccctttccatatttgtgaccaccttcttgacaaaagatacttagtttttattatctgtaatatgtttattatttaactagccctccttcccccacactccagtataaccagtctcctgttttcctcaccaaacttgggctccgacatcattttccaggtggccactgccacgacccttcaccaacaccctccttaccctccctgggctccaacactacagcaggtaccatcttattcagcctggcctagtgacttttggactgagttgtttgggaaggaaaggaaagggaggaagaagaggaagagtgcagtgactttcttaatatatgccatcaaattggtgataaagtttcaacaaatgaataatgggggggcgggcacaaacattcagaccgtagcatgagtattttcaggcttctctgtctctatctcttaatcgaacccctcaccatattacctccaactttatttctagcacataaacaactgtctaatataaagacatttcaatgctttctcctgattcccccaccggctgttgtccatcaggcttccccaccaggaccgaggttgccttaaacaagtcagcatcctaaggcttgccactggcatcccagcaacccagtatcaatctccccagtacttccctctatgctaatgctgatctcttctcccatatcccacccccataggattgatttctggtccctacaaggggatggtaattcatccgtgcaagtctgttccaatcttgatgtcgtattgagtacaatcatgataatgatatgcatacatgtcattccttcatgtttatctctagaacatttaaagcaggcacccgggcttcccagaattacaacatgagttgaaagaaacggaatgtaaaatacaattttcttcctgttcatgcctggaaatctttggagtattgcttggctggccaacctccaagttcatgatcggggagaaggctgacacgtgactctgagcagccaaactagacaattcatggctagggtcagaactcctggcttcagtggttttgtgaatggaggtgttaccaagttcctgcggcacatttcatatttcatgccagaagaagtgactccactagtttgttgtgtgactcagattgatgattggatactaggtgatgaaaaatataatttttaacttctctggtagaaatcatgctggtggcatgctggaatcctaaaaccttaaagcaaataaaatccactgagagccaagatgtggtaaggaaggagaaatcttctaattctttccatacaaaagttatctagacagaaaccccatccccctggtgtggaaatgctatttgtttttgcttttagtgcttttgcttttaaaagatggacaatgaatgatagaagttctgttttgaaaaggatatagtcattgttaatgaccgggtatctagaaattatcttgttggttcttattttactttttttttttttttttttttgaggcagagtcttgctctgtctcccaggctggagtgcaatggggcaaactcggctcactgcaacctccacctcccaggttcaagtgattctcctgcctcagcctcctgaatagctgggattacaggtgtccatcaccatgcccagctaaattttttgtttgtttgttttttgtatttttagtagagacagagtttcatcatgttggccaggctggtctccaactcctgatccgcctcaggtgatccgcccgccttggcctcccaaagtgctaggattacaggcatgagccactgcacctggcccttatttgacttttaaaggaagaagctccacttaaatagaatttgagtgacatttgtttatacagaggtgaataaaaatgtatagtccctgctctcagggaacttaatggttcagtaagagaaacaacattaaacaaatgaggcaattttatgacagagaagcacagagacctgtaggagcacaaacaaggaagaccatatcatttggaggataaagaaagtcttccttccttaggaaattactgtctaagctgagaactgaaggggtaaagttgggctcagggtgtaggggagaaggaagggcacctaagagaggctcaaaaggaatagagaacttggcacatttgagatatttaagagtaagttaatggaagagatttaaaacaaaacagaaatagatttggagccagacaaccaagagctctatcaatcatgttaagggttgtagactttagagtttaccctatggtcagtgagaagccagtgagagtttttaaaggagtaattatctgaacacaaccccaagctgtcctgccttcactgtgagttgatggactaaatgtcttcctattgtaatgcatccatttcataggcttggattgagctcttcctgcttatgagcacttccgaaggcaggcgccatcttggtgaacaccctgtatgttatgtgaggggccatgctcccaatagtgtgtgcatgtgtgccctctgctgatggcacttagaattagagactaaaaggaagaaggccaggggtggtggtgcatgcctgtaatcccagcacttttggaggtggaggcaagaggattgcttaagtttgagacaagcctgggcaacatagcaagtccccatctcttaaaaaaaaaaaaaaaaagaaaaattacctgagtgtggtgacacatgcctgttgtcccagctacttgggaagctgaggcaagaagtttgcttgagcccaggtgttcaaggctgcagtgagctgtgatcgaaccattgtactccaggctgggcagcaaagtgccaaaaaaaaaaaaaaaaaaaaaggagagagagagaataaaggaagcacctttgcaggtacatgagcctgatttgaaggggtaactcacacagtgctgtaaaacacccttgaggaaagaattagggggtgggatatccaaacattgtattgaagttgcagttcaagaccttttcaaatgtcttttcatattggggttgccaacagttctcactttagtatctgtgtctattattagatatcctggtttcacttccaagttctaagtatgccagagaaacccagttaggtgatgatttgtttggttttttgagagtttctgttttcatgccagatgttgaatttatttaccaagtcagatcattcaccccgtgagacctacattatggagagtggcaaaagagaaggtgtagtttgctattaagttccataacttggggtatctgttcatgtcttctaatttgtggaaagatgtgatagttataaatgttacttttgtaagctgtacaggaagtgttgacttctgctgctgtctgtttagataagattagacatgaggtgatcattacattattataaagattcttaactgggtctctgttctttccccttcattatctgcaaatatcacaaaggaaagtcttaggaaaaatatgtttgcgactgtccacacattcttcatgaagcagagcttggtggagtgtgccatgctaaattagagccacatgaggcacagtttcatttgaggtgccctcattgctccatgggggaagtccctgtgtcagcatctgacagaaggattgatgatgagagagctctccatcagtagtacacagtgcctctctttcctgcaaggcaggcaccaactgtgcagcttgtaggagcccttctggctgtgtgaagctagctaaagcttattgtggagtgtccacagatggttattgtccaccaccatatttctagaacattctctggttacaaaagtctaatcatggtagttacaatttatcaaggccttaaagctgcatataatactagttatttcacacttgtcatttcttattttctcactgaatcctcccaacagccctctaagatacaaattacctcaactcttgaggccggatatatttctagattcagactttttctgattttagagaatttataaagtatatactattatttagaaaagtaatacaatgaacatactattatttaacacaactggcaggttctgggtcaacaccctgtgatcaaattaaatttctactctaaaacttgagaagaagaattagttacattaagtgggtaaagactaggagaccttcatgtcagctcatgtcaggttttgctgccaaataagttatgaaaaatctttcttttcagagttttttggatttgggaattatatatgaagagttgtggacctgtaataatattctttttcaaagaattactactagagcccagagagattaagttgcccaaggtcactcagcttgaaaatgggagagcctggtttcaaactcaggctctcatttgtctccaaaatccatcttctttcccctaccttctccttcccatttgttgagcctgctctatgaggtatacagtaatagcttctctctccaacctgtagctcaggttccctctaccctttcccaatcttatgcccaacccctgcattttcctgggtccttcttgatcctccttttaggagccactgtggctctgcaatccttcttttgcggtggcctgggtgtataaatttgactctcaggggccatgaaacagtgcttccctagtgacccaggatgattcctttctgctttcagaactcaattccaatgccccaaattacagtaggcaaaagcactcgggctgtccaaagatctgagcggatagccaagggactaacttagtccacatcagccatctagcctagctgctcttgtgagttctttttgaaagttatttcccaggaagaagctctgccatttactccagaaacaggttcattccttgaaaacttcgaaagaactgggtactcaagcaaggaagaaatttttaaatttgaggatgagcagggataagtgttcattattctgttaactaaacatgaacatttttggtgtactagggtcaaagtcaactaagttagttgactggtgatcattgagcaccatgactacgtactgttctccttgccttttaaaaattgatctttctgccttggcccagacttccctgtgttctctttatctaaatccagcaagtatgttttcttgaaaaatgcatgccatttggaaaggaattggtaagaaaagactatgttgaagctatgtttggcaaggggtgaaggtgtgcaatgaaatcaggacttttcaaagtatagaattccacattctctttagatattacccttaaaggcttggaaaagacaactgccatggttaaacctgcctgtcagcctcactcttctttttttttttttttttttttttttgagatggagtctcgttctgtcgcccagtctggagtgcagtggcgctatctcggctcactgcaagctctgcctcccaggttcacgccattctcctgcctcagcctcccgagtagctgggactacaggtgcccaccaccgcgtccagctaattttttgtatttttagtagagatggggtttcaccgtgttagccaggatggtctcaatctcctgaccttgttatccacctgcctcggcctcccaaagtgctgggatttgggattacaggcgtgagccaccgcgtgcagcccagcctcactcttgagatcctatgggcccagaagtctttattctgtgacaagcctgcagttacagcttctgggcagcagaactttggaaaaagcagaacgttccccaccagctgaattccctggtacaagcaggttctgctgttcctgctgattgtgctgggtcttcagatagatccgtgtgtctgggttggctcctgctggtgctgggccaccatgtgatgtcctcattgcctacttctgcatggcctctccatgctgcaagttagttaggggagcatcttatgaggaatcagactcagccatgcacaaaaacagatgcatagttttcaggtgacagagaggaggtgaatcaaagaacctaattcttgcaagttccttggtaagaaataggaactaatcaaaaccaggcttgggagcaggatgtcctctgtgactgctggggttcagggcagaatatgactgtgtcttttaccagccatagttacttgctgtgtacttccctaaggagactggcatttcagatctatttgatctttgtgtgctacatacttatggggtggaaggctaggaggtgaggtggggcagggagagagtgtatggggcagacaattagagcaccaaagaatatatgtgtagttcttgtaacgagattttctttctcatggccttgaaggtaaacttaaaagggttcccaaaatgtgtgtgtatctaactcacaagtattaccagtctctcttttatttcccattactcaagtataaatctatgtgcgaggtggctcatgcctgtaatcccagcactttgggaggctgaggtcagcagatcacttgaggtcaggagttcgagaccagcctggtcaacacagtgaaaccccatgtctaccaaaaatataaaaatgagccaggcgtggtgtcacatgcctgtaatcccagctactcgggaggctgaggcaggagaatcgcctgaacctgggaggcggaggttgtagtgagctacaatccctactgcactccaacctgggcaacaaagcaagactctgtctcaaaaaaaaaaaaaaaaaaattatgtgtgatggtcagggagaatatatgctaaaatatgacagtcacttctctggattcatatctcaagcttcattcctgactaccacttgctagctttgtgaccaacttacttcacctctgtaaacctcagtaaaataggaataaagttataccaacctcataaaaatgttgagacagggcctggtacataaaaagctcccagtaagagttattattgttgttgtcattacaacattacaacattacagttgctcttttgttttaagaaaaagcttagaggctgatcgcttgagaccagaagttcaagaccaacctgggcaatatagtgagaccctgtttctacggggggaaaaaatagctgaatttagtggtgtgtacctttagtcctagctactcaggaggcgaggtgggaggattgcttgagcttgagttcaacgctgctgtgagctatggtcatgccgctgaactccagtctgagtgacaaagcaagaccctgtctctaaaaagaaagaaaaggccagaaagccttagtagaattatttgtgagttgctcttttgcagcagttgtgagcctgaaataaataaccgaacacacatgataaaattgctttctattcctagctgggatttttttcagttacttccttagaattaacatttctcttagaaacttgaggtcaggaataatgagttttcagtagtccactatgattcgaaaaactaaagagtaaaaagtccatcattaaatgtactgagtgaataaaattacatgtattaccataaaaatgttttccttctggggggaggtaatcttcacacagccaagcccaccatgctagtagaaatgtatttgaagagaggatcttggtggagaattactattcaccataattttcattcttactgttttaattaacttttttcctttttggccttaaactctgcttgccctgtaagagcagagttctttctttccttctagagttttcatcatcttccagttgtgttcataggtataaacccaatatcagcaactcatccaacaacttgacttacctttaagcaataatatttgacagtttctcagacttgtttgccaagcagtggtatttctcatttctgagctaagtttataatctgaagattcatatcatcacattctcccacccctggggccttcaaaggaggagatgaaagaagaagggaccagctcttggtgtgcgggtcacagctggaaccgcacaagtccgtgcactctggggctgacaagcaggatgttcccttgtactgagaggaaacgaaattgaaaatgcaagtctgagctcatttctttctggtgacttgtgggtcgcttcagatgtttgcaaccttatcccaatgctgtgtgaagaaaggaggtcattgaaggaggccctggcttaggcatgtcctctggtgagtgattttgttcggttcagtttggtttttaaatacgagtgggtgaaggctttttcttttattttgagaaatgtggaaacaaaggctctttgatttaagacctcagacttcatgcatagagagagtaataatcacccaaatcataatatctgaccaaaattttcaggacttttggaatccccattcctggctttttaaaagttagacctgaaatccagaaggaagatttggacagtcagggatgacaatagctgtattctgagtgcatgcagccttttctcgggttctttgggtgggaggaattgcagattcttttctctgcctcctgtcagcacggctcgccacagatgcccaagggaaatccatccggcctggaaaatccagaagcacagccaaggcatggcttgctttctctggaccacagagtggtataactatttatgataaataaacaggaaacaccaatttatgctttcccactcatgatgggactaaactagctagtttggagtgaaactctttgggcttccttgctgcttagtctaccttgcaatgctacagtcttgtgagcaccaccattgcagagatgaacagtttttttccttctgagctcctctgggtatgcaccgcctgggatgatggaagggcttgtggatctgcctagtccataaaagttaaagcaagcaggtttacctgcttttctcagcgtgggctaataatatttacaagaaaacttttctggtttgttttatattttaaaattaatttgtgctgattgtagaaaaaaatgtaaaaagaatcaaaagtgattcataatcctactcccccaggaataaccacctttctagattttctccatgcccataggttcatggaagccaatattgggttgatacttgcattcgtttctattgctgctatgacaaattaccacaaatatagtagcttaaaaaatatgcatttagccaggcacagtggctcatgcctgtaatgccagcactttgggaagctgaggctagagaatctcttgagcccaggagttcaagccctgggcaacatagtgagaccttgtctctaataataataatttttaaaaatacacatgcattatcttacagctttagaaggcagaagtctgaaattcatctgctatggatgactatctgaccaaaataattttcagaacttttggaatccccattcttggctttttaaaagttagacctgaaatccaaaaggaggattgagaccagcctggtctcaattgagacccctgtcccgcaaattcgtatactgaagtcttaaccctcagtgtggtggtgtttggaggtgggccctttgggatataattaggtttacatgaagtcacagagtggagccctcatgacaggatcaatgcccttgtaagaagagatatcagacagcttctctccccaccatgtgtggacacagcaagagggcagctgtctgcaatccagggagagagccttcagcagaaaccgaccattctggcacctcgatcttggacttccagactctaaagttgtgagaaaataagtgcgtgttgttcaaaccatccagtctatggtattttatggcagctcaaacaaacctaagactgggctaaaatcaaggtgtcagtgggtagtgttccttctagtggctctggggaagagttcactttcttccctctttcgttctgtatgctgcctacattccttggctcatggccccttcctccatcttcaaggccagcagtgcagcatcttcagatctctctctctctctcgctgaccctcctagttccctcctacaattacatcagacccaactggatatttcaggatagctttcccatctcaagtacctaaacttaatcacaactgcaaagttctttttacctctaaagcaacgtattacaggttttggggattaggacttggacattgttggtgaggccattgttctgcccaccacaggaggcaacatatagtgttcatcttatgctgattgagtgtctgccatgtgctatgcacttttgctttctttcacacagttaagaagtggtgaactaggatttgaacccaggcagtctggctctcccgcctgcactcttgaactcctgcaatatatctacttctgcagtctgctttttctcttaatatagtttgaatattttctcatgaccttaaccattcctctaagtttgagagtctaaaacatcatttataatggctaactaatacttcattgcctaaatgagccatagctaacttaaccattcttcaataggaagatatcttggtgtagttaaaaaaaacacagtgctgaacgttcttgtacatgagctgtgtgcccatacttacttattaaatgaacttgggccagaaaagttccctggaagctggttaactactgtacattagacaacagtatttcctaaactgtttttcttcttttttccccttctgtattcatttacttactttaaaatttttttccccttctgtattcatttacttacttttaaaatgaggtctcactatgttaaccaggctggtctcaaactcctgagctcaagtgatcctctgacctcagcctcctgaagtgctgggattacaggcatgagcctctgcacctggctttttttcttgaggcacttaatagattctatgaagtgaggttttctggttaactaaacttaagaaatgctgcactcccattcctgaattagagcttcacaatcatattagcactaaaaccagaagtcctctggtaaacaaatccctctctccctccttgttttctttaacccagagtttcccaagcttaatttgaccaaagatttttttctttgaggcatcaagtaactatcctacaaagctaaggtcacaggacacaatgttagaaacacatctttggagtcaaccaagtgaagccacttaccctcaaactccttcaaaggcttaagtctaaaattactccagatggaatagtttgaatatgatcacgtttatgaaataaacttaaacgtttcctatcctccactcggaatttcagtctaacattgttgtagtggttccttacgttccttatagaggtcacattatacctgttccctgctctgtaaatgtcagggctggccatcagccaagaccaatacggacctgccctgaggtctacatggcactgtgtgttcatgttgttgtttaaggatagtgaccgatgtccttcaagagagccgttctggccgggcacagtggctcatgcctgtaatcccagcactttgggtggctgagacagactgatcacttgaggtcaggagttcgagaccagcctggccaacatggtaaaaccctgtctctagtaaaaatacaaaaattagccaggcatagtggtgggtgcctgtaatcccagctactcaggaggctgaggcaggagaatcgcttgaacctgggaggcagaggttgcaatgaacccagatcactgcactccagcctgggcaacagagcaagactccatttcaaaaaaatgaaagaaaaaaaagtgttctatagagtgttcagtgcaggtgaggaactggatggcaggatgttctcattgaaaatggggcagatttcaggcatcacaagctattgaatcattacaggtgaataaaccaatagcagagcaaagtttgagggagtaagcaaagctggacctggggttactggggaagttctgggtgagatgcacactggatcagtgaaaaagaagcaccaaagataaccatcatggtttggggagtctaatggggcatgtcctcttggccaagggacttcaaggggccttatggggtcatgaaaaagaatgtgattgagctcccaggcctgtggcacagactatttgcatcacattcatttaatgatcttcaagacccaaacagtggtgctgtctgcagtgtccactattgggggaagagcatccggagtgctgtcaccgtcctaatggagaggacctctggctgcaaactctggacctctgaggaagttgtcaggtgtggaacaggtttctctccagccttttggcagcctgtgtgattcctaagatggcacccagaattctggtgcctggtttgaaccatacttggggaggatcatcagagatcacagggcccagcagaggagcctggctgagctagcttcccttgatactgaccagaatgatggccggaagtctggggatgaggcatagtgtcttctctctctggggacctgtgatagcctctcctaagggggtagatagaaccagaacatgggctcagttatccaaagcgaccattctcagcccccttgttcctggaagcccctgctccagaactgctaagccagcctttctttcctgctacttctctgacctctagtggctagaactggaaaaacttgctcaagggatgaaatcatcaataagcaggaaatgtctttgatgttaaatggctgtccacttctctatagtaatccttcaccctctttacaacattctttctgcatacatcccatcatttaattcagccatcatcaacactgggtttgggctccagactgtgactgtcactgtcttatgtaacttgggctggagttggcatctgagcctctgtggtcatgacatccaggtgtcacgacatccaccctaactacattccagggttgttgcaaggctcaaatgacatgaagcctacaaaagaagtggtatataaatccgcttgttactccaaagccattgagtctgtgattctgtaagcctaaaatgttttaattcatatattttggtgaaggcatttaagccctttcctctgattctctatgggagattctgtcccaatccataagcatttacttgtggttgttatatatatttcataatggacttactgattactcaacaaacatgaattgcctacctcgtgccatgtaccacagctactgctgggatctggcaatgatcagacaggcaaggctctaccctaatggagtttgcattcaaatgaattaaggggattcatagacaggtgaaacatacccccctgtcctcaggatgacattatagcttaattgagaagacaaaagcttcaatagccagataagatttaagtcagtatgtgaaaatggccttcacagaaatataaacaggagttccactgtgctgtgtgtgaaagggagaagctagaagcaatgaatataggctgtgctttctaggtgtttaactctggaagagtggctggtgggaagtgatctggacacttgagaggtcaactggaaaatgatgaaaattaacctggtaattggtgtctatttctggtcccagaagagatgcaaaaattttatgcagaatatgcatgaaattgttcatctcaccctatagtcacattattctttgagattccaattaagtggtagctagaatcattagatgctttctgttctgaatattaaccttataaatattaactttgtcctcataataactatctgagggtaggtacccttatcatcatacccattttactgatgaggaaactaagatatcaaaagagtaagtaacttgcccaaagtgatttggctgccaagtcatggattcaagcccaaaccggctggctccagagcttacacgctcaccactgtgctatattgtttcttaagccttcaattaaaaagtcaatcggaattttcagagatacatactaagtgtgcaggagtgaggtgacctgaggtctgggattggtttaaaataattcagcaagtctaaggaaggaaggaagagccaattatgctaaaatcttgataaatgtttactctgggtgatgtttataatgtttataggggtcattatagcattccctaatttccgtaataaaaaataggaactgtttctagtgaacttggagattttgaaatacttattattgtactgttaatatcaaaagacttttcagttatctgggtaatttagatcaaagcaacaaatttcactgttattaatgtaatgtggccatgaaatgcagtgcccttttctgtatattaaaacctattttccacctaatccccaagtgtaacagctaaataccttaaaaaaaatcaagaagggtgtatcctgccaaacatatttgatagaatagcaaaacgtttgagttagaagagaccacaaagataacttcttccaaaattcccatttaaccgctatggcagttaaagctaggagaatttaagtgatcagcccacgattgaaatgggaatatgaaacgatgatctatagtcagtcacgtagccaagtactggaagagcaggagttaaaaacctgggtttcctggactccaggcctttgtatctctcatcagaaggaggttgtgccagtaaagggctaagcagcccatatggaaatgtggacaccaggcttcacttgtgattcctgctacatcaggcagttgccaagttagaagcctgggatgtaagatgaagaaaggtgagtccccttcggcttggaactggaagaggtcaaatggccctttcccctcccaaacggagccatgcaagccccatttatcttgtgtgttttatccacattccttgttcacaggttttagccgcatcaaccacaaagggcataattggaaaaatcataattgttatacttgaagatacttctcagaagtgcatttggggctctgtgtcaataaacccaccccatgaagggccagaagccagggccaggcatttcttgggagggagggatggaaatggtcttggtgagggtgcgtagagtcaccacaccactgttgaattaatcactgacctcatctctccatcctgaggattcttggaggacattgcgagagctaaaatctcctcattcccaaggctggtgtgcaccttttccattgcctttgttggtgtacacttcttaaggtctgggaggcctcaaaccccaatgtttcaggaccccagcaggtgaggtaaatgaataaagctggccagtgtaagaccggggcaaactgagaagaacaaacttcatccttattcaaaggttttataacactgggctgtctgcacaaaaagcctgggcaggtcagcagacaattgacttcctctgctatagaggatagaccctggtgaggaaagcaggaggcctgggtaccatcactggctccctatgacttgagtacagccttcccttggcagagcctcaagcgctttcatctgttaagaagtgggtctgtgagtctccaaggtgccaccacctctgacagtctaattctgtgatctgtgatagaatacatatctcaaaacaactggagccactgtcggtctgtccaacatatatttgcaaaatgcgtgctgtgcctgtttgatctaactgactttttggaacttggtgtccttgagatctttggatgggtttgtgcattaaccttaagtgctttgatccctgtaatataataaaatggcctacacttaaccatcattctggtaccactctctgtgtcagaggttgttgctcttttatttgccagttttctttctaaaagcagtcatgagcagacaagcttagaaagggtattttcttcgtgttgtttcagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagtgtaagtttttcctcctttcctctttcacttctctgagcgcggccatcggtgtggcgtgtggcattccagttcaggcacaaatgtgtatgtcgttgtctggtcagcattagggttccagtatcagttttcatatatgtggtttcacatgcctggaactgggtttgggtttttgcctgtttcaaaaaaaaattgttgatcttgcagggagctggtcctttgctgccaagtatagctggagtcgaccagcaaggctagtgtgtaagatgtttggtgcatagaaagacagcatgcaagggccacgcagggagaaggttgcaagtgccctgaaatcatccctatgcacctgggagctgatttctaccattgcccagtagagattttatttctctagaaaaggatgaagatgctgttccttcaaagccgacactctaggcaatccctaacaatgttacagtgcttaaaagactgagtgtgtttggggctgttaacaagcccatgtgcatagcttgaaagcaaagagccagtgaaaatgacagttgaaaaccacatggctactctgctacacccaagccctcggaactttgcacataacgttcaaattaactgtgaaggaagtcacatgctctgtggtttctttctccggttagagacataggaactgttgctctacacagtcccaggagcctggagatcagcctcagggttcatgccaacctcctgtgggtcttctggcaccagtctcttagcacatattgaagtcatcacctcctcccctgactgcacttaagtcacagatagcttgggttggttgaggatcctactgagtttacctgagacagtcctggcttatgcctgttgtggtgttgtggttattaatatccccttcaactcttttgttgttgttgttgttgttgttgttgagacagggtctgtctctgtcacccaggctggaatgcattgatgtaatcatggctcattgcagcctcgacctcctgggttcaggcaatcctcccgcctcagcctcctgaatagctgggaccacacgcgtatgccaccatacctggcttattttttaacttttttgtagaaaggaggtctcattatgttgctcagactgttcttcaactcctgagctcaagggatactcccaccccagcctcctaaagtgctgggattacagacatgagccactgcacccagcctgcctttcactcttgaaagtgtcccagtttgggtgataaaccatctggtcaccttaaacttgaatgctatgaagttcacagtaagaattccctgctgttttattgccttttatatcctagctggctaagttaaaggatttctggagttgaagcccagatgctgaaagttgctttcaaaatatatggcggtaaagaaaggaagaaagcaaatggatatctggcagcctggcttctcacttggcatctcccaggctttcccttttgtttacacctgaactgcgtggagcactggctcagctgctgtattaggctgcagctattctactgggctcttcactgtattagacagtgggatgatgcccggccctgggtagctgctgcagacatttccactgctgaacctcactgtaggggagccagcagctcctttcgtgagcctgcaggatttttccctggctactcagtcactttcaccagcccttctttgaagccccacttcaaaggataaagtttgccttaagaattttctgaaagttaaatcattttgaaacttggtgctctaggtgtctggtttcttttctcccagtgactctgctctatacatcagcagttttggtagaatttagccaagtgggtgccccacactctgatgtggatggggaagaacaagtagaaccacttagcatgtgacccacgcgagtgtttgctgaacacactctacttgtcacttgtgtatgtcttttgtgttggagtgcagatgatagggaaaaatactccatacagaagggtagaggcagttctcactcatttcgtaaaggcagagggctggaagctcttttgtgcacacgctgacactctggcagccacctaacaaatgccaaccaggttgagtttttcctctgcatgaatgaagctgcttggaatcagcgttttaatatgctgattgcccttcacttacaaatcaaagaggcagcctcctgtctctatattttccagtaaataaacattttgaaaaagaaagagacctaactaattaagctgttaatatccctggatcttggattcaaagccaaatgttttgcactgttattgctattacaacagaaccaagtttgctgttgttgaaaattcttaggatcaggacaaaatctaccaatccactatatgctcatttaagagacccaaatctaaaacaacaaattcagattgcttctaaagcaaagatatgatcatcagtcaggcttcaaatgagagccttctcctagcccttccaatttaggggaccttttctcctgtatctgtgtcaatcactggtgaatgtgttgaagtttacctgtagggatgaacaaacattcatttttttcctaaccaatctgtggccccttttccattttttctttttctttaataccagaaggatagtaatagagagcagatggattgctggggggatgagttgtgtaactggcttacctatccgtagaagcataaagttaattctcttaaaggtaaagtaattctggtctctagcctccatttacatacactattctcacagagaaacatggcttcttagactctccaccctctaagcacctcagtggctcacacctacacacccagcatctccccatgttatgcagcatcacccctggcacctccatttgccaatattttttccagtaagccacttggcagcattttggcatgccgttttggagatgataaaccacacctgagaatcaatgcctgtcgcgtgattagaacacaaccatgtgtttgcccatcgaaagtaacagttatttgtgaattgagcaaaaataattcttattttttattctttttaaggagaaggcagagttaaaaacaagacaggcgctgatcattggaatgtgtataaagtgtgatatgttagacacaatggtatcgaggagagtgaaagacagaaggagaaagatagaatgtagctacggctgaagttttgctgagtgagaaaaactgatctttgccatcaaaacaagttcagtgtcccccgagcccccatcaggggtgtggtggcctctggggtcctgtccacagggactcagctcagggccctgctctctccagttttccactttataaaaagtcatatgcagagaggcccctggcttatgggagtcagggagtggtgttatccaaaggttgtccccaaccagccatatttgttactagctcagaacttgagcaaagtactccctttagttgccacagtcttcacccacctgggctgatttctttgtcctgtatattggagtcaccaatgagtatctccagcctcacttattaatggacctcttggctaattctgagggcaggaggattaccatccccacccctacccacttacccaaggctgtttaccaacctatgcaaggcctttgtgtgaattaggaaaaaaaaccacccttgttcctctatgaagatatgaagatgcagccctgcaccagccacacatttggggggtagagtaggggactgggctttagtaccattcatccctttagtctgatgcttttgtgcagtgcacacaacacacacccagatgcagcaatcctattcatattgtgggtttctcttatctggaaatgttctcttatgtggaaatgtccacttatctgggtctcataccatttctgctcagtcatgcaattcataatggactagtgaatcctagtttcctaaagggcttcttgatgccttgcaaagcgactgcctccaaggtggggttgcccactcatggacctggaagacatttggatcagtgggcacaaatgatgggctatttggatgtttttccttcaggcatgaagaacccctctaggaaactctgattcattagtccatcctgagtgacatgactgtatttaggcaaacagtatttttccagccaattgtttccctaacctgacctgagcctcagaaagtgaagatgatgggtcattgagtcaatgatgctcatgaacatctcgagggtttgctttgcctttctcagttgaagggatgctgaccagagtccaaatcacagcctcctggatgttcagccccatctttacttttagcgcaggatctgccctcagtggggttttccagtgtgctctctctctctttctcatcccatgacttcattactgagaggtcatccaaccactctgtctcatcttagaacaagagaagacctcgtcggttttcctgggctacgtcaaagctgagagttcctggcacacattacccttccagaccaggacatgcattgagagttgtggccatactctcgctcagtgtgtgaaggaagcctatctgcctcctgtttccccagacgctacaggaagctcagtgatgccttgtgcttccctaactctctcttacgttctcactcgtaccctagtgaagatgcaaaggagagagaagagctcctgacttgtcagctcccagccattagcccaatcatgacagaactataattcctaagtgctacatataagaagcagtcagcaatcacagatgtgtgatcccacctaactagtctatggctatcaatgccccaaaccaataaatgctttaaatgccccaagcagtgtaaatgtacgctcattaccataattctggagagggatgtcccaaattggtcctgccatctcattttccatagtcaggccatttttttctgtactttgagtaagacttttagtcccctataggaactaaaggatcatttcagttcctaagtgctcatactaataatcctatataatcaccagaaattgctatcaaaggatgatcccactctcaggaacttacccaggcccccagggttctgacgagggaggctgtgtggtctccctaggcaagactacccttaggccggtttcagagaatctgcctccacaaaccaactgctgtgattaggatcttcttttaatggaacaacaggttacaagacggctttggggttcagagaagcctacgggaagagaaaaggctatttggctacagactctagcaaatccaaaatggcccccaacgaccttgctggtgggcagctgattgtgtacagaggggaaggaatcttgttaattcaaagtacagaaactgaaagcaacgttttgaattaacaaagtacggcttatctgatatttttattagtgaacaatagggtatctagttgctgcaaagaatagacttataaataaactaatatcagatggagaaagttttggcatgggtgtagaatggcctcctggtattacttcccctcccatcctcttctggtgtggtgcctgttcccggctagggggtgttctgtaagtgtgtcactgccatgtactaaccctggtcttttccctctctgccagtacacttctaagttactgtcttgcaaggtgacttccgaggtacttttcaatttgtttgtcttggtcttactgaatgcatgatccaggtgcatgctgttgtggtttgccatttcctgatgagttaaacgaaaatggcaagaaaaatgacttgtctccatatgtatttttttgtgcctgttctgaaatatgggactgcctcgaaatgttggagtccatgcaacagtgatatacaatggtgtggtttgctgtgctgtgctgtgggggcgagtgggagggtactggggaagaccttgcctgctcacgaatcttgaagacgtttggaccagaggacacaagtgatgggctattttggtttttaaagtttctttaggcattaatagcaagtatacttggcctggttggaaaacagtgcagctcatgcagattgagctatggattttcacccattctttgtttaccttaacataaagctagaaagctccattctatagatttaagatgaaccatcctaatctacagatttatcaaatgtaaaccatcctagacctccctccctccaatctttaaacgtgtatttttattttagaaactctaagccttgatttctccaaaagcctccttgtttaagagacaaggtcttactctgttgcccagggtggagtacagtggtgcaatcatagctcactgtagccttaacctcctgggctcaagcgatcctcctatctcagcctcccaaagagctggaactactggtgtgtgccactatgcccagctaatttatttttttatattttttttgtagggacgggggtctcgctatgttgcccaggctggtctcaaactcctggcctcaagtgatcctcctgcctcagcctcccaaagcattgaggttacaggtgtgagccactgttctcggtccccaaaagtcttctttccttttacacagatttcacaaatatatgtgctataaatatgtgtgctatgagaaggcataatatttttctcttttaatttttttctattttgtccattttttctttttgctgagaaagcacaatatttttcatatttttatttctgtattttattttgattttaaaagaattatttcaaatatacagaattctagagagaatcattcgttcattcatttaacaattttcaaggctctactatgtgtcaggcattgttctaggttccaagaatacagcagtcaacaaaacaagttcctgatatcatggaactggcattcagaataatataagataataaaataataaaacccacctacccagctttgtccattcttatcatttcatgatatttaatatttttaaaagaaattagtattgcaaatacaatttaagccctctcgtacttctcccagttccctcctcccttacaatctcgcagaggtaactatttttgagcttgttgttcatcatttccatgcatggttttatacttatactacaaatgtgtatatacataaacaacaccttatttttgcatgtttgaagacattctataagcggtaaatcatgttgcagtatcttctgctcctgactttgttctgtctgcattgttttgagatgtgtccttgttgatcactgtggctctggttcattctttataactgctgtatggtattccattgaatgaatatatcactatttattcaatcttctgttatggaaatgtagactatttccagtttttcttaccgttagaaataatgcttttatgaatgttattatacatgtctctttatgtacctatggaagaacctgtctctatatttaggagtagaagcactggctagtagcctgatacatcctaacatttactagatattgtaaattatttttcaagttggttgcattaacctgtagcataataagttttttggtctctctatttagccaaagaattatatttaaatatagagctgacctgctgattatcagtaattttctttcataagatatcaaatgaatactgagaatatcattctgtaccttctttaacgtctaattgtggttctcatctggaggatggcagtttgagaattaggactaagcccgtctcccctttgagtccatttaaaacaatgaaaatctggtcaaatatatccaaggaagatagagttgggcccactctgtcttcaatttaaaagcaggttggaagatgaaatataaatattaatatgaatagggtgatattatttaacatatctgtcttttgtttcatatgtccaaattaaaattttctatattgattgctttcaaagttaagcaattcacttgaattccctaagcattagagagaaaaattaatattaaagggttgttgagagataattgttttttattccctaccagacctgaatgtgaatttgtgaaaacaataaaactttgtttatttatttagtttacttttttttttttttttttttgagacaccgtctcactctgtcacccaggctgaagtacagtggtgcgatctcagctcactgcagcctctgcctcccatgctcaggcgagtctcatgcctcaacctcctaagtagctgggactacaggtggcagccaccatgcccagctaatttttgtatttttagtagagacaggttttcactatgttggccaggctggtctcgaacacctagtctcaagcaatctgcctgccttggcctcccaaactgctgggattacaggcttgagccactgcacccagccacaataaaactttaaatcagatcgttttttgttttcccttttccatttccatggggagtgttgattgctcttctctggtgtgtctccttctggactccttacagccattgggcagccagatagtctggtggcctcaagcatcaactctgcacccagagtgcagagttcaaatcttggttttgccttctgctaactgggtaattctgggcaagttacttaacctccctgtgcttcaggttcttcatataaaaaatgggagtaataacagcataaatgtcatagactagtagtgaggattcaaacagtaacatcgtacttaggacatgagtatgacattattagagccccagagacatatgcctttttgcccagaaaataaaggaatgaactttagaaagtgaagttaatatgcagtaataaacaagtaataaaagctctaaatttgctagagattcacacacacacacacacacacacacacacacacacacacacacacgtctgaattaattacagaacagatactcattcaaataccttgatttttgaatcttctgaagaccagttgtggtgcagctttactcccagacacccctgggtcataagccttatgaacccaaagacagctttatatcaagattgccaggtatttcagtaaggatgtttattttcttgtctgtgccattactagaggctttagatttcactagaaatttattgtatggccatggtaagtgattgtatgaccatggtaaatgggcatacatactaggggaatgaattaagaaaagagagctcattgttggtataagtgaattactggggctcttgacaagtagatgtccaaacccaagctatactaaacgtttccataattatgagtattatttttctgcccattatacttttcgtcactaaactccatgagggaagggactattctatcctcaacacgaagcactgtgccttatacttggtaggaaactaataaatatgtgtaaattggattgatagatggcttgtaacaagagttcctaaagagcagagcaaactcaatttgctcaagttgtttgagaattaaaatagggtttaaataacaagacaaagaacattccaagaggatggggaccatagtttttagaactttagatttatttttagctttgatgtaaacctttctgtttgtatctgcaatctgaaaggcaaagagatgatccttttatacaatgtagagttctttataaaacgccctatttgtatgccacttcataatttatatatccctttcacatgatgatagaaataattattccatcatagtttgagagcttactatgtgctgggaactatactttacatacattgcctcattgatttatccgtccaactttatgctgtagtttttatgatccccattttacatggggatactgaagcacaggggtaagtgacttttccaaggtcatgaggatttgaagtagacctgcctggacttctgagtccacagtgccttctgagaaagcctgtgaagtggggtagctgtgttctccatgttatagataagaaatgtgagataaaagatgaacaacaaaggacaaaactggaaatagagcccaagacttccacgtgcagtccagtgctgtttttcagttccatgctaccacacattagactattagaaaatttctctatttaactatacagatttggaagcatgctttcctcctactaatttgttattcgtagatatctgtggatattgagtgagtgaccgtgatatgcttacatacaaaacacattatgcaaaacacacatggcttgtgtgcttaacaatgcatcattcattcagcaaacgtgactgaggaggaaaaggggaggcttcacagaggaagatatgttgaagctctgggtggtccattcctttgacaaaggtgcagagaagcaggttgagatggacccccgatctcccatctacccacaatctgcttatgtctgggctcccacctctgcctgtaactgcatctccttgcttctctggagttgccaactgtattagtccattttcatactgctatgaagaaataaccaagactgggtaatttataaagaaaaagaggtttaatggactcacagttccacatggctggggaggcctcacaatcatggcagaaggtgaaggaagatcaaaggcacgtcttacatggcagcaggcaagacagtgtgtgcaggggaactgccctttataaaaccatcaggtctggtgagacttattcactatcacgagaacagcatgggaaaactcgctcccacattgaattacctcctatgagtccctcctgctacacaaggggattatgggagctacaattcaagatgagatttgggtggagacacagccaatccatatcaccaacatcactgtcccttgcctaactgattatatttagaatgagcagtgccttcattgcagtttgcataatcaaccaatgttggctctactggacttttcttcaaaatcagaaactgtacatcctaagcaaatgccagaacaattggcaagaatgcctggacttgttttctgcatggtcatgaaatagaaccatttttcatatgttggcaacctaaatgccattaatctggaatctcttcttgatcaaactgaaactggaccagataggctgaagtctcctctcgggattccacagactgccctagtgaatgggaggaagggaggctctccctcagtggtggtgagcctacttgtccttagtgttgtcacctttcatttcattgattagcatgtggggtctgaagttgcatcagaatgctgagattgcttctattgatccaagaacttttttttttcatgtaatggcttttttagtttaattttgccaaagtaggtttttatactataaatatcatcatggcttatataggtttgcaaagcttgatggactgaatccacactggtcccattgtttggaattattttctggtttgcttgtttatgaagagactaagaccatctatagtgtgctgtctaatatggtaatcactagtcacatggagctattcaaattaaaattaattaaaatgaaataaaattaaatatttagcttctcagccacactagccctatttcaagtgctcaatagccacgtatggctagtggctaccatactggatagcagagatacgttttcatcattgcataaagttcaattggacagcactgatctgctgcgtgtagggatctgctttatctgaaaacttgatgcagaatcacggctagttcaaagaaacttgcagaacatttcatgaaaattaaatttctctatggtgaaaactaggggtcaagtagcagatgaatactggctgtgagatgaatgcataaccagaacctcccattcccctttttccagcgtctctcctatctcccagcagtgctttatcactttctcctctcaagttgataaagagaaaggaagaaagaaacagagaagtcggtttatgttcataattaacatccatgaactctgcataattttttcccctctctttacaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggagagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttat

SEQ ID NO: 36245 - DNA, 392213 bp, Homo sapiens; identical to SEQ ID NO: 36244

SEQ ID NO: 36246 - DNA, 162934 bp, Homo sapiens
caaggcggccggcggcgaccatggcagcgggccggcggcggccgtagtggcccaggcctgggcttcagcctcccggggccccagagggcggggcggtccgggccgcggcggtggcggcgccacttccctgctcccgcccgaggactcctgcgggcactcgctgaggaccagcggaccggcggcgcgaatctgactgaggggcggggacgccgtctgttccccgccgctcccggcagggccgggccgggctgggccgggctgggccgggcgggcccctgggagcagcccccaggcgggggaccgccttggagacccgaagccggagctagaggcaggcggtgggcccgggtggagtcccggccggagctggtggttcgggggcggtgctaggccccgaggctgcgggacctgagcgcgaggagcctgagtgcgggtccagcggtggcggcatgagccggcccccgccgacggggaaaatgcccggcgcccccgagaccgcgccgggggacggggcaggcgcgagccgccagaggaagctggaggcgctgatccgagaccctcgctcccccatcaacgtggagagcttgctggtaggtggccggggcctgggagcttgctcgttgcagctcacacctcagatcccctctccgcccagccctccgtgcccgtccgcccgtggggagggggaggtcttgccccaccccgccctgcttccggcagccggggccggagaccaaacgattctgtcaccgagttccaagagtagtgacccgcctttgattcctccctctacctcctgctggagccagtgtcatccccggctgctcctttcttgcagcactgggaggaaaacacccctcttctccttccgcctgcccactctggggaggtgggtggaggactggccatgcttcatacaccaggttagctgatttgaaagtgtcatgctacgtggggacttggtgcgagcgagggagaaagaaacctgatgctgtccctgttgcgagtactcactggggtacatgacaaagagccgccctcactctctccttttagtctgaaatcttggaacacacagctaaagttttgctgttttcacttgcgtttgagcattccatacttgctatttagtgcattttaattgctgtaaatttaattccctgagattattgcgccagagccaaaaaatcagtctgaattgtggagtggaataaatctgtcctcttcattgcgtctctttcctataacgacctttgaaatccagattaatagcaccgtaaaggctgctaattggctcttggttaagaaaggagcatgttttacaaaatagaaatgcaccgtagaatgctggcttatttcttatttttgttaggatagatgattgtatttcgcaatttgagtagtgtgcagtgtagatgcatttatgggaaaagggggtgtggacttttaccctggggaggggaagaaaggtgaaaacgatactctgtgtattaaattgactctggaagactagaactagggtgggaggtccttagatccgttagacattctgtgctggaatgcagatgtttagttctattccctcctggaataaaccttactgtatgatgagaaaaactgcctcctccctttccagggacggacggactggcttttggtcagaggcggttggttatcctttgaggtttcaggcatcgtttgcagagtgactcagtcctgtttggtcaaaatgcaggaactgactttagctatatagtgtctttctgcacagtgtacagaaagtaatgaatgatgtgctatattgtgtcacatgtgtttgatgttttactgtttttcgggttaatgtgttgttcctatgttttaatgggagcagtctttgaaagtctttaatcgggagtaagattgcttgcatggatggcatagcttttcctaggctaaagcggagactctgggctgcactcccagcattttcactttggtattttgctagcaaaactttgacctaaggccagaaagtttagttaaaaatagtacagcaaatctcaagtattcatcaggttcatgctaaatcctagatggaaacgttttgcaattcactttgatatcttagatctttaatgatattaatcataattattagagttattctgagcttgaatgtaagtagcttatacatgtaatatgatcatgcattttgttttattgctttccaaattattaaaatggaggctatttttaaaagtgaaacatctcacatgttcaggacacagttcattcatttagcagttattacagccaaaacacacttttattaaggtggcacattacggatctgagaattgacatcaggtgctgatgacttgacagactctgttattgctgtttctagttggttaaatatgcttgaggtgcagtaaacctttccaagccaaaatgcgtcccttattcctttggagcaaggttcctggtgtttctgttacaaattgataaacgaaatttaaaaatttttttataataaattaattttaaattacgcgtattttatttatgaactactagaatggattttttattgtggtagcgtatacagaatttaccatttttaaccatttttaagtgtacaggttagtggcaggcattaaatacattcacattgttgtgcagccatcaccactatccgtctctggaatcttttcatttttccaaactgaaactgtaaattaatgtttaaaagaatgttataaaaattatatttcctgaaatactgacgaaataatggctggtatcactttaaagatctgaaaccttagcatttaggttgcatttcactattggtcattgttttactgcctatgacatttattttttggttttgccatgggaaatacatattttgtctttaacagaaaatttaaaggaatataatttaaagcaaacacagctgcgacactacattcaggagctcagaaagtaccattaaaaatagtatatacctaagatgacaaaagaagatgaagtacaccagaaatgattgtatgatgctttcagtgggctaggcctagaaggtaaaactctgtaggaaacaaagttttatgagataacgtgtaaagtgcttagcctagtgcttggtacatcacagtgctcattaaatttagttcacttctcctgtgcacacttagcatgttattagttaactgctttaaattttcttttcaaaggaaaatggttttatttgcaactatttcttgctacataattttgagtgagtagcattatcatttgaatttgtcatcagaaaagtgctagcaatcattaggcataggtagagctggattccaagactaaatcagtgtaaagatgacatcttgtttctctgcaaaggctcatggctttatgtgggtccttaaattaatctgagaagagtatatctcttttatggttgcagattgtgagccgcttagtattacttagagttttgcttctctactgcctctttttttttttggaggcgagtcttcagtaatatgcttttgtagtgtttgaaacctttgggtaaatacctatgctttgttgtcaagaccagcttctcatactgcttacctattatggtaaaaagaactgtgtttcaggctttgctgaagagatatttttctaaaggtctgtgctttttgagtgttgatttattttactctttcaaagagtaaacagtcacaataacctgtaggactcacgcttgggtaaactcttacttaagacttgtgtggatgggcaaaggtgattaaaactttgtttacaattttcagtggcataaaacataaaataatttgattgatttcattatacttgtaaactatctgacaatattatctcagtgcttagactctttcagcatgctgctggttatttgcctagttaaaataaaattgtatgtgtatttttcccatcatgtaataagtaagaacattataaagatacaataaaaatgaaatagaataaaaattaaaaatcattttatacatttttttctttatgaagagtttggcatttatagtgtaaaatttgtgactagtttactttaaaactttcatgttgataggagatatttaaagaaaatgagttagctagggaggttttaaaaaaaaggtgatgtgtggaacttactgttgatgtgaagcaagtgcaggtccgcaatcccttatccacaattttgatatataaaaaacccagtttttggtaaaatgtatttgatgataacatctgacctaatctcacattagaatacttgtggtctagtcattcctcttgatgtaaataataatgccttttgctggaggaatatgaatgtatttgatttcagggtgttgcccagattttcaagagcatttttgggagtacacagtatatgtactgtgtacctttctaaaatccaagaaattctgagttcggaaacattttggtcccagggtaaggccaatgtagactaagtaaggaaatacggacttacatacacttcagtagctgtaaataaatagtggataattatcttgaaacctaacttttttgttttttatttcccaagtcttgatcagatagccctctttttcccattttgaattctaaaaatatagtatgcaaatataagttacgaagcgtaaaaacatattcatgaaatcaccacacaagttaataagtggaacactagcctgtagaagttacctgtgtgccgtcgccgctgctggattcagtcttcctgcatcctctctcatctgctaccctgaacattttattgttcctttgcttcatttcatagattactacatttgtgtgtatctctaaacaatattgtttagttttacttgtttttttaactttataaaatgtcagcatttttatgtattcttttatgacttgctttatttactgaaaatggtgtttctaagattcactaacattgtgggttattcatattctctgctatgataatcagtatagctccgatctacttaatggatatttacagttttctttctttcttttttttttgtttttttttttctgttatggaaagtgttgctaggagcatttctggagctcacgtgaataattcctgtagattagggtatatatctgggagtggaattgctggattttaagatatactatgttcagtcaacttaatataatggatagagttgaaaattttccccatgatgttattatagaaaatttcgaagtatagtaagggtgaaaaaatcgacagtgaacatccatatatttaccgcataattaatattttgctgtatttgctgtattttctttatctgtccattcctttatccatctatcaatacatcttttatttttggttcacttaaagtaaattggagatattagtatacttcaccttcaaacacttcagtatgtatttaattaagaagagttcaatatttgtttagattttttaaagattaaatttgcatgcaatgaaatgcacagatctgaagtgtaccgctggtgagttttgacaaatgcacacacctatttaatgcaaattcttgtaaaaatacagaccattattaccaactcagaaatctccttcacaccttttcagctaatttcacacaccattttcttctattagaggcagtcattcttctgatttttttttttttttgcagtaaagattactttgacttcttctatacttcataaaaatggaatcatatagtatatacttttctgtgtctggcttctttaatttagcattgtttctgagagttatctgtgttattgtgtgtgtcagcagtttattcctttttctcattgttgaattgtcttctgttatatgtataaactgcagtttgcttggatatctcgtgttgatgcatacctggactagttttcagttttttgttttcagaatgtacactggtcccttggtgttctccggggattggttccaggatacttgccttatagtctgcctacgtaccaaaatccgacgacgcacagtcctttttataaaatggcattagtatttgcatgtaatctgtgcatatcctccatatactttaagtcatctctagattacttacaatgcctaatacgatactgtattgttttagtttgtattttttaatttttattttttttccaaattatttttgatccatggttggattcatggatacagagtgctgagtgtattatatattttggcttgatttttttaaaatatggagacaagatcttgctctcttgctcaggctgggatgcagtggtgtagtcatagcgcactataaccttcaactcctggtctcaatgatccttccaacttagcccctctagtagggactacaggcctgtgccactgtaattggctaatttttattttattttatttttgcagaaatggggtcttgctgtgttgtccaggctggtctcaaactcctggcctcaagtgatcctccagcctcagcccctgaaaacgttggattagaggcctgagccactgcacccagcctactttggctcttaatacagttgttatgaaagttttcatttcttttgggtaaattaaataccttgtagtggaattgctaactcatagggcagatatgtgtttactttttaagaaactgatggccaggcatggtggctcatgcctgtaatctcagcactttgggaggctgaggtgggtggatcatttgaggtcaggagttcgagaccagcctgatcaacatggtgaaaccccatctctactaaaaattaaaagaaaaaaaaaattagccaggcgtggtggcacgcacctgtaatcccagctgcttgggaggctgaggcaagagaatcacctgaacccaggaggtgggaggttgcagtgagctgagactgggtcattgcactccagcctgggcaacaagagtgagactctgtctcaaaaaaaaaaaaagaaactgccagatctttttatgaagtagttataccattttatactcccaccaacagtatatgagagttccagttgctccacatcttccccgacactgctctttaaaatgtgatttcgatttgcatgatttgcatttccctcatgatgaatgatgtactttttcttgcacttacgggccatttatatattttcctttgtgaagcatctgtttgaagcaacatacctccatttttgcccattaaaaaacattgggtcatttatttgtatttattattgaatcttagaagttcttttgtatataaagagaacactctttgtcaaataaatgttttgtgaatgttttttcctagcttatggtgtatctctctctctgtctctttttttttttttctgaggtagagtcttgctgagttgcccaggctggagtgcagtggcacaatctcggttcactgtaacctccacctcatgggtttaagtgattctccctcctcagcctcctgattagttaggattacaggcatgcaccaccacacccggctaattattgtatttttatagtagagacagggtttcaccatgttggccaggctggtctccaactcctgacctcaagtgatccacccgccttggcctcccaaagtgctgggattacaggcacaagccgccatgcctggccccatatctctttttttaataaaaatttttaatggttgttgcttttctgcccaagtaattgtcgccatcctcatgtcgtgaagatattctcctttgcttttttccaaaagctttatggttgacttttacatttaggtctaggatacattttaagctaaatttaatgtgtggtgtgagttaggggttgaagttaattttttttctccacataattatccagttatccagactatcctgcaccattttaaaaaaattaagttttctcattggattgctttggcacctttgttaaaagtcagtttactgacagttggacttttaaatttgcttttctaccaccttagtagctacaccggatcatcagtcctggttctattgtttaacccatgctcaattcaaaagtcatttcttggctgggcacagtggttcatgcctgtaataccagtgctttgggaggctgagttgggaggattgcttgaggctagaagtttgagaccagcctgggcaacatggtgagatttgtcgcctctacagaaataaaaaaattagccaggcatggtggcacaaacttgtgatcctagctgcccaggaggctgaggcaggaggatggcttgagtccaggagtttgagactgagtgagctgtgatggtgctgctgcactttagcctgggtgatagaatgagaccctgtctctggaaaaaaagtcatttctttttagttttatctgtacctgagggaagtgacaaccaactatggctgagagggaaacatagattttattttttaaagtgaagaaagatttgtcattttttaaattataaaaataatatgctctcgttgtagaaaatttagggagcatagaagggtataaatgctaatagcacttatctacaatctccttccttagagataatcactgtttaaattaacattttggtttatatatcttaacttatatgtatttaaaaattacagtattcatgtgctttatctttttaaatatttaatgaatagtatgagttttatatagtcacaattatcaatcgtttcactgtaaagtgatttctggcttagtggtcatgtttaggaaattctctgttaccaggattatatcatcatatacctgactttttgttctcacatggctttatttttattgatattttcatttcatttggaattctgatggaaagtatgaagtaggagttcaaagattatatcaggagattgagatttgtctaggtattaaatttcccaaaatattaattgggagtttctgtttacatctctttattatactttctatttggagagtggtgattggggtgagaaaaaaggtttaatgattaaggtctaatgattataggttaggtctctatttgggcctcttgaatttcttcatgaaaatactatacaactatacttaaaactctaatttgttagtgataaggattactggtggagagaatgtggatgactcagtgcaacttacagcttttaaaaataataaaagaacattttcccttggtggactagcatatggagcttactgtttaataaattgatgtgaaatcatggtgcatttggggctcaactaaaactatactcactttatccttaattggagtcatttttctttcctctcatctgtactcctgcccccctttaaagtattattaaattatatagatattcttgtaaattctgcagttaggttttctaaatgaccctcacatatcttttcaaaaagcatttgggtcacaatacttagcatttctctcattccccgccttccccttccgtgtgtgtgtctgtgtgtgtgtgtgtgtgtgtgtgtgtgtgtgtgtgtgtgtatcagtcaaagggaactatttggattcatttttagttcattgtcaataatattttggggaatgtttctaagtccaggaatgattttatggtttggtacttcattttggtaaggtatgggctgtttgttcagatatctaaagtgctttataatttttttttgtcataggtgattgaccacttatattcaatgtctgaattcctttattctctaaaagagtttcacctcagatttctttagttataaagcaagtgatagacattttattttcaagggattatagacttggaacaatttctaatgtttaattattgaggtttctatgccatggaaatgaattagcgaagtgttctctagcagtactttatttagatagaaacgcgccagagcagggctggtattgtcttaattacctgcatgattgtgttgacaaatgcttaatatgctaagcattgccttcatatatgcttcttggcttttgagtttatttttatttaatgcacagaatatgagctcttttagtacgagtcttttatgttttcctattctgtaaatatttgttgaatgaactaacaatttttttttttttttttttttttgagacagagtctctctctgtcgcccagcctggagtgcagtggcacaatctcggctcaccgcaatctctgcctcccgggttcaagggattcccctgcctctgcctcccgagtagctgggactacaggtgtgcaccaccacgcctggctaattttttgtgttttagtagagatgaggtttcaccatgttggccaggatggtctcaaactcctgaccttgtgatccgcccaccttggcctcccaaagtgctgggattacaggctcaagtcactgcgcctggcctctttttttaaataacaggagtgataacctgtagaaatatctctacttgaagagtcattaattaaaatacttcccagataaacattttgatatgtgttcctgtcactaagttcttatctatccataggaaagaagataagtaaacatctatatatgcagggaggatgggtttagaagtagaattaatttggagatcatgtaggaaaagcaaattgtgatttggatattttccggattgttgtgaaacagtttgtcttggaaagaattaggtgaattttattcagtgttttaggtgaagtaaagatacctcatgggggctgaacagctttttattatttatatgtgtcattttttcccccttctccttaacttttttctggttaaacacatttacttctttttatgtacctagttatgcctgtgttggaattgcactttatgagcagggcagatgaaatgctggtggtgtgttcacaaggtgaaatcctttaaaatagtgtattggctgttattaatagtaaggcaatatttttcaatagtactaaaaattaagttaaagggcatgagatttttttgacaggaatcaagtgtgtcattgcaagtcacgatgacttgagaatttgtcaggtattaagcattctggtttctcatgtgttgatttggctttaaactgtttcatgtttgtagtatttctttttttttcctaatacatgcaggtgctttttttgtgtgttctctggaccatatttaaaacagttacagaaagaatggaatttagagctgtgatagtttttcttctatatctactagtggtattcatttagcagacaaagaagagtgatacatagtatcttacttgtaataagcctttcatattggttgaacaaataaatacagccagcagatgtagtgcaattggcaaaatgtgtttcagtctcttattagctcttagaatcagctctgaaataaaagtctggtggttgagaatgagcaggtattgaatatatagagtcaggcatcattgtttactagcattgctagttctttttattttcaactgttttattgaggtataatttatacaccattaatgtcttccattgtaagtgtacaatataatgatttttagtaaatttacaaatttgtgtaaccatcatcacaattcattttcatcaccccccctaaattcccttgatcttatttgcagtcaatcctgaatcccatccccagccaaccactgatctgctttctgtctctataagtttgtctgttctgtaaattccatataagtggaatcataaaatatgcagtgatttctacctggcttcttttacctaacgtaatgtttttgacattcatctgtgttgcagcatgaatactatgttctttttaattgatgaataatattccatggttatggatataccacattttgtttatgaattcaccatatgtgagggcatatgttttcatttctcttggacagattccaaggagtgggactgcagggtcatatggtaaatttatgcttaacttttgagaaactgcagactgttttctgaagtagccctaccattttacattctcactagaaatgtataagggttccagtttctccatattatcacaaaacacttggtagtgtgtgtcattgtaattatagccattgtagtgcattttaccaatgacaaatgatgttggccactgttttatgtgcgtgttttgcttgttcttttgatttttgctaatgtgtcatgagtgtggcctaatttggatcattatatttaagttgtttttgtttttatgctaggaaataatacggtaatcaactggtgaaggagttttattttgtataccacaggccaattccagtgtttggaattccaaaaatagaatacaaatacagatcagtgccctctgaatgtggaattatcctactgataagtgtttatacctgaaaggcctagttaatactaagcatttttttaaaaccttgttatgatactttttgtttccaaggaatgaatgagtcttgctgatctgtgtaggctcttttttatttttttaattaaaaaaaggttttttttttaagagatggggtctcactctgttgtccatgctggagcgcagtgtgatcatagctcactgcagcctagaactcctggactcaagcagtcctcctacctcagcctcccaagtagctgggactacaggtgcatgccactgcacctggctaatgggaaggccctaataatggcagtggagtctactagttgggttatttctgtttctgttgttgttgttgttgagacagtctcacactgtcgcctgggctggagtgcagcagtgtgatctcagctcactgcaacttccgcctcccaggttcacgtgagtctcctgcctcagcctcccgagtagctggaattacaggcgcctgccaccaggcctggctaattttttgtatttttagcagagacagggtttcactatgttggccaggctggtctcaaactcctgacctcgtgatccacccgccttggcctcccaaagtgctgggattacaggcgtgagccaccgcgcctggctaattgggttatttctgagctacagatgttaagggcttctgacgtgcacatgacttttttttttgttccattctgctctgtgttcatcttccatcttttgattgttttgaacatgttaggtataagcttataaacttatttctttcccttttgttgacccaaattttatctttatacttctctgttaaaacagttactagtattacttcaataacttggttcatatagaggataggtagctgttggtgttttaagtactattgcacttggcttttggcttgtttttgagtattcattttaatttgccttacagatacaaaggttgcctgttcttgttcacaggtggcacaggtgccatgttcttgttcacaggtgtatcagtgtgtgattctactcttttgctttgtatttaggtgtgaatcctctagaagtcatactcagaatatgcttattgaaattgaagttttctttttaatgttaggttagataaactattttgagtttttattaaagataactacatgtggtacctttttcttttttcttgagtagcaaaggaaacttagaaaatattatttcttcttcttctcctcctcctcctccctcctcctccctcctcctccctccttctttctgctccttcctccctcctcctctttccttctcctccccctcctcctccctcctccctcctccctccccccttcctccctcctcctctcctcctccctcctcctctctcttcctcctccctcctcctcattcctcttcctccctcctcctccctcttcctccccctcctcctccctcttcctccccctcctcctccccttcctcctctctcctccctcctctctcctcctcttccctccctcctcctcctccctcctcctcctccctcctccctcctcatcttccctcctcccttgtcttcctccttcctcccccttctcctttttttgagacttttttgagacgcagtctctgtcacccaggctagagtacagtggtgagatatcggctcactgcagcctccgcttcttgggttcttaaaagtttttcgttttaaaaccaaaaggaaaagaaagtgtattagcacagttgtcatgagctttgatgcctacaagatctagtgaaaaatgtgtttttgtatgttgaaatccctgtaaaagtattttgtatattaaatatgaaaatattagtatgattttgaaaaatgtatcacctttttcagataactttgttgttttagagttatagtttgtgggatttttatctcatggctaacaaaactacataccctgtggccaaggcacaattcaataacgtggggctctagagtgacatataataaaagtatctttaaagccctaaagatttatgacattttatcttttgaaatattgttttcaaataattgctgaatagaaagataattagaaatgtgaaatctgaaactaggtgatgcttctttcactgactgaatatatttctgcagttatttttagaagagtgttatggatgatttagaaacatttttattggaagtatttttccagttagaaacattttacaatctggtgatgagaattcctaattccataatacctcagtgttgtacaagatgctccagcatttctaaatatttgaaaaaaatgcaattaatttgagacttcatgagtcagttatgacatgttcatgctaaaaatattctcaggcattatttcttgctgtagcttaaacggaatatgcaactcatggttgcaacatttaaaattagaatatggataatgtttatgttgttatattcaggttaaagaagaatttaatcacaaaagcaagagaacatttaaagaatttaatcacaaaaacgagaaaacgcacctaaaggattttgctgatagttttgtaaaacaatttctgctgcaagcaattttttttttttgtaaaaatggggaggctgtaaagttataaattttgaatgctggaaaacagattgttttccatttttaagacatttccataataggagaacagcagatgatacaaataaaactaaatttagaactaataaaaggaaactctagtacaaaattggcttgtaaaattttcttctgagggaagtcataaaatataacagtgaataaatttttaagaagttacggttttttttttttttggagatgggattgttacaagcttttagtatagggaagttttgtctttctggatgatataatgtaaatatttggtgtagtgttttaatgtgctttccccttcttttaaacagaactactcagtttgactctagttacaacagatctgtgaaataaaagtttaaaaatctgaacaatgccttatttcaaatgattttctattaataaaattccaccaaagtacataaagaggatccctgtttgatctcattaacatatgaaggttaaaatgaatttttttcttaagagtttccccaccaaggtagtgaagatgggcaaaaaatgaaggaaaatgacttgaatttttaatttcaagtgtatttttttttgtttcttttttttgcatttttaaaaaaattattattatactttaagttttagggtacatgtgcacagtgtgcaggttagttacatatgtatacatgtgccatgctggtgtgctgcacccattaactcgtcatttagcattaggtatatctcctaatgctatccctcccccctcccctcaccccacaacagtccccagagtgtgatgttccccttcctgtgtccatgtgttctcattgttcagttcccatctatgagtgagaacatgtggtgtttggttttttgtccttgcgatagtttactgagaatgatgatttccaatttcatccatgtctgtacaaaggacatgagctcatcattttttatggctgcatagtattccatggtgtatatgtgccacattttcttaatccagtctgtcattgttggacatttgggttggttccaagtctttgctgttgtgaatagtttcaagtgtatttttaaaagagagagtagtatagtggaaagaacattggatttggagtcagaaaagctaagactggtgttaattaatgagatgttctagtgattatcttcttgattgtgagtaatttataggactatttgccttcaaggagttgtgaagaatacagtgagaagctaactatatgtgctagtgttctgtaaactgtacagaactttagcttttttacagacagttgaaaaactatgtgtataacagcctatattgtttgtgtctctcaatgtatgtgcatacaaaatcaaccctctgatattagcctgtttccccccccaaatgtagcatattatttggcacatattagcttcactaagtgttaaataaatgaatgaaaattgttggcatttttgtgttcttaattcactgcgtgtaattagtcgcattggggttttggatggatctttacaatctaagagaatagtaagacaaagtcttggtggggtttatggctcatagatgatggactttggggatagaagtttcatatcagagatgtggaagggaagagagtgagcaggaccagggatagaggcagtcttcttttcactgataatctgaatataccatgttctctatactctttgcccttgtgtgtacctggattgctctgtctccttctctgttttgtcagcttatcacaaaaacaaaaacaaaataaaacaaacttcattttttaaattacaaaagtaacatatgcccctttaaaaacggacagttggccgggcttggtggctcacacctctaatcccagtgctttgggaggccaaggtgggcagatagcttgagcccaggagttggagaccagcctgggcaacacagtgaaaccctgtctctacaaaaaatacaaaaattagccaagtgtggtggtgtgcacctgtagtcccagcttcttgagagtctgaggtggaaggattgcttgagctggggaggtggagatttcagtgagctgagattataccattgcactctagcctgggtgacagaatgagactccccctctgcctctttcttggccatgttctctttctcattgaagacacaggcatgtggctcacaatctttccccataaggctttgccaccattcgtggtgaatttagagtttatgtgaacagagggcccaggactctggctttatagtttcccaatttcatcatctccagttgtctttcttttcgcttaattcattcacttaatcccatggagctactctggacctcaccattacctgaaaattggctttacctttgaggtcttaaatttaaaacactgtcctggctctgactgtaaacttttgagatctgtagttccttgacatctctaaatggttcctttactagcaggcaggaacccattttccatcactttaaacttcttgccagaatcctcagtgtccttgtcctcatgaattttcatcgtatgtatctggcaaaacctaagttctggatcagtttgtctctttggccaacaaaaaaagcatttgttgagcagtgatggataaaaatcacacacaattacccagattagtggtactgcaaattcatggtctctagtccctgaaagagctgtcagggctgcattgcaattcttttattctccataggggctattttaatcattcttttctttctttaaacttaagaaagaaagtatcctccccggatggtctccccccttcatgggaaaacagaacccatgaaaaggagaccccttatatttcctgttacttgactcaccagtttatctcctccgtagcatttgttcttcctttccttcaatttcagtggatgagatgtttcctcatgctgcctcaggctgattctccaactgtgctctgggtcttattcttttcttcctgctgattaacgctatgtctttaatctctctcttaattctgattatttcccatctcactaataaacatgttcataaaacaaccaaaatacccctagacataagtctcatttcttactgcatgatatggtcagaaaataaaaaacaaaacaaaaacgaaacctcagttctttctagcttctgcctcctcctctcaccagcaaaacaaagccccaagcttgtgtacttctctgttgtctcatgttctgttcacttctccatacactataatgtcttctctcatcattcactaaaactgctcgctccaagatcatctggacttcttgctgctaaaaccataatcttatagaatgttcaaaagtacttgacacttgtcaaattgctgtcttctgttggcttctatgacagtacgcaaagcctcagctgtttctccttaggctcctttgctgccttctcttcttctgccaaatggaaatgttccttacttttttttttttaaatgcatttgccatcttggttttgtatcttttccaggactttatcatttgtatgttgatgccttccattttatccatctgagagcttgcatttgagcttctggctcacatatccagctacctactgggcatctctacttggatgtactgcagatacttaatgataacatatctacaactacattcttttttcccctattgctccaaatctgcttcatttcctttggttttagattcagtgattgtttccactatccatttagcttcgatcaggccaaaaatctagtgtctgttatctttgacctcacattgttcccagatcttatcagcgttacctcttaaaggggattcacttgcctcgcatatccctgcttctttcctatttcaagtgactatcatgctatttctagattattatggtattcttttccctggtgttctttcccccagcttttctagtcttttatccattttctactctccagccagactaattatgaaatgtaaacttaccctgttattctctgaagtatttaaatgattgatttcccattcattcagagaaaagttaaaattgctaattatttcccacaaaattgtttgtgatctaacttctgctgacttctctaacctatcgcttgtcccttactcctccctttctctcatatcccaccccatattaaataactttcatttgaagctgcaccatttttcttcccatcttcaagttattaaaaaaacctagatccctctgcttaaaatacaaatgccaactccccaaatattaactgtaatgtagtatgtggaaaaacttctgtagcattgtatttagtctggtatgaagttggattctggaaggacaagacaaatatgtacagttttccctcagtatccaagggggattggttccaagaccccaagacccctgtggataccaaaatctgtgcatgcaccagtcccacagttggccctgccagaaccacatacacaaaaagtagccttgcctttggtagtggatgtgcaactcacggataaggagaactgactgtacttattggaaaaaaaatctacttataaacagacttgtgcagttcaaacccatgttaagggtcagctgtatttataataatgtctttcagaaactgatctatttctgtgttaaatgataatggagaattggtttgtatagcatgaaggggatttccttagaaaagtgtttcaagtggaagttgctgatggaaactcgtgcttcttgtgagcatttctattatgagaagtatggataaaatagttggctaatggaaaaatggtaatataaatgctgggcataaaacttctttatagaaaacgaatagatattttaaataataagcacttgagacctgtcatgttgaatagaggtttttatgatgtactattacggttattgtcatagcagaaataatacaagcaagacatacatctcttactatgtgccaggcactgtgctttactaacttgttagatttctgtgtcatttttccagtgccatgaaaataacaagttctttcaagattggcttcttttacttagcaatatgcattttaagttttccctccatatcttttcatggcttgatagctcatttctttttagtgctgaataatattccattgtctggatgtaccatactgtacccactcacccactgaacaacattttgttgcttccaaattttgctaattatgtataaagctgctataaatgtttgtgtgcaggtttttgtgtgaacataagtttgttttgttttgttttgttttgttttttgagacggagtctccctctgtcgccacgctgcagtgcagtggcatgatctcggctcactgcaacctccgcctcctgggttcaagcgattctcctgcctcagcttccccagtacaggcactcaccaccatgcccagctaatttttgtatttttagtggagacggggtttcaccatgttggccaggatggtcttgatttcttgacctcgtgatcctccagccttggcgtcccaaagtgctgggattacaggcgtgagccaccgtgcccggctgaacataagtttttaactccttcaggtaaataccaaggagtgcaattgctggactgtatggtaagagtgtgattccagctgtatgacgttctggacaaaggcaagagtaaggaaccagcaaaaagatcagtgactgttagtgtggaaggagagatgaataggtggaggacagaagattcttagggcagtgaaaacactatatatgatactataatggtggatacaggttattatacatttgtgtgaacccatgggatgtgcagtaccaagaatgaatactgacggtaactatagactttgggggataatgatgtgtcagtgttgtaggtttgttagttgtaacaaacgtatcattctggtgagggatgttgatagtgggggaaggctatgtgtatgcaggggtgaggggtatgtgggacatctctgtacctttcagttttgatgtgaacctctaactgctctttaaataaagtcttttaaaaaacatgttctttaaaaatattctgcacttaggaatacttacgaattcaaatatggtttaaaatttttctaaaaaattatgacctcttctgggtagtatagaggtagttgcgtactttttgcaaacataatgagaaacctcttacctgtctgattaaagttatattaaagtcagaacatctgagtagcatatatgtctaatagtatgtaatttcacccaattctttgaataaaggtttattcattctgtacctgagagatttagtgtcttttagatttaatgtcttcctgagtatttgttttctcatttaatacaattgtgaaatatgtagggcagatatacagaatagaggggaaactgaggtttggaggtttgtccaaagtcatgcagctgctaagtggcagaactggaaaagtatcaatgtctgtagatttctaagacagtattctttttttcattatgatgcttattttctgaagtaaaacctcaagctctgaacaagaaattggttagctatttggacaagctggatggctatcttagaaaagtaattaataatattaaatgttttaacattaaaaggattacaaacttcagaatatttgttgtcagtgattgttcaacttgtttaccctaaaaaatccccttaggttcaggttaatcttcttcactcttcaaaagagcactgctttggattttttcatgtctgcaagtgaagagagcgtttcactgtatgatctatacttactggagataatgattaagaacttatctttaaaactcattagttgttagtgtgattttgttcactgaccatttgaccaagctagggaggaaatggaacgcgtaactcaggaaagggtaaagaagctcttcacaactgtggtatcccataatgataaaattagccaaaaccaaaaagtacatatttttaactttctaccacatataaaataatgtttaagacatagtccaggtacttttaagaagttatagtttgggaagataaagcttattgtcaagtggaaagttaaatgatgaattaaagagctataaatagagtagtataaaatgataccttacttgctatttgagcagcagataacaaacaccctgaattaagaatggtggcagtcaccatgctttggaagtattagaagagcattatggatgctcttctaatgcattcatgacatgaatgcgacaatggcagcaacagtcatgatgattagtagcaaacacttaaatggctactgtttctggcatttatatatatataaaatatatatgtataaaatacatatacacacactagtgataccttgatttcttaactttattttttcttattctttttaaaaaactgatacattaatatgaaaattatgtgtatttatggtgtacaacatgatgttaacacctcgatttttgaaagatagttttgtgtagtattctaaattgaccattgtttgttttgtttttggcttaaataacggaaatttattatctcaaagttctggagcctggaagtcccagatcaaggtgttggcaggtttggtttcttctgaggtttttctccttggcatgcagatggtcaccttctcactgtgtcctcacgtggcctttcctcttgcttgtgtacccctggtgtcataatctcctcttcttagaaggacaccagtcagactggatcaagacccactctgatgaccttattttaatttagtcatctctttaaaggccctatttttaaataccaatgacattttgaggtactgggagttaggacttcaactcgtgaattttggggtgcaggttgaaacataattcagtcagtaactatccatctatttatctatttttaaacctatcatttttaacgtggagtgctgtaagactgaagatgcttcaaagaatgaatatgtatatgaaaacttgtgatcgagtttttgttgtgatccttcctcctttgatcagtgtaaactggtcgctttcctgtctgtaatacagctttcaattcctacctttcaggattattgtgggatagattgactgcttttgtttttgttttatttagtacttttaaaacattgctccactgtctttaaaaaaaaatcagtccagaggtttatttatttgagactaataatttatttggcattctctgacccagtgatccacctgccttggcctcccaaagtgctggacgcagtggccacgcctgtaatcccagcacttgggaggctgaggcggatggatcactggggcaggagttcgagagcaacctggctaacatggcaaaaaaccctgtctctactaaaaatacaaaaattagcccggtgcggtggcgtgcacctgtagttccagctactcgggaggctgaggcacgaaaatcgcttgaacgttggaggcggaggttgcagcgagctgagatcgtgccactgcacttcagcctggatgacagagtgagactctgtttcaaaacaagaaaataatttgatccttttgtgccttgctttgttatgccggtaaagagcagcagttaatctagagctaatttttccatgctactgagggaaaagccttttgagtacagtacctcaagtcccgtgaattgtagggttttccattctggctagcatggcaggaattattcttgttcagctcttgggaaatgtctcatgtagatcatgtagtctcatgtagatatgttctctactgaagactctagggggagtacctgtgttctttctctgtacacctccctcctctctggtactctgttctgttaactgcattggcttccttggcttctagctctgcttctgcaatccagggtgaccacttggctcaacttaggttccctctctgggcatggtcacctggtcacctggaagtggccatgatagggctcactttgtttttctcctctcagggagggaccaccgtctttcactgcctgatatccagtgtcttgaaagttatcatttcatttattttttctagttggtaagttgtttcaggtggctggaaggggtagattctagatattttaactccctaagcattaaatgtaaacccattatcagactagagtaagacctatattaaataattttatcgcttcataatttatgtaaggtatttatcacagtggtgacaaggcaaaaaaatgtttgctgttgctatccttattatctcatcaaaggactcaatgttggtgtcttccttacatttaagtgttaaagtatttaggtgagatccaatccagctgattacagctgcaccacgagacagtgctattgaaggaacctggtagtgggtaaagaatattgaaaaagttgagataaacattatggcagtggcccaaatagctattattttcttctttgtactaggaaaacccctggaatgtatttgagtttgggctgaatgaagactacttaaaaaaatttttttaaagcagttttgttgttgtgtgtgattagccacatgagtaagttgaagctatggaatgtgaacaccagaggtttgtgagtagcttccaggaagagtccttatagggagtgaatgtatccttttcttgccattgccttttaacagctggtgttggtgcttgctatcccatgtcattaggtggaagcagtggattcaggttaacagtaacaaagctgaggagcttaggtccctgattatcattggagccactggatccaccctgaatagttttaaggtgttttctggttaggtttttctgtcacttgcagctgaatcagtccaaaccaataatataatttattatgataatatagtataaaatatccgtggtatttaaaaattaccattatttctttaatattgccaaggaaataaggtgtttagaaatgtgtagatcagatgggacgtatctaaaaataataagagctatttatgacaaacccacagccaatatgatactgaatgggcaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtccctgtctgcagatgacatgattgtttatctagaaaaccccatcgtctcagcccaaaatctccttaagctgataagcaacttcagcaaagtctcaggatacaaaatcaatgtgcagaagtcacaagcattcttatacaccagtaacagacagagagccaaatcatgagtgaattcccattcacaattgcttcaaagagaataaaatacctaggaatccaacttacaagggatgtgaatgacctcttcaaggagaactacaaaccactgctcaacgaaataaaagaggatacaagcaaatggaagaacattccatgcttatggataggaagaatcaatattgtggaaatggccatactgcccaaggtaatttatacattcaatgccatccccatcaagctaccactgactttcttcacagaattggaaaaaactactttaaagttcatatggaaccaaaaaagagcccacattgccaagtcaatcctgagccaaaagaacaaagctggaggcatcacactacctgacttcaaactatactacaaggctacagtaaccaaaacaacatggtactggtaccaaaacagagatatagaccaatggaacagaacggagccctcagaaataataccacacatctacaactatctgatctttgacaaacctgacaaaaacaagaaatggggaagggattccctattcaacaaatggtgctgggagaactggctggccatatgtagaaagctgaaactggatcccttccttacaccttatacaaaaattaattcaagatggattaaagacttaaatgttagtcatttaaaaccgtaaaaaccctagaagaaaacctaggcaataccattcaggagataggcatgggcaaggacttcatgtctaaaacaccaaaaggaatggcaacaaaagccagaattgacacatgggatctaattaaactaaagagcttctgcacagcaaaagaaactaccatcagaacaggcaacctatagaatgggagaaaatttttgcaatctactcatctgacaaagggctaatatccagaatctacaaagaactcaaatttacaagaaaaaaacaaccccatcaaaaagtgggcaaaggacatgaacagacacttctcaaaagaagacatttatgcagccaacagacacatgaaaaaatgctcatcatcactggccatcagagaaatgcaaatcaaaaccacaatgagataccatctcacaccagttagaatggctatcattaaaaagtcaggaaacagcaggtgctggagaggatgtggagaaataggaatacttttacactgttggtgggactgtaaactagttcaaccattgtggaagacagtgtggcaattcctcagggatctagaactagagataccatttgacccagccatcccattagtgggtatatacccaaaggattatacatcatgctgctgtaaagacacatgcacacgtatgtttattgcggcactattcacaatagcaaagacttggaaccaacccaaatgtccaacaatgatagactggattaagaaaatgtggtatacttttatggaatacaatgcagccataagaaaggatgagttcatgtcctttgcagggacatggatgaagctgggaaccatcattctgagcaaactatcacaaggacaaaaaaccaaacaccgcatattctcactcgtaggtgagaattgaacaatgagaacacttggacacaggaaggggaacatcacacaccggggcctgttgtggggttgggggagcggggagggatagcattaggagatatacctaatgtaaatgacgagttaatgggtgcagcacacgaacatggcacatgtatacatatgtaacaagcctgcacgttgtgcacatgtaccctagaacttaaagtataattaaaaaaaaaaaaaaatatatatatatatatatatatatatatatatatataaatgtgtagatcagggcggctttaaaaaatagctttttgaagttaatagctgtttatgtatatgcctggtgttttacagacattttatgtcctttatttccttttcataacaatgctgcaaagttatgttattatctctgttttattgatgctatgaggtttagagaagttatgtaacagttgcgttggtagagttaatattcaatttcaagttcgtctgattccaaatcacatacttttttcactaacccatgcttttctaactcctttgctttaaatttttatctctgagtatcttctgattggtaaattaatctatttaggagatgccctgtaaaagtgactaaatttattatttcaggccacttatttcttttgtttcttatcatgttgacataagttacatgtcttttagttacttgcatcatttctgtggcctcattcgcaggaaaagttaagctttcctgaatctgtaaagttgaacaccaccataaactctggactcatgataatttaaccttatgttatataccatagatgagagtttagtctgaagaaggtctcaaactattaagcttcttaactgtgctggtatcctccatcaattaaaggtttggtttatgtatggttagctttaaacgaccacacttaggatctgaggaaaaccatttgacccttctagtctattctaagtctcttaattcactgagaaattttgatgcatttttagttttcattcacttactattttgttttagccctctctttttgttctagaatgacttattagcagtcagaggacagacataccatatcgtaggaacctaagcatgtcaataattacttaaaatacatggtcgcataaaatgtttacgtcttaaagaaatttactttttgtaatctgttatggcaaaatatttttaaagcctgcatgttccagacctgttctacctgttacctcttaactgagatgaagactgcatacctgaaagagaaattcactggtagaagagacacatgccagaactactgagaattaagtctttgtttatgtaaccttttagtttgttgagtctttccttttttggagtacatgaaattaaatactatggaataatttgccattctcagctgttaatatattctctatgctgtagaacttgttaatgctacctttattgttatataaacctgacatggtttttgactttagtaattgacaaagtatggatgtaaatttaacaaggaaaaacatttaaaattagtaatgttacatatacaagtgttgtatacattctgaattttcttggtctctaaggcctatccatcacctcctcttccacccacctctgatactggatatacgtagtatttatttatatctatttatttattttgcctcttttgcctttacaatagttacccattttccaacttctcaagttggagtgctaccagttgagggtagttgtattgagtagttcttttaaagagagctttcttagggtatatccaaatacttctctttccagtataatagccattagctacatatggctaaattaattaaactaatcaaaacaacataaattccgttcctcagttgtgctagccttgtttcaagtgcttagtagctacatgtggctagtggctaccatctcggacagcacagctttatagaacgtttgcagtgttctgttgagtatacttaataatcagaatgtggactgaagaaggcccctggtacaactctattttagatatatgtaatttaataatgtacttatggctttaatttctggctgaggttgttcaaaaaagtgaaatctttaatccctgtgaagcttgccttgcttaccagtctacattctgatgagttttttcactatgttttgaagtcttttacagtgctgcctatttaacagacaaataggactttgcttgttgttaaatgatttgccagaaaaaaattatggatatgtttttagaagtttattatattcctgattataagagtaacagatgtattacagaaaactggaaaatgtaaagagtaaacaattaaaacttatattatgccgactcagataatttactgtttttttttactagttttattcataatttaattaaaaaaattttaaactgttgggaattcatctcatagtttatttccattttgttcccctaacattgtagcataagagtttctatatgatactgtaaaacaacaacaacaacaaaacactctgaagcatacactgcagtattgaattcagtggttataattgcttaaccattccttgttgttggacattgtgttctgtgtaatggtgctctttgttttgtaacatagattacaagggtacatctctaacttcagaataattgttttactttttttggtaattatttgttaagtttgtgtcttatactagagtataagccacttgagtgcaaggaccatgccttgattacttgtcttaggtcttttttgcattgagaaaggttataaagttattttagtgatatttttatcctcagtttatatcattgtgtctgatatatagatacttgtttgacaaattgaacttagataattggatttttcattttcataggttttgcttatggataagaatatgcacattttaataaagtaataattcagctttttggacacattcctttagggattatagtctcatttgtaatatacatttttccttttttgcagctcttttcacaggagaaagtttttggatatgctatttaaagagatgaataattttcaaggacatctatatttaagcatcatatttgcctggctttatcacataccacaatatggtttagctatttgaagaacatctttagtggcaaatgcaaaacagtgaatcatgggtgctgagatactggccacatttagttatgatacagctttgtagcttgtataagttgatttcaacagtgttctaaaaggaactatgaaaagcaaatttgaggatatgtatagttggggtttttttcctaaacttactgggttttgcatgtaaaatgtggcagatacgaaaccttattcatgtaaatatggtatatgttggaaattgtaatatgttggtaccaataaatgtaaatgaagttctaaactattcctaaacactattttaaatacctttaacagtactgtgttttagtgaataatagtaactaaacagcatgtgcaatgcagtcagtttctttaaagaacatacagacaaaggacgtatgtcagtcaaaattggtataaagagagcagcaaattagaaaacattcatagtaatgtttttagatgctacattagactatgaggagaacattactattactgtgaaatacaaattgttgactgcaaatagtttttctggtatcattataaatgctttattcatttatcatagttctatagtaatacatttaaatctaccttatttttaatagcttttaatattccattgcttggataaattatttatccattacccctaccaaaggatttttgagtcactttctttacatctgagtatcaaagagtgttcttatatatatttatgcagattctaggaaaaatgctgtaattttttcctgtacttctgacatttcttcagttagtgttaaatgtttttataataaggacaaagtaaaaatttatatttgtaaaaaatgcttttaaaagttgtttaaatatttgagaggaaaaattaggttattttctctctttataacatgcaccaaaataaactccagataatcaaagaggataaaggtaaagtgagaaaccataaacaaaatgaaactgtacaaattcccgtctgatctaaacataatagatatgaaaacaatcataatgtagtttttatttactgaaagtgaacaaaactaaacgagaagttaaaagagagagaaaaaaactgaggaaaaccatatgccccaaaaggcagacacagcactattatttttaacataaagaggttatacaaattcaccataaaacctcaaatatcaatagaaacatggtaccaggatttagacaattcaccaaagaaatgcaaacgacaaaaataatgctcaggatttaaaaatataaaaattaaaacatcaataagagataattttattcttataaaacccaaaaatattttaaatatggtagcatctgctgtagaagagtgtaaatttgtcccatttattcactgctggtcagagtctttcttgttagttttaatttgtctttagttaatagttaatagactagaacagttgtaggtttacagaaaattaagcagatggtacagaggtcccatgtaacagctactccatccccttccgtttctgttattaacatcgtaccttagtgtggtacacttgttacatacagttaatgaaccaatgttgatacattattattaactgaagtacatagttttctttagggttcattctttgctgtacatttgtttgggttttgacagatgtgtaatatcaagtatccacagttacagtatcatacaaaagagttttactgtcctaaaactcccccgtgctccacttcatcatcctcctttctttttcctcttgttgcctccaaccactgagctttttgctatctctagttttgccttttccagaatgtcatataaatggaattgtccagtgcgtaggcttttcagaatggtttctttcacgtagaaatatgcatttaagtttcgttcatgtcttttttgtggctgtatgattcatttctttttattgctgaataatattccatataccacagtttatcatttacctattgaagcaatattggttccctccagtttttggcaattataaagctgctaaaaacatttgtatacaggttttagggacaaaaccccaacataagttgaggaacatctattctcagcaataacaaatgcattattaatacatggaaaaaagatgaatctcagaattatactgaatgaaagaaccagtccaataaagagcacatactatttgatttcatttacattaattatataaacttcaaagtaatttatagtgataggaaaacaaatcattcgttgcttggagaaagtgggggcttttgaagaggggcaggagagggggatttttaaggagtacaggaaactttgtgggttgatggctatgttcattatagtgactgtggtgatgattttatggatgtatacatattgacaaaacttatcaaattgtacactttaaatgtgtgcttttattgtacgtcagttttaccttaataaagctcctttttaaaacgaagcttagagtttaaaagaatataaagtatatgctaaaaactgagaaaattttaaaatatgaatttgttaatttattgagaataactgtaataaagccatttaatttcacctatgtagtacttaatgaaaaatatgtttttcaatacaaaaagtttagtgagaagagtggcattgctctgtaattttgcaaatctttagtgtctgactttagtatgaaacgacggctggattctcatctgcttcttcatgtcatcagttgtgatatgttgtatttgttgaagtaaatgaggaaaaatcatcattgtacatatttgtagttggaaaagggagggggatagtaatagcctttctagataattctggatattcttcaagttctctgttgaaatcccccgtcttgatatctcaaacatattaatagcagtgattttgaagtttatgttaagtttctggatctcctataggggtgtgtgtgtgtgtgtgtgcacgcgcgtgtgcgctttctctcgattttatgatattttagttttatcatctggtatggctgctaatgtttgactgctgggcattgcatgtgaaaaaattgcatagaattaggtaacattgtcttcaggaggatttacgttttcttctggcagttactgttgaggcagactaccttaatctattcagtaattgaactgatttgaggcagatttttaatcttttgagggttggtctagtttttatttttccttattacttctaggatatagccctttagtagactccattaaaaaccctggactttttcttcttcgtaagtccagaactctaatttttgtgttccctactctgcaagaatgctagaagctctcttaggcttctcaacttcagagctgcaactttgtagtcaactttaggttcacttctttctccacccaccaccctgccacctcaaggattttggtttcaaatctttactgctttgggggctctccaggacttgagtagatttttaaaaataaattcgtttggcctttaaagcttttcctcattaataagattggctctatcaaattagtctatcattggtagagatagaaatctccagattgtctaagaattgtttgtttttttaaaaagtgtttcactgtactagatagtagaatttcaggggcttgatatattataattactctcatgctgatttcatagctagttgagagttggagaagtaagttagagatcagaatgtcatctatattactggtgaaatctaggatgcaggctgtggctcagagacaggacaaaactgttgtcctaaatgaaacttgagtcatagatacatttttctcacagaggtgaaatcttccttgctttattacaagaataagagtagatgagaataaatgtgtatcatttatatggatcaaaattctggaaaattaagtaatttagtgtaacttaaaattgtaaatcactgttgtggtcagtgtgtgttatataacagacataggttgtatatacaacctatgattctttcttcaattgagcttttatttttatgaattttatgaattgagcttatatttttgtgaattttgcagagcgtggatttgtagtaagtaatgttgagcatgccaggatataaaatattattttgcattctcaggaattatcaaaaaatagaatattttgtgatgattttgtttgccatttggtaaccgttctgcaatctggttatttgctgttcatattcggaatttatctacgagtcaatgagttgtgtacgccaggaattctctcagtattgcagtatatgtcacaataatgtggcaatatctttcatcaattctaagccatgtgattaggcatgttaattgtaggaatcacccatttaaaactgcttgactttgaacccaactctgctttaaccttttttttaaaaattgtaaataagactttacagtgatggccagaactcatttagtattccgtgaggttgtaatcagtgctaacaccaggtgacacaaatgcagtcaagctacttcccttaaaaaaactcaccaaactttaggatcagattaccataacatgggctaaattaaaaacagaaatgaaatacacagtatttattacagggatatttaccaggaaaagaaagtatctttaggccatgttggtttgacttttattttacgtaattttataattagttcagtccattcatagaaatctctcaaagaaaaattttgacatagctcttttttttctttcatttcttttcttttttttgttttttttggagacagggcaggctggagtgatgtggcatgatcttggctcactccaacttttgcctccagggctcaaaccgtcttcccacctcagcctcctgagtagctgggactacaggcataacgccaccatgcccggctaatttttgtatattttgtagagacagggtttcatcacatttcccagactggtctcaaactcctgagctcaagtggtcttcctgccttagcttcccaaagtgctgggattacggacatgagccaccaagtccagctgatgtaatacagtaattgattggtttcatattaggaacattaaactacatttttatatttcatatactcatttttgtgatttttaaaacaattttttggtggagatggggactgaaataactttctaggtatagaaccctaatttgcaatactgtttctattggaaattcaaattttatttacaaatttaaatttcagtcattatcaaagaaccagttaggttgtaagatgggtgggagtcgtgtataagctcaattaaatcaaaccatctttattttgtgtatactgcatatgcacacacgcgtacatatacagtcattcctcgaagtctgtgggagactggttctaggacctctagaggataccaaaatccatccttgctcaagtcccttatataaaatggtgtagtgttttcatataacgtgtgcccatcctcctgtatactttaaatcatttctagattacttataatgcctaatacaatgtaaatactatgccggtagtttttttttttttaatagaaagtaaaacatgtttcaaaagctacaataaacctgtatccaaaggagtcctatacatcagtgatgtgctggactttgaattttgtggtacagctttgcattggactccctccggcctactggtctgggtacggcttgcttcctgcctgttgaagggtgaatacgctacacagagctatgatggtttctactgagtggtaaaattcacagaagttccaggttcatcatgtcaggatcattccttgtgcaaagtttgatgtagatgaagataaagtggtttcttggtcaataattgcaattgctttcttttaaagtcagtgggtttcttgtatagttctattacatttggcccaagtttaatttcatccatctccatgaaagcaaaacacttggtgctggtaaacctttttttaggcttgtagtgtttgaattcaaagaagatagctgcacctttggttaatttttcaacatgcttctggagctcaatgtccacattaaaatgaacatatgtatcttcttttcttgaagccacaggagtatcttgcacaggagttaagtctatgccattcagatcctttacactaactgtaatatagggattgatgcactgcccagcatctttcaaaccagttttctcaattctgatagtgagtaatgtcattcctggttccagtggcaaccttggtaagaaagtaccgggaactctagcaggaaaagaatcaggagaccctgctccagcaccaccctcttcttcatcttcttcagattccaaattctcttcttcaccaggtgccaaaattcttcttaatgggacaggctaaacatcaaatgggaattctttattatatgtaagaatattctttaggattggttctagcttcttcaggttctccaatttaaattcttcttgagactgtgtggactgtaaagctgtacttcgcaattctaagcatgttgcaattttgcctgtggttttctttcttctgtgaattcagaattattgtgttgagcttgggcctctttttgtagatgtcttgctaatatctgatacttgtctatcgcctccaccagctggccccaagagtcgcagtcggcgcctctcctaaaactggcgccccagcgctgcagcagactccgggtcacctctgacatggctggtccccaccccgtcccctcctgcccctaccccagcaaggccgggttctagggcgccatccttcccaggcctggccctgacattaacagggccaggaggaccgctacggccaccaccgccacccaccgaggagccgcccaagcccatttttcgccgatagttgttatattgtattgtttagggactaatgacaaggaaaaaagtctgtgtatgttcagtacatatgcaacaatctgttggtttttttcctgaatattttcagttctgattgttgaatcagtggattcagaaaccgtggatatggagggctgactatatacagtctttttggtatgtttcattttcagaagtgttggtttagattcagatatatttgttatttagaagtctctttaagataatgttttctggctgggtgcggtggctaacgcctgtaataccagcacttggggaggctgaggcgggcggatcacgaggtcaagagatcgagaccatcctggacatcatggtgaaactccatctctaccaaaaatacaaaaattagctgggtgtggtggcatgcgcctgtagtcccagctactcgggaggctgaggcaggagaattgcttgaacctgggaggcggaggttgcagtgagctgagatcgcaccactgcactccagcctggtgacagagtgagactccgtctcagaaacaaataaacaaaaagataatgttttctgtcattttggtgacaattatgcaagaaaggaaggtcagcttcattacctggtacacaggagaaaaaagtatttataaaatgggatgctactgatttgactacttcatgtgtagaaaccataagatcatctttagatttttgaattatactttttaaagtacaaaccattcagtacgttttataatactgtaaattaattgaaaccattgttgttagtgtaattatagcctcggtagtttttcaaggaaacgtggtaatgaaatatcgagacctcagttacatatgtcttttggtttataccactgactttattagaatattagtttggcgtcattcttttttcccccaagaaaacctgctttctgtatcttcccatatttttcaagcaggtctgctatagttaattcctctctgtcagcatttggattgtttatactgtatttcccacatggtgttggtaggtattttcttgctgtattagctggctgcagtattatggctttgcttgctgatggaaataggtttgttcactaagctcctttgggcaaggacattagctcatccatttatgctgtagacatatttgttgaaatgatatcccggagctatcaagttaacagcggagttcttttacctgtttctgtattcctttgctttgattgagaaagtgaacttattttgcaattgattcttaaatcccttgtgtttaaaggattttatgtacactcagtcatttaatgaatatttagtaactacggcatgccaaccactggtttaggcagtgaacaaagcagataaaatattcctgcctatcagtttgcattttaataaggagctagataataatttaattgtttgtaggatagtgataagtggtaaggagaaagaaggtaaaacaaagataatgcgaaatatagaacttttaaagtttacatattataataagttctcccagaaaaggttacttttaagtgaagacttggtggagagctaccaccaactggtgcagttatatgggtgtgagcttttctgacagaaggaaatagtgagtccaaagtccctgagtcaggaacatgccttttgtggtttttaaaaaacttcttattttgaaacaattttataaacttactgcatacacaaaacatttgatttgtcaactgtccaaataatgttcttcatagcaaaagaatctgacccaggatcatatattcatccaactctcatggctctcgaatctctttcaatctggaacagttccccagtcttgactctcatgctcttgacagttttgatgattacaagccatttattttgtagaaattgttccagatttgccactgggagccctttcatactggcttatgtgtcctcttgacaagtcaccatcagtccttgtacacttctttacttatttttaaacttttttcttgaaataattataaattcacagtaactttgcaaaaatagtacagaatggtcctgtgtaccccatttcccatagtgtttatatcttacataactatagtttattctcaaaacgaggacattgacattgatacattgtgtatgtatagctctatgccattttatcacctgtgcacttccttcctttttggcacaagatgctacaagctcatcttatcattttcctactccagccttagaatcagctatttctgcaaggagccctagttccttttagtgaagagtagtattttaaaaccaagatctgagtgctagatgagctcattgctatgggagtatctattgtacaccaggccctttcagtggtcacatccaggaagcatgtgcatgcacgtaagtgtgtgtgtgtgtgtgtgtgtgtgtgtgtgtgtacacccacacagacatttatctacatctatatttctatatccatctttattttttttaactttatttttgagacggagtctcgctctgttgtccgggctggagtgtagtggcatgatctctgctcactgcaacttctgcctcccgggttcaagcaattctcttgtctcagcctcccgagtagttgggactacaggcgtgcgccaccatgcccagctaatttttgtatttttagtaaagacagggtttcgccatgctggccaggctggtctcgaactcctgacctcagttgttccaccctcctcagcctcccaaagtgttgggattacaggcatgagccaccacacctggccccctgtatcttttatataatgaaatctgttaattcatattgatacaatctagttccagctcaacaccatgagttcattgtagtgtgcccaaccctcctcccccatatttgtatttattctatcattagtatgagcctagttcggttattacatagtaactaattggctgaattcctcatatttagtcagtctcccaaccctgtaaaactgtggtgctgctcagttttccctacttgttagtgccctgtctgccactgagctaccttcctacaccattcctacttcttgtgtagggtaccggttgtgatttcgaaacgtttagaaggccagtgtggcagaagcacagtgagtgagacagaaagtaatgggaggtgaggtttgagagttaataactaggtggatgcgagcagatgatagactcaaaggctgggaattgtgctttactctcaatgaaatgggaagccgttggaggttttgaacagaggagtgacagcatcattctctgagttccattgaaaatattctaagaagagagagaaggcaaagttggaagcaagaagacctaatggtagacatttgcaatgattccagcaaaatgttggtgatttgtaaaggtggtgaaatctggtggagttctggattcattttgaaggcagtcttgaccagatttgtaagtgttaggatttgggctcttgagagaaaaagcagtcagatttgaatattaacattattggcctcagtatttgcaaggatggaattggcatgaatggagatgtgaaagactgaaggagggaagtggttgtagtaggaaaaggaaggggtagggcatagttttggacattattgtttgaaatacttactagacattcagaaaaagctgatgaatagcaaatagatatatgggtcttgaattcaggattttagttggaatagagataatgaatttaggagccatcagcacatatttaaagacgcaagacaagatggagttcgagggagtgagtgaatttgagagaggaggcccaaagacaggagaaaaccaataaagtatactaagaaagggcaaccagagaaatatgtgataaacgatttaaatgggttttcatcaaagcaaagtagaaaaagttttcaagtttttgaaaataatagggcaaggcagtcctgaccaaactttgacctgttattttgaaaaaaatagtgaaggactgtctaaagatgtttataggtcaagtaagatgtgaactgagacatgatcattggattagcaacatgtaggtcactgataagcttgaaaagaaaagtttaggagtgtgatgatggctgttagtcgggggagatctgattgtagtgaattgtaaagggaatgggaggagaaaaacttaagacagctagaataggtatttcttccaagaaatttttctgtaaagaaaaagattgaaatggcagctgtatgggaggtagggtcaagggattttttcttaagggtaagagaaataacaacatgtttccatgccaatggcagtaatcaagtagagaaggcggcgagaagaaatgaagagatcatgggagaattgctgttgtggtgttaatgagcaagagggaatgggagatttagtgtgtaggtggagggattagctgtagctaggactgtacatccataatagcaggaaagaaagtaaaatgtgtgggcacagatgcaggaacgtggatagatttggtgatgaaggcttgtacaagttctcagtgaggtaagaagcaagatttgaagaattctgcacttgaggaatttacagctaatagatgtgagataagctgtgtacaaaaataacttttataaggacaaagtgacatcttctttgaagaacatgtaatgtgtaggagttaggaaggagagatttttatcctggaggatcctgaagatttcacagaaataagttttatctgaactaatctttgaagaatagataaaaatttgaacaagtagacatgactgaagaactttaactttttaatttttttattttaatgcttagcactcagccttggtacatggctacccctcagcaaatgaatgagtgttgaatgttctgtggtgaaagactgtgaggaaagtgatggaagtagaaagaccaaggtgaaaggtgaaagtttgggtggtccaaactttccagtggatactgttcaatagatatataatgtgagccacatatataatttaaaatttcccaggagcctcattttaaaaggtggagggaaacagatgaaattaatttcaataaatatttcatttaacccagtataacaaagtattattttaacatgtaatcaatattttaaaattattaacgagttattaaaacagttatttcatattcttattagtactaagtctttgaaatccaatgtgtattttacatttaccagagcatctcagttcaagctaaccacatttcaggtgcttggtagccagatgtaactagtgccttctctatgggacaatacaaatctagagcaaatgtgaaagaagggtcgtaaatagtgggaagtcagattggagaaggtcgatggggcaaagtattccaaatgctagtttagacttgattttctaggcatttggaaggtatggaataatgttaggggtgcctgtaatcccagctacttgggaggctgagggaagagaatcacttgcggaggttgcaatgagccagaccataccactgcactccagcctgggcgacagagtgagactccgtctcaaaagaaaaaaaaaacaacaacaaaaaaacaccccaccccaacaaatttgaatattaagaagagcatgaaatgtatagctttatgtttcagaaagattactcagcagtagaatggagatgtactggagcagagggagattagaggcagggaaacaagttagtaggtaagaaataatgtgaatctgaaaccataatggagaaattttgttatttcttttaaaccatagttgctggccgggcgtggtggctcacgcctgtaatcccagcactttgggaggccaaggcaggtggatcacctgtggtctggaattcgagaccagcctagtcaacatggtgaaaacccatctctactaaaagtacaaaaataagcagggcgtggtggtgggtgcctgtaatcccagctagttgggaggctgagcgaaactccgtctcagaatgacttatacagagggaatgacttgaagtaaggggcaagggaaaggaattctaaacctgacttacatagaatggcgttgcttattagatgtagagtaggtaagatttttttttttttttttttgaggcggcgtttcactcttgttgcccaggctggagtgcaatggcgcgatcttggcccactgcaacctctacctcccaggttcaagcgattctcctccctcagcctcccaagtagctgaaattacaggcacctgccaccacgcttggctaattttttgtatttttagtagagatggggtttcaccatgtaggccaggctagtctcaaacccctgacatcaggtgatctgcctgcctcagcctcccaaagtgctgggattacagccatgagccaccgcgcccagcagagtaggtaagatttgaatgagaagatgcctaatttaattttggttatgttgatactaagatgctggctatttacacaacagttttttgagtatatacactatgactggaatatagaaaataagtttttacctttaaggaagataaaaaattccttacctttaaggaatttatgacctctgaagttttaatcttgtatcccatcattgaaaaatttttgagaatatctccaaatatattttatttataatttgtatacatggactatagtattaaaacatgtaaattacaaaatatacataaaagaggagtttttaaagtataattttataaacataagattgttataaatattactttattaatggtacaaactttttctttccccactaaatgacatatgctttattgctttttacaatttttgtttaatgttgttgcagtgatttgaagattaggttctaagttcagtttattttgctaccaggttttgagaactatcataagttttttttcctcctgaaatttcacaaggaggtatagatacaaatggaagaagcataatacgttagtggctgtagttactaaatcacaatactcactttctaattctgctcaccaatgatacaacttttttttttgcaccttagtagatcattttacactctcattgagtaggtccactcaacttaggagacttcttgggtcttttgggtatctggtggatacttggaaataagggtactggatcacagtgtactattttgtagaaacagggttattaagcctacaagatggttcaaagaataaagtctagatttttgttgactttattgcctttccattttgagtgtaagaaaaattatggctatttgtggcaatttaggttgtgtctttgagtaattttgtatttcttttaaaccatagttgttggccgggtgtggtggctcatgcctgtaatcccagcactttgggaggccaaggcaggtggatcacctgaggtctggagttcgagaccagcctagtcaacatggtgaaaacccatctctactaaaagtacaaaaataagccaggcgtggtggcgggtgcctgtaatcccagctagttgggaggctgaggcaggagaatctcttgaacctgggagggcggagattgcattgagctgagatcacgtcattgcactctagcctgggcaacaagagcgaaactccgtctcagaaaaacccaaaaaaaccatagttgctaatgtgtatctaaattggttgataaattattattcctacttaaggtgctgttattgccagaaatgaaggagcaatatgcagatttatggatgaaatggtctagttggtaattagcctttagaaactgtagatttacctattagttatcaaattgtttcatcaatgggaccttttctctgacaaataaggatttataggctaccaaaatatgaaatagaccccaaaaactgtgaattagattcgctttccgagacttgctcatcattctttataggggagggcacatagagtggacaaaagagagacaggatagatatttaaaaggttgttaaaatgttttctgatttttaaaaagtgtttacttaaaaaagtttcctgagaggtatgaaagaactgttgcctcctgggtaaggatgagttgtgccttgcttctctggtttctgttgagaagaacatttttacttttccatgaaaattaggttggctactcgttctgcatagttacaaatgtagttagaagaagaaaagagaagcgtgcgtcctttaaaacaaccatcaacaactattttcttcttgctgtgttctttcgtggttcttagtggtagttatatgaatagcagaaagacctgctcctggttgcagcttctgcctctgctgtatccctaagtggctctgcctcaaaacacttctccatttttttttttctagtggaacttttacgagaattgaatgagcgagtgactttcttttgcacatagtatgaactcagtaaatgttaatttcctaatgtgatctgtgggcacacatttttgccctttgatttttcatgtgaacttggttttttataaaagtacttggttgtgccttaaaaagttcattgtttagatttgattaatatttgactggaaaattgaagatgatgtctgtgggtataatgatttgatcttggggtatttccagtgatttttttttttttttgagatggagtcttgctctgtcgcccaggctggagtgcagtggtgcaatctcggctcactgcaacctccgcctcccaggttcaagcgattctcctgcctcagcctcctgagtagctgggattacaggtgcgtgccaccacacccggctaatttttgtattttttttttttagtagagacagagtttagccatgttggtcaggctggcctcaaactcctgacttcatgatctgcccgcctgggtctcccaaagtgctgtgattacaggtgtgagccaccgtgcccggcctccagcgattttttaatgtggaatataaaatgagatttttaaatctctgtagttttaaaacatatttataataactatagtgatatatcaaattctgacaatagggaaagatagttttgtgtttgaaattcctttaattccatctcagattctccagcagggcagctctcctcttctcactcaaaattgctgacttgtttttaagggttatgagaaacatcttttggaagatgggatccaaagtataaagtcgtgtgacttctcataacctgctccctcccagcactttgaacacaaataagctttgaaagtgtttggaggataagtctctgtaataaaaagttttcattgaaatgtagcagacttgaggatgagtttcctactcatatgtcctccctgattgagaagatacaatatattagaaaaggtatgtgaaaatgtctaagcacaatgatggcaaacaggttttaaagttcatttgcccctgtgtgtggtttttttttttttttttttttttgagatggagtctcactctgttgttcaggctggagtggagtggcacgatcttggctcactgcagcctctgcctcccaggctcaagtgatgctcctgcctcagcctcccaagtagctgggactataggctagcaccaccatgcccggctaatttttgtatttttagtggagacagggtttcacaatgttggtcaggctggtctcgaactcctgacctcaggtaatttgcctgccacggcctcccaaagtgttgggattacaggccactgtgcctggcctcctgtgctatttttatgttgtcagtaagttcattattatccaatgcacccaaaacattctttgtaaatatatgtctatatataccctcacagaaaagtatgtacattgtatgtatacagcttgataaatttttacaatctgagaacccatataatcagcagctaggtcaagaaacagaattttccagaatgtccccttatcctgaccttctaatcaccaccccacctatgtttttcatgaaatttttatttttatgtacaagtttttaacagttttagggaaattacatttgcttttaattacctaatgtatgtttaaacatcattaattagaaagaaatgggatattttgaacatttctatcagaaacttgaaaaaattttgttcataaaggtactcagagagctctgtgtcctccacatggctgacctaatataatgtggtaatagccacaaaaaggtaaaatacttagcatatagacttaacaacatgtatttagaatagatgtgtttatcactttgctgaaagaaatagatggagagacctaccttgttcttggatgggaaaaaaaagttagtttttctcaaattaacctattaatccctgttaagatcccagttcagagaagagagagaaaaaaaaacaacatatgacttataggaggcggcgaatagtgaaatgcattgggatttaaaatagcatctgttttagtagagatatggagctatagataataaatgagtaattttttaaaaggtctaaatgtattaagactgtcttctgtaataccttagatcttgtttacttagatttgctatattttattatgagttattaatacaaatttcaccacaaaaaacttaggaaaagaataaaatgatataatttcatcatggtatgatagttattgtattttttgctttccattcaaaaatttcatatacataattcccttaagtagaattattatacatttaatttttattctgcactttttaaacattaattttttaaaaatactaattcctacctagtctttgtaacaactatttttaatgattggttaatataactttgacaagctttagtaaaatttacttagtttttctgttccagatttttaggttgctttgagtttcttgctattataaataatgttgctccaagcacttttgtgttatatctaatctttcccagattttaactgtcttaaataaaatgttaagctgtataaacttaaaataagactgaaaattacttggcagtgaaagagcttttaaaattgattaaaacataagtacattcataacaaaaggagttacagtgactagtacctaacctttgtttcatttggcatcacagtctttcattagttgtcacactagccctgagacttaaatgttgtattgcatagatgtcaaaaatgagatttaaaggagtaaaataattttctttatggaacacattatgttagtgatggaactgtttttggttctgttagtataaaaaatgtgctaataggtttagacgttaaagtgtaaaaaccttccaactctccatatcctaaattacgtaatctttaaatgcatagtgtgtatttaggtgatattgaaaatagtggtaataatagctaacatttattgagtgatattgtttggagatgaagcagaaatttaacttcacaattgtagaaaaataattttctatatttaggttcttaggggtggaaaccatatagacaaacttcttgttataaatgaaaaagaaggttctgtttatttaattgacaattgactagaaacaggctgggaagactgtttcttgtcattaagtgtgaatatgaccaaactgttttaccttctaataaacaaaactttatctgtttgttgtatcttttcaaaatttaagaaatactggaatagctctatattcagagtagcttagctatctatctacttaactgtatatccacaaatattttacagacaaatgttgctttgtaatttagttggccattgtcatctccagcattcttagttactagatagactttataggaaaagttgttcctccaccatcttgccccttcagctccaaaatgtccatgaagtgtaggttattctgctttgagaccctttgttttctctctctctctctctctctctctctctctctctctctctctctcctctctctctctctcctctctctctctctctctctctcttttgttttttgagatggaatctcgctctgtcacccaggctggagtgcagtggcgcgatctcggctcactgcaagctccgcctcttgggtttaagtgattgtcctgcctcggccttccaagtagctgggattacaggcgtgtaccaccacgcctggctaatctttgtatttttagtagagacggggtttcaccatgttggccaggcaggtgtcaaactcctgacctcaggtgatccaccctccttggcctcccaaatagttgggattacaggcgtgagccatcatgccaggccttctcttaaggtagtctggtcttccctggagtatctgtaatggagcactatataaacagatcctgccatcagtgtatttaaagtactgctgctgaacgatattatgaatatcaaaatattgaagccatataattattctgtgtactgtgagcaccaaataggaaaattaataaaacataaaaccagcaggccttttgggggtatttttcttgcatgtatgtgttatatcctggatgagattttttttttttgccctaaagtctatctgtgatacttaactgtacaagtttcaaatatggaaaatactttttaaaaagtctaacttgcctacaatcagaataacaactctaattttatctggccagtagtttctcagttgaataccaatattaaattaagaataggattcagtcagatgatgcattactttttctaatattttataataggtgtgtaaattgcctgttttctgttttatagggagtttcaggtaacattgtatgtaatttttgaggagagaagctttttttaatagaggaaaagataaaattgttgatttataagccataagaaatctagtaatgcaggctgggcacagtggctcacacctgtaatcctagcactttgggaggccaaggcgggtggatcacctgagttcaggagttcgagaccaacctgggcaacatgatgaaaccccgtctctactaaaaatacaaaaaagtagccgggcatagtggtatgcgcctgtagtcccagctcctctggaggctgagacacaagaatcacttgaggtggaggaggaggtggaggtggaggttgcggtgagctgacatcatggcactgcactccagcctgggcaacagagcaaggctctgtctcaaaaaagaaaaatagtaatacaaatataatttgatcttaattttattcatgtgtttctaaacaatatgttacattatgtattacacaaataaaataataaaacaatgtattacattatgaatgcaatttgattcatatcttcccatcaacttaatattttagaagaaaaaaatcagaatttaatttaaaaaataccaataattattcaaagcagcattgggcccaataccaaccttaatgcttctaagctgtgcagttctgggaaatggtttaagttctccaagccaaatttcaactaaaaaatatggtgatattaagactgtataattaacaccatataattccaccatataattaacaccatataattaacaccatataattccacagtctgttaggaaaattaaataaggagatgttatataaagtgtttggcatcatgtctatccaagaactctgcaatagcagctgctttattatcagcacagagcactatcaccattagaacaattaccaactttacatttaattcttctaaaaccttgatcaaatcaataatgtgattttttgctctttcctttctttcctttcttttctttctctctctctttgtcttacttttttttaaatttttttttgagacgggagtctcactctgtcacccaggctggagtgcagtggcacgatctcggctcactgcaagctccacctcccgggttcacgccattctcctgcctcagccttccaagtagctgggactacaggcgcccgccaccatgcctggctaattttttgtatttttagtagagacaagtttcactgtgttagccaggatggtctcgatctcctgacctcacgatcctcccgcctcggcctcccagagtgctgggattacaggtgtgagccaccgcgcctggcccgtacgttcttttaaaatcagaatatgctatcgttaatgcctctctcattgtaaaggttcattctctttttaggaccacggctgaggttagggtgaagccattcaggcacttggaacaaaatttgagggagaaccctaaaaagccacagtaatcaagatattttaatgtaatattttaaaaattaatgcaaagactcactatgaacagaatatcaaactcaaaattttaaagaaaggcaaaatcaggaagagtactgtgccaagccatattggcatgtgaggcaaaaaggaaaaattaataatactggtcctatcttgccatgctgagccatgttagagcctgaggctcaaggaaaagtcataaaaacattcctattgctcctgtcttttgccctaggaaagtttctttccctatgccaggccttgctttaactatttaaatagccaatttttaaagaactgctcaccagaatgattttataggctatgaactcttttttacaaacgagggccctagaagttgggtgaaattacttgtgtagggtcacacaattttatcttttcctctattaagtttttctcctcaaagttactgctaacctctgagttgctaaattctcagtcctcaattaagttgacttagccgtcctcaatttaagttgccactaaatggcagaaccgtgatgatgtaacccaggtttcttaacttctagacttcctttactttattatctctttataaaacacatctgtgtatttgttggctcattaccctgagactgggtaatttataaagaaaagaggtttaactgactcacagttccctaggctgtacaggaagcgtggctggagaggcctcaggaaacttataatcatgacagaaagcaaagggaagcaggcatatcttacatggctgggaaaggaggaagagggagaagggggaggtgctacacacttctaaaccagatctcctgagtactcactcactatcatgacaacagggaaaagtcttaccctgtgatccaatcacctcccaccaagcccctcctccaacattggggattacaatttgacatgagatttggacagggacacaaaaatccaaaccatatcaactattttagttatgtatttgtgtttggagttgaaatagcaaacagaggaaatgtgttacaaattcatttaaataacatttcctggtcactaatctgtacagcagatacacagaaatatgcttcctatgctctgtaactaactgtttctttggttgtcttgactttaaaacttgtttgttatttagtattcttttagaggaataattttactaattaagtttattattttattaacttttaagttcaatattgtttataagagcatcataaaattttaattctgttacatataagctattctggcttggacacattttttaaccttttaacctttaagcttcagtttctgtgcctactaatgtaggtatgacaatagtattaacttatatgctgtgaggaataaaatgttaaatgcatgtatagtgctttgcacaatacatggtgcaaagtaatcaagaaaggtccctgttaataatatatgctgtattaacctgtataatgtagttaaagtttttggtaggtaggctgtaaagaataagacataatttgtggtcatgctgaatgctaggtattatttacagtctatgaatatggactttttttttaatacggtatttaaaatagtagtactaagaaagtggtgaacagtgatttagaaataataaacttgtaatccaaatagcctttagaaaagttactgctaacctctgagttactaaattcacagtcctcaataaggttgatttaccagtcagattaactatcatagtctgtcatttgtctatcattctgtccctcttcctgcactcttcatctggcttctaagatgccatgatggtcttgatttccctcctcaaaaaaatggttgttcctttttagtcccctcttctcccttgtttcttaatattgatgcatcccaggactctgtacttgattcttttctgtttatctataatcagtcctctggtgatcttacccagttttatagctttaaatactacatatgtgctgacaactcataaatgtataaaattttcagctaaaggataatttgtgcctcatttagcaattgaaattcctaagagggtatctccatcatattgcttatcaatttagactttccaggttggcagagtatttccaatctccttttatttttatttttttgaagcattttatttggatgtttaacaacaattagttttttttttaagacagagtcttggtctgtcgctcaggctggagtgcagtggcgcgatcctccgctcgctgcaacttccgccccctgggttcaagcgattctcctgtctcagcctctcgagtagctgggatcacaggcttgcgccaccacgcgcggctaatttttgtatttttggtagagatggggtttcaccgtgttagccaggatggtctcgaactcgtggcctcaggcgatgcgcccgcctcggcctcccaaagtgctgggattacaggcatgagccactgcacctggccaacaacaataagatactaagaagcagtgtacagtgaaagtgaaatcaagttcaatacttcatttcttgacaactgaagtataaaaggctctgtgttcaggaaaagttagaaaaatagaccattttatgtatatgtattttttccctcataataattatagtaggggaaactgggtgtttggcttatacatgtttttttaaaaaatacagtaggataacacatttttctccctgcctttctctcatgctttttgcatatagacaacctaagttagtttctgcattggagctaattcacgtttctcagctggtaaccttagagatgtaactgggctagccgggggcatagaccaaggcttgattgaaagctgtgtctgacctatctagtgatgcagattcatatgaaacttgggcaataagatgttgttgttgtttttccctccagtgtcttattttaggagtggggattttcactccgggtactgattttctcgtaatcagtctggttttaactcctcacctcatttaggcccttttaattatcagtcattgatcttgctgctttctgacctgaaatccaatagacctctgtgacttttagcacgtacccattgcttggcatttttctttctggtcagttattggtggtagtgttttgtttagtctcagtggggctgtcattttcaaatgttctcctgtcatttctgtacggttggaaacaggcagatcgttttcttcattgctttaaaattttggttgtagtcttttcctgaatttatttgtatttctttttagcatttctttatctcagttttagtatcatttttaaaaaaaatgagatggggtcttgctgtgttgcccaggctgctcttgaactcctgggctcaagcagtcctcccacttcagcttcccgagtagctgggattacaggggtgtgccactgtgtctggtttagggtcacttaaagaaaataatcacagttgaaatcactgacacttaaaacttatgaaagtttatttgaaactgcataacaaggaaggtcacagacatgggctttcaatcaagtcctgagctaactcagcttgcccagtgactggatctcagtattaatttcatatacttaaaacactgttatctgaaaacaattcagaatttttttcttaaaaggtgatactaagtagaataaattttgattgtaaaaattataaacgtaaaggcctcaagtaagaatgtaagtttataaatgtatatgttatcaacctacattaaagtatcatagtatcattaaaaattgatgctacgtaaaaataatagtgcctaattgtgatagtgtttggtctttaaaaaatggttttataaacaagatggttgagttgagcaaatgttcagatgttccaaatgctgaaaaagctctctgaccctattctactggggaatcttatgggaaaatatttataaactttccagattagttaatcttcacataatcccatctcttggagagaacttttggggaagatacgggggagcaaggatttcattcttttattaatgtcaagttgtagtgttgcttcaaagaaaggcttctcttgtcttatgtgtaaatggagattttaatgcagagttacttttatttcagtatgaagtgttaatattctatctgtttgaaaaatctctgaggaagatttactgttgcaatagaagccttttccttgtcaatttatatttttcttctttttcttctcgtggaggtaaatggaagcatggaagaatgctttccatatgaatatacttttctttgatttgaaattgtaatacagagtataagtctagatacatctaaaatataaatgattcagattttacattttaaacttactgaaatatcaaaattatactaataaagatacattgatttggtacttaaaaatagcctaatatgctcaaatgttagaatccttgaaaagtagtccagctgttttggaggagtgtgtgtgtgatgttgtttatgtgtatgtgtgtgggagggtatgtctcaatgtgtgaatttaacaatcccagcttacctggaagttggattttttaaaatgtatttttttcttttagttgaagagaatgaagattgctttgtatctgtattagatatcagtgggatataaatcattttgttattaaaaatgttaatagtttactcttaacacctttgcccctttctgttattaaataatattttcacaaagtgttaacattttttagtgaatgaaaattaaaaatatgaactataactgagtggcaagcatagtatgtacagttattctaggattagtagattaattacctttctaaagaaaaattttttttcagagacagggtgtcactgtgttgcccacgttggtctggaactcctgggctcaagtgatcctcctgccttagcctcccaagtagctgggattacaggtgtgtgctgccacacccacctggattacctttctaaattttctgtgtaattttccccatgttttccccctatccaagtcccctaaaggtttatttttactgctgtttcgttttctgcaatcctctagcttccctgtttaccctcccaggctcccattgtttcttttagcagggtgtcagtctgatcattgagactagagggatgagttaagtctattggacctcctaagatttaggttgtatgctgctactgtcatttcctaacatcatgaccctgaggaaatcaaagtcatgtaatttctctgtgccttaatttgtttcttcgtctttaaattgaggatgtttcctcctaccttccacagagttacttggcgttgagacaatgtatgtgatagtgttttagaaatcgtgctaccttcacaagcatttccattgagtaatctgagacttaattactttctggtgagtttttttcacctccaccattatgtgtatatagtttttttctgttttaatgcatgttcactgtagaaaatatgggaaatacagaaatgtaaagaaaaaatagaaatccagacaatgcatcatccttttgttgttgttttaagaggaaatttagttttgagactgagctcccagagggtaaggatggtgttatttatttttggattttctcttcttaatctgcactaggcacaacattaatgcaggtttaatgagagggaacttagtgtagctgtatttcttgaagtcaaaacctgatgaaatttggccatttgaagagagaaaagaagacatctgtctagcaaaaataataatagatacatgttttgaaattacatttttccattggccgaaagaacacaggaaaacatgataggggcagtcctaatattctctgacagaggttaggaaaccagttaaagctgttggatatggaacttatggacactatcatatcaaagtgggttggcattttcctggtgaaaatgacataaataaaattaaaagacttttttaaatgaatgcttggaaattgtaaaaactgtcatttcctctttttatttcttaacaggatggcttaaattccttggtccttgatttagattttcctgctttgaggaaaaacaagaacatagataatttcttaaatagatgtaagtatgtttaaacttcatatttgatcttataactctacttttgataagagatttttgtttggttattatcagcctataaatttattaatttaatcaacttatttattaaacttaagtcttttgcttaccatttgatttattcaaaaattgttacttttatttttaaagcaattgcagaaccgaattacaatatgcaaagcagataaagttctaaattttgaaatacattattaagactattttaggacaggttatttatagcagtttgaagagaagttttaaattaatatttacaattccaagacttaatattgcccagagaattaataagctttatacttctgtaattgtggacatttcagactagttaataataaataatgtaactattattaccatatgtgtggtaacccttaatctttgccattattaatgttgcaatgcagaagtaagtgaaattgaattccaagaataagaaattctcaaaacaattaatgtatacattgtatcatcacagtaagctctttactttgaaattggcagagactgaggtattttcccaattaaacaatcttatctatagttactatttatatagtatgattaccacttttcagagaagtaggccatcaaaattcattactaagattagccttgcaagtaatttcatggcaactttctgccatgattcagagtgcacaccaggattgcttgggtcatcactgtgtcagctatcatctaacttgctaagcaacagaatcagaaacagaatagctgtaactgctactttttggcagtcagtggtgttcatttatatgtgttaataaaccatagagagttttggttctttaacgttaatgtatatcttagatttttaactaacagcctttaaaaactggcaagtttagctaaaaactgtcttttcttgaaacaaaaatatatttataaatgttgattatgtaaaaatataaatatgattgatattataagtatggtgatctttttatggtagatgagaaaattgtgaaaaaaatcagaggtctacagatgaaggcagaagactatgatgttgtaaaagttattggaagaggtgcttttggtgaagtgcagttggtaagaaagtgttttgttcttattgttctctatgacatcatggttttgtgaagcattatcaatagcagctgagtagatctaatttctatgcccacccatgccagaaggtggctttgtgatcttggtcagtgtcctcatctataaaaggaagcctttgttgtctactctgggtctcttccagctctgaaacacattgtagaaaataaggccaatatagcttcacatgtgatctgcctagcagttactattccaccagaactgttgtatttttatttagaatgttcagattaaaaacatctgcttaaggaactgagatttatttagatgtataagaaacctaacagataaattttaataactgaaattaaatctgaaatttattttcgcaggccatactggtaccaattggaattataagaaatgttgacaataactattacctttatattattggctttggaactcttcctaatctcgtattcctgttttcatcacctgagtatatgaaactcctctattattgtccttatagttaaattagagtcaaattctcttcttcacactacagcgtttacccctcttgatggagcactaagaaaagtagtgatcattataagccagcatggattttgttaagaacaagtcatgatagacttttttttcctttcattgcttctttctttgggttttttgtttctttttgttcctttttgagacagggtcttgctttgtcactgaggctggagtgcagtggcacaatcttggctcactgcagtcttgacttctcaagctcaagcagttctcctacctcagccctccaagaagctgggactataggcatgtgccacacacccagctcattttttgtattttatgtagagatggggtttcaccatgttgccgaggctgatcttgaatttctggactcaagggatctacctgctcggcctcccagagtgctgggagtacaagcatgagacacctcactgtgcctttcttgataggtttattggacttgtagatcagggtagtgcaatttatgtaatacatatccataagaagaatattattcttctgaagaagtctgacacacttgaggataatatgatgaaatggcacagtaataattgtatgggtaggcaagctttataactaatgtactagttttattccaaggaggctggtgaaagcatggatggtacatgggacagagacctccaagaaaggtttcagggtccctcttctcctattaaacatttttttttttttttttttttagacagagtttcactcttgttgcccaggctggagtgcaatggcgcgatctcggctcaccgtaacctccaccccccgggttcaagcaattctcctgcctcagtcttctaagtagttgggattacaggcatgcaccaccacgcctggccaattttgtatttttagtagagacagggtttctccatgttggtcagtctggtcttgaactcccgacctcaggtgatccgcctgcctcggcctcccaaaatgctgggattacaggcgtgagccactgcacccagcctcctattaaacattttaatgacttgtttgggagcaatggtagcacgttgaataattttgcaaatgagttaaacctgaagtataatgaggatgattttaggtgatgagccaaaattcagaaatcatcaatgggaaagaacattggccagatagaagtgaaattgaaccagaatatagtacttggatgtgaagaacacagggaatagttgcttaacagtactgtcttaattaaagaaccattttccttggattgtaagcaggcaagagtcattaatgatcagactacctaaagtagtaaagaaatttggggctgctttaatataatttctaaattgatagaaattgatggaccatacctgtaatattttatttattctagatgccctgttggcctgtttttttaaaaaaagactttagtttttttaagagcacttttaggttcacagtaaaatcgagaggaaggtatagagatgtcccatataccccttgccccaacgtgtgcatagacacttccattgtcagcatccctcattagagtacatttgttacaactgatgcttacattgacacattatactcacccattgtcatagtttacattagggcttgctcatggtggtgtacatcctataggtttggccaagtgcacaatgatatatgcccatcgttatactattatacatagtattttcattgccccaaaaatcctctgtgctgtgcctattcatctcccagccccaagtctctggcagtcactctttttactgttttcatagttttgccttttccagaatgtcatgtaattggaatcatacagtatgcaaccttttcagattgtcatctttcactgagtaatatgcatttaaggtttctccatgtctttttgtgatcctttagcttattactttttactaaacaatattctgttgtctggctgtaccaaagtttatccattcacctactgaagggcatattgattgcctccaggttttgacaattatgagtaaagcactatagacatccatatgcaggcttttgtgtagacataaattttcagttcatttggttaaataccaaggatcttgattgctggatcataggataagagtgtatttggttttctaaaaaactgccaaactgttttctaaagtggttgtaccactttgcattcctaccagcaatgaatgaagattcttcttgcttcacatcctccctggcatttggtcttgtcgctgttataactgacaaaaaacaagtgttttggttatttgattaggtgtttaacagtatctccttattaatttgacatttccctgatgacatatgatgtggaacatcttttcatatacttatttgccatctgtatatcttttcctttttttcttttctttcttgcttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaatttttttgtatttttagtagagacggggtttcaccttgttagccaggatggtctcgatctcctgacctcatgatccacccgcctcggcctcccaaagtgctgggattacaggcgtgagccactgcgcccagcctcttttttttttttttgagacggagtctctgtcgccaggctggagtgcaatggcgctatctaggcttactgcaacctccgcctcctgagttccagtgattcttcctgcctcagcctcccaagtagctgggattacaggcacttgccagtatgcccggctattttttgtatttttagtagagatggggtttcaccatgttggccaggctggtctcaaactcctgacctcaggcaatctgcccaccttggcctcctaaagtgctgggattataggcatgagccaccacgcctagcctgtatatcttctttgatgaagtgtctgttcaggtctttggcccattttttgattgggttgtttatttttttttattgtttagttttgagagttctttgtataacaaattcttttggataatagacctttgtcaggtgggtgtttttcaaatattttcccccagtctttggtttttcttctcatcctcttgacattgtctttgagtagtagacaatttgaattttagtgaagttcaggttatcagttctttctttcttgggttatgtctttggtgctatatctaaaaaaccattgctctaatcaagataatttaggttttctcctatgctatcctctagaagatataaggtctggtcttgattcttttttttttttttgcatgtagatattcagttattccagcaacatttgttcaatccatcgtattgcctctgctcctttgtcaaagatcagttgactatatttatgtgggtctatttctgggctctctattctgtttcattgatctatttgtcttttctttcaccaatatcacattgtcttgattactgtagctttatagtaagtctataggttggatagtttcatccctcccattttgttcttccttatttatttttaattattattttttgagacggcatcttcctctgttgcgcaggctggagtgcaggggtgtgatcctggctcactgcaacctctgcctcctgggcccaggtgatcctgctgccccagcctctcgagtagctgggactacaagcgtgtgccaccactcctggctaatttttgtatttttagtaaagatggggttttgctatgctgcccaggctggtctcaaattcctgggctcaagcgatctacctgccttggctttccaaagtgctaggattacaggtgcgagccactgcacctgactgttctttaatattttgttggctattctgggtcttttgcttctccatataaactttagaatcagtttgtcaatatccgtgaaataacttactggggttttttttgtgattggattgaaaatatagaccaacttggtctatatttgaagaaccggtatcttgacaacattgagtcttcacatccaagaacatggactgtctctccatttgcttagttctttgatttctgtcatcagagttttgtagttttcctcatatagatcttatacatgtttagttagatttatgcctgttttatttttgtaggtgctttaatgtaaatggtactgtgtttttaatttcaaattccactttttcattgctcatatacaggaatttaatttcatatacattgctcatatacagaatttaatttcaaattccactttttcattgctcatatagaggaatttaatttcatatgtattgctcatatacagaatttaatttcaaattccactttttcattgctcatctacaggaaagcaatgaacttttgtgtattaaccttctgtcttgcaacttggtataatgacttgttccaggaaactttcgaatcctctacatagatgatcacatagatccttcccaatctgtatacgctttacttccttttcctgtgttattgcattacctcggactttcagtacagtgatggaaaggattggtgagaggaaatgtccttgcttttgttcttgatcttagtgggaaagctagtttcttaccagtaaacatgaagtgagctgtggattttttatagatattcaagttgaagttcctctattcttcatgtactgaggtttttttttttttttttttttttaaataatgagtgggtgttggatttgtcagatgctttttctgcatctatgatatgatcatctgtctttcttttttagcctgttggtgtgatggattacaataattgattttgaaatgttgaaccagtcttgtatacctgtaataaatcccacttggttgtggcgtataattcttttacaccgcataatacattgttggatttgattggctaatattttgttgaggatttttgcatctgtgttcattagagataatggtttgtagttttcttgtaatatctttgtcaagttttttgctgacctcgtagaatgattctggaaatattccctctacatctgtcctctaaaatacattatagataatttcttcctttaatagttggtacatttcaccactgaatccatctggacctcatgctttctgttttggaaggttaataactattgatttaatttatttaataacagtaagtctgtttcttcttgtatgagttttggcatattatgtctttgaaggaattggtccatttcatctaaattattaaatttgtgggcatagagttatcattcattcattcactgagacaagttcttgctctattgcccaggctggagtgcagtagtgtaatctcagctcactgtaacctccgcctcctgggctcaagtgatcctcccaccccagcctcctagtagctgagactacaggtgtgcaccaccatgaatggctcaattttttttttttttttttctgtagagatggggtttcaccatgttgcccaggctggtctagaactcctgaactcaggtgatccgcccgcctcggcctcccaaagtgctgggatttcaggcatgagtcactgcacccggacccttattatccttattaatgtctgtggaatccttagtggttttccctccttcatttctgatattggcagtttttattctctctcttctagccaacctggctagagccttatcaatattattggtcttttcaaagaaccagcttttagtttcattgatttttgtgtattcttgttttctattccttggtttctgctctaatttttattatttattttcttttgcctacttggaatttaatttgtttcttctgtttctagtttcctaagttggaaactcagattattgattttagatatgtgcattaagcactgctttcactgtatcccaccaattttgaaaagttttgtttttattttcatttatttcaaaatatattttaatttctcatgagattccttctttgacccaagagttatttagaattatgttgtttaatctccacatattttgggattttctagttatctttctgttaccagtttctggtttaaatccatagtgatctgagaatagacacagtatgatttctatttgaagtttgttacggtgtgtttcgtggcccagaatgtgatttatcttggtgaacgttccatgagagtttgagaaaaatgtgtattctgctgttgttggataaagtagtctatagatgtcagttatatccagttgattgatggtattgttgagttccactatattcttaactggttttctgcctgctggatctgtccatttctgatagagcagtgtcaaagtctccagttatgatagtgaatttatctctttcttcttgctgttctatcagcttttgcctcatgtaatttgacactctgttgatagacatataacacattgatgattgttatgtcctcttggagaattgatccttttatcagttatgtaatgcccttttttatcgctggtaactttccttgctttgaagtttgctcgtctgaaattaatatagctacttctgctttcttttgattattgttatggtatatttttttccatccatctacttttcatctatatgtgtctttatatttaatgtgagtttcttatagaaaaaatatagttgggtcttttttcttgattcactcaatctctgtttttaaattggtccatttagacttgtgacattcaaagtgattgttgatatagctgaattaatattaccatatttgttgttgttttcttttgttgcctatattcttgttcctatttttgtcttccattctttttctgtcttttttggttttaactgatcatttaatgtgatttcattttctctcctttcttagcagattgtttatacttttttttttgctttttatagtgtttgtctacttttttccttttttttagtgtttgccctagagttttaaatatttatttacatttctgagaaaattaaaaataaaaccaccagctgggcacggtggctaatgcctataatctcagcactttgagaggccaaggcgggtggatcaactgaggtcaggaattcgagaccagcctggcgaacatggcaaaaccccgtctctactaaaaatgcaaaaaattagccaggcgtggcggcaggcacctgtaatcccagctacttgggaggctgaggtgggagaatcgcttgaacccaggaggcagaggttgcagtgagccaagatcgcaccattgcagttcaggctgggcgacagagtgagactctgtcttaagaaaccaaaataaaataaaactacctttacaatccagcaattccactagtaggtatatatctaaaggaagtgaaatcattatttagtagaggtatctgcattctcatgttcattgcagcattattcataagagccaagatatggaatcaacctaagtgtctaacaatggataaagaaagataatatggtatgtataaacaatggaatactatttagccttacaaaaggaagaaatcctgtcatttggaacaacatagataattgatggttggaggatcttgtattaagtgaaattagcccaggcacagaaagaataccacatgatatcacttatatgtggaatccagaaaagctgagtgcatggaagtagagaatagaatggtggttaccagcagctagggagatctttgtcaaaggatacaacatttcagttagatgggaggaataagttaaagagatttatggtacaacatagtgactgtagttaataatgtattttcaaaaaatctctaaaagaatagattttaactgttctcaacacagaaaattaaaagtatgtgaggtaatgcttatatgttaattagctggttttagccattctacagcatatacttacttcaaaacaccatgttgaacaccataaatatatgcagtttttgtcaattaaaaaataaaatttttatgaaaggaacttcaaatgctaaatgaggaatcctgcctgtaaatcatgctctatgattccataagacattctggaaaaagacaactttggaagcagtaaagattagtgcttgctacccagaggaaaagaagtcatacgaaaaagatacttgcacacacgtttatagcagcaccattcacaattgcaaaatcttgggaccaacccaaatgcccatcagtcaacgagtggataaagaaattgtgctatgtatatatgatggaatactactcagccataaaaaggaatgaattaacggcattcatagtgacctagatgagattggagactattactcgaagtgaagtaactcaggaatgcaaaaccaaatatcgtatgttctcactgatatgtgggagccaaactatgagtacgcaaaggcataagaatgatacagtggactttggggacttgaggggaatgattggaggggtgcaagggataaaagactacaaatagggtgcagtgtatactcttgggggatgggtgcaccaaaatcttacacatcaccatcaaagagcttactcatgtaactaaacaccacctgtaccccaataacctataacctatgggggaaaaaaagattggtggttgccagaaggttgtgaaggggtgaatgggtggagcacagcggatttgtggggcagtgaacctattctgtctgttaccatattggtggatacataacattttatctgctaaggccatagaattgtatagcacaaacagtgaaccctaatgtgaactctggacttcgttaatagtaatgtatgaatattgctttatcagttgtaacaaatgtaccacactaatgcattcctgtaatatgttaatattagaggaaactgaaaaagagaaggggacagggagtatatagtaaatttgtgtaccctattcggtttttctgtaaacctaaaactgttctaaaaaataaagtctattaataaaaacatgaaaaaagaaatatactcacagtttatccaagtcccctttcaaatcacagcataccacttcacggggggtgtaaaataccttataataacaaaataatcctaattccttcctcctgttacgtctatcattgctgttattcattttgtgcatatatatgtatacatacacacacaccagtacacatacagacaagcatatgttactgaatatattgttgctgttattattttgaacaaatttatttgttagatcagttaagaacatgaaaataacagtttttgttttactttcacttatttcctctatttctatttttgcaagaaacatcattggagttacagggtttgcattgactctaggttgttttgggtaatggtcattttaacaatactaagtcttccagtctaataacaagggactgggttccatttacttatgtcttctttaattccttttagcagtgttttgtagtttttattagatgtctctttcaattaagttaattcctaaatgttctttttgatgttattgtaaatggaattgtttttgtaattttcattttagattgtttatttttagtgtatagaaatataattgacttttgagtgttgactttgtatgccgcaattttgcctaacttattctaatacattttttgggaggtgggatctttaggattgtctacataaaagatcataaatcacttatggacaaagatagttttatttattttttattatctaatttctctggctagaacttccagtgctatgttgactagaagtggcacaagccttttcttgttctttatcttagcggaaaaacttttagactttcactattgagtatgatattcacgtgggtgtttcacatatgtagtttattacgttgaggtggttttcttttactcctggtttgttcagtgttttctttttgtaaatcatgaaagagtgttgaggcagggcacggtggctcacgcctataatcccagcactttgggaggctgaggtgggcggatcacctgaggtcaggaatttgtgaccagccaggtcaacatggtgaaaccccatctcttctaaaaatacaaaaattagccgagtgtggtggcaggcagctgtaatcccagctgctagggaggctgaggcaggagaatctgttgaatccgggaggtggaggttgcagtgagctgagattgcaccactgtactccagcctgggtgacagagcaagactttgtctcaaaaaaaaaaaaaaaaaaaaaagattgttgaattttgtgaaatgtgttttctccctcaattgaaatgattatgtgttgcttacctttattctgttaatgtggtttaatacagcgattgatttgcacatgttttaccatccttggattctaggaataaatcatacttggtcatgatgtggaaaccttttaatatactgctgatttcagtttgctagtaatttgttgagaatctttctgttaattttcagaagtgaaactggttgatagttgttttctcgtacagtcacctgcccttacctgtagttttgctttctacaatttcagttgcccgcagtcaaccagggtctgaaaatattacatacaataaggtattttgaaagagagagagagaccatattcatatagcttctattaaagtatattgtataattgttcttataattcttttttttttttttttgacatgaagtctcgctgttgtcccccaggctggagtgcaatggcacgattacggctcactgcaacctctgcctcccgggttcaagcgattctcctgccttagcctcccgaatagctgggattacaggtgcctgccgccacgcctggctaatttttgtatttttagtagagatggggattcaccatgttggccaggctggtctcgacctcctgacctcaggggatctgcccgccttggcctcccaaagtgctgggattacaggcatgagccactgctcccggcctgttcttattattcttaatttttactgttgcttagtttataaattgaactttatcatagatatgtatgtataggaaaaaacataatatatatataggattcagtactctccatggtttcaggtaaccactggggtcttggaatgtatttcctgaggataagaggggactaccgtgatgtctttatctgtccttggtatcagggtaatgctggcctcatagaatgagttaggaggtgttccttcctcttcagttttctagagaagtatgagaatgattgatgttattgaaatatttggtagaactcaccagtgaagccattaggtaaagagcttttctatgtcaggaaagttttggttactgaatcaatctctttactaattgtaggtctatttatattttctggttttttgtgtgagttagtcttggtagattttgtgtttctaggaatttgtctgttttatctaagttattctatttgttaacatagaattggtcagagtactctcttaatcattttaattttcgtaaagtgggtagtaatgtccccacttttatttctgattttaataatttgagcattctctgtttttttaattagtccatctagccagaggtttgtgactcttttggattgtttcaaagaaccaacttttggtttcattgattttgttgttgttgttgttgttgttgtgttctctgttttatctttgctctaatctttattatttccttgcttctgatggctttgggtttagtttgtttttctctttctagtttcttaaattgtaaagtttcgtttttaatttcagatcattctcgtttttttaatgtaagcatttatagctataaatttctcccatatactacttttgctgtattccgttaagttttttgttgtgttgttttcatttgtctctggagtatttcctaatttcccttctgatttcttatatgattcgttggttatttgtgtgttgtttaatttccatgtttttgtggattttctcattgtagttattttatcgaagtctttttttttttttttgagatggagtcttgctctgtcacccaggttagagtgcagtggcgcaacctcggctcactgccagctccacctcccgggttcacgccattctcctgcctcagcctcctgtcttttatcgatttctgacttcatcccattgtggttggaaaatatactttgtatgtctatctttttaaatcttttgagacttagtctgtggcctgacatatgatctgttttggaaaatgtcccatgtgcacttgagaatattatatatgttattatgtgttctgtatatatccctaagatctagttagtttattgtgttaagtcctctgtttctttactgtatttccatactccattctattaagtgataatagagaatgaaagtctccaactattattatagagctgtctatttctccctcagttctgtttttgcatcatatattttgatggtctgttactaggtctataaatgtttgtaattgctgtgtcttcttactgtgttgaaacttttattaagatataatgtttttttttgtttcctgtaacctttattgatttaaagtgtatttggtctgatattagtatagccacttctgctctcttttggttactatttccatccttccactatcaatcagtttgtgtctttggatctaaagtgattatcttatggacaatgcatagatggatcttttttttaattcattctgccaatctctgtcttttgattggagagtttaactcacttacattgaatgtcattactgggaagaagaatttatttctgttattttgctatttgttttctatatgttgtaaagctttttttttttttttttttttgacccttatttcctgcatttctcttggcttttgtgttcagttcattttcttatagtggtatgtttacattctttctcaatttgtttagtatgtattctgttttctttgtagataccataggcattacatttaacatcctaaacttataaaaattcagatgtcaatttataccagcttagcttcaagaatatacagtaactcttgctcttttttttttttttttttgagacagagtcttgctctgtcgcccaggctggagtgcagtggcaccatcttggctcactgtaacctctgtctcccgtgttcaagtgatttccctgcctcagcctcccgagtagctggggttacaggtgcccatcaccgtgcctggctaattttggtatttttagtggagaccatgttggcaaggctggtctcaaactcctgacctcaaatgatccacctgcctcggcctcccaaagtgctagggttataggcgtgaaccactgcagccggccagctctgcttctttaacagctctgccctcaccctttccagttgctgtcacagaattacctccttattcattatgtgccccaaaccataaactaatcactttaaatgcatcaattttttatatagaacaaaatgggtttatgaaacaaagtttcaataatactagcttttagattaataatttaaaaatatgtattggccttttaaatcatgtagaaagcaaaaagtgcaattataatccattattacagtaatactggactttataattgtgtgtgtatttacctttattgagatttttatttcttcacatgacttcaacttactgtttaaacagtgtgttttcatttcaccctgtaggacttcattgaccatttcttgcaggtcaggtctactggtaacaagctcccttaatttttgtttatctgttaatgtcttaactttcctgtcagtttagggaaaacacaacaaccaaaaaacccagtcaaacaataacaaagctttgtcactttccaaggcagtcctttcctcagatctgctccaaatgaacctttcaattctactttttttttttttttttgagatggagtctcgttctgtctcccaggctggagtgcagtggtgtgatctctgctcactgcaagctccgcctgtcgggttcacgccattctcctgcctcagcctcccgagtagctgggactacaggtgcccgccaccacgcccggctaatttttttagtagagacggggtttcaccgtgttagccaggatggtctcgatctcctgaccttgtgatccgcccgcctctgcctcccaaagtgctgggattacaggcgtgagccaccgcgcccagccccgaacctttcagtcctttcaacctcagatggcattgtttcaagttcccagagcaccataccccttgagtatatcctatcaatatgccctttaaaacagggcaacaggtttctggttgcacaagtaaggagcttggaaatcaccatccatcctaacaacaaataaaatgctgaagagactgaaaaaccaacagtgcttccgggatccaaaagacaggtgaggacaccaaacaaaccactgaccccaaactagagagacaaacaaatagccatggctataagatccaggattcataagcagaaattgccacgagaaccagtgctgaggtaggaaaacctgagctgtaactgacaaattgctgggggctaagtggtggtcaagtcagacaattaaaaacttgcaggggacccagttataggtgagcccccacacctttacagattttatatccaagagctcaaccagagtctcacagtgaatattggagaaaaatctcctcatgcttccaagaagattaaagggaaaggaacattttgaaatatgccacagcatttgcttcttaacaaggcctgccctccagatgtaaccagagcataatggaacttggggaaggttaatacacaactccagcccacactagccatcctatgactcagaagcacatttaaagttcacagtatagaggcataaggattcgctgagacctaatcataagactatagaacactgcccacaagattgtagaacctaaaactataggaaacattgcctcactctacaccttatattactaaagacctatttacagaagttccttttactcaatgcatcatgtcccgctatcaaggaaaaattacaaagcatactaaaaggcaggaaaaaagattttgaagagacagtaagcattagaagcaaacatggtaggaacactaaaattatcaaaccagcaatttaaaagaactttgattaatatgctaatggataaaatagcatgcatgaatagagtggtgatgtgagtagagagatagaaatcctaaggaacaagtgaaaataaattctagagatcaaaaacacttttaacagaaatgaaaagtgcctttgatagacttattgctagactgaacaaggttgataaaatatctctaagtttcaggatatatcaataggtacacccaaaactgaaagcatgtagagggaagactgaaaacatcagaacagaattatcacagaaccatggaaccactagaaaaggtgtaaaatatgtgtaatgggaatacaagaagaagaaaaaaacaacagaagaaacatttgaaataatagtgaaaattttacccaaattaatgtcagacaccaaaccacagatccagaaagcccaaagaacagaaagcagaataaatgtcttaaacgttagatttaggaatatcattttcaaactatagaaaaccaagcataagaaaaagcctgaaagccaagagaagaaaaagcctaacaaaccacactttacctatacaggaacaaagataagaattttatctgacttctcctcagaaaccatgcaagcaaaaagagtggaataaaatttttaaagtattgagaataaaaaagaaagcaaaattgcgaataaaaaagaaagcaaaattaccaatctagaattctgcactttaggaaattatccttcaaaagtgatggggtggctgggtgcagtagctcatacgtgtaatcctggcactttgggaggccaaggtggaaggattgcttgaggccaggagtttgagaccggcctgggcaacatagtgagaccccatctctacgagaaaattaaaaataattagccatatgtggtggcatgtgcctgtagtcccagctactctggaggctgaagtggcaggattgcttgagcctgggaggtcaaggctcctgtgagccatgatcataccactttactccagcctgggtgacagagcaagaccccatctcttaatgaaaaagcacacaaacacaaatgatggggagagagaggattctgaaaagagaggggagtaacaagcaagaggaatctctttcgttacctggacaacaatcacaccggcagaatatgtcttatatccgaagaaacaggaaaatgtatataggccattcaaagaaaacaaaaacaaatcaaaagaaaccgtccttgaaaaagacctgatggccaatatggccgatccattcaaaaaagattttttttttttttttgagatggagtcttgctctgtcacccacgctgcagtgcagtcgtgcagtcttggctcactgcaacctccacctcccggttcaagagagtctcgtgcctcagcctcctgagtagctagtattacaggcgcctgtcaccacacctggctagtttttgtgtttttagtagagatggggttttgccatgttggccaggctggtctcaaactcctgatctcaggtgatccgcctgcctcagcctcccaaagtgctgatattacaggcatgagccaccactactggccaaaacaaagactttaaaacagctatccaaaagatgctcaaagaactaaaggaagatgtagagaaagtcacgaaagtgatgtatgaccaatatgaaaatatcagtaaagagacagaaaacctaaaaagaaaccaaaaaatttctagagctgaaaagtacaataactgaaataaaaaacactaaaaggagtcaaaggggcagatttgagccggcagaagaatcagcaaacttgtatatagtaaaatgaagattactgagtctgaggaacaaagaaaacagattgaaaagtgaacagagtctaaggggtatgagtaggacacattcaaatagaacaaaatagatactgtgggagtaacagaagaagaaagagacaaaatatttgaatgggtgtaaactcccgaattttgatgaaagccatgaatatccaagaaagtcaacaaaatccaactaaaatgaacttgaactcaaggaaatctacaatgagaaatcttacggtcacacttgaaaattacaaagagaatttgaaagcagcaaaagagaagtgatttgtcacatacaaagaatcttcaatagattatgaatagatttctcatcaaatatttcagaggccaggagacagtgggccaatatattcaaagggctgatagaaaaaaagtcatctgtgaatgcagagacacacacacacacacacacacacacacacacacagtgcaaaactgttaaatacacacacacacacacaaggaaaaaaacacacacacacagtaaaactgttacatccggagggctgaccttaagaagcgaatgctgtggcatatttcaaaatgttcctttccctttaaccctcttggaagtgtgaggggatttttctccaatatttactgtgagactctggttgagctcttggatataaaatctgtaaaggtgtggggtctcacctataactgggtccctttcaaagtttttaattttctgacttgaccaccacttagcccccagcaatttgtcagttacagctcaggtttcctacctcagcactggttcctgtggcaatttctgcttgtgaatcttggatcttgtagccatggctccctttatttgtttgtctctctagtttggggtcagtggtttgcttggtgttctcccctgtcttttggatcccggaagcactgttggtttttcagtctcttcagcattttatttgttggtaggatggatggtgatttccaagctccttatctgtggaaccagaaacctgttgccctgtcttaaaaggcatattggggccaggcgcggtggctcacacctgtaatcccagcattttgggaggctgaggcgggcagatctcctgaggccaggagtttgagaccatcctggctcacacagtgaaaccccgtctctgctaaaaatataaaaaattagccgggcttggtggcgtgcacctgtagtcccagcgagccgagatcgtgccactgcactccagcctgggtgacagggtgagactccatctcaaaaaaaaaaaaaaaaaaggcgtattgataggatatactcaaggggtatggcgctcaggggacttgaacaatgccgtctgaggttgagagaattgaaagtttcatttggggtacatttgaggagaggactgcctcagaaagcaatgaagctttgttattgttcggggtttttgttgttgtttgtgttttttggtttttggttttttttttttgtatgtgaaaatggtgaagctttggcttttagaattttggtactgtggtcgggagagtgggagattagatgacatgacagttgagttatagaagagcctaaagatagggaaaatatatagtagttgaatcctagctcttccattttctaactcagagatcgtggtgaccacaggcgtgagtctttctgagttcccacctatagcatagagataattatacctatcttatgggagtcattatgggggattaataatataaataagcctggtcaaagtgcttcctaagggttaattgtattattgcctattggtatatagattcatgctgtaaatattttaaacagatgcattgtttctgcatacctgtgtagttatggaagagatacagaatttggagttgaaatttggaaggaatatgacagaccttgatttatcatgtcttaatggcaggatattcactgtactgtgttaatttgatcattacaatttaatctgttaaaggaaagagaagaaaaaggaagatgtataaataaagaaggcttttatttttgtttttatcattaatttttcatctcaaaatttgttttggctacaaaatatgcagaaagaaagtcttaatttttagaaatgaaaaatattttaacattccattaatctgatgacctgacccaagagtttatagcatgtttgttttagctttaattcttggttctgttttactttatgtagagattctttaaaataaggataagaatccaaaggagaagtgcaggtgcttctttcatagccttttaaagttgattcgtatacagtaaataaattagtatggcggatatgtgtggactgttccacatttggcacatctttatgagtatgtttttgtagacatttgaagaaagttttataatagttggtgcaaatttgtccttttatgtgaaatactttttcatttcaagttaaaaatgcattaccacagaggatctgccaatttctacagatagaattctcattgtacaagtaactttagtatgtcacagtaggtattgcacagtacagtcatgcgcagcattatggtgttttggtaaatgatagactgcatatatgtcagtggtccccaaagactataatggagctgaaaaattccttttacctagtaatgtcagctgtcttaaggtcatagccatcttaatgccgtagttccaacacattactcatgcaactcaatagtgagaaaagaaacaagcccaacaaaccaccatgaacatatttctgaaaaaagtgacacctcctcaagaagtacctcaggcaggtccctcaggagggattccaggagaaggcattgttaccataggaaatgccagctccattcatgttatttcgcctgaaaaccttttagtgggacaagatgtagaggtggaagacagtgatatttatgatcctgaccctctgtaggcctatgctagtgggcgtgcgtgttttagttttcaataagaaagctttaaaaatctaaaaatagaaaaaggaccacaggtgtgtaccgccatacatggctagttttgaatttttttttttttttgtagaaacaaggtcccccagtgttgcccacacttgtctctaactcctggcctcaagcagtcctcctgctttggcctcctaaattgctgggattacaggtgtgagtaatcctgcaatcccactgtgtaatccccctgcttacttcttattcctaagaaaaatgttaagtgacattaaattttttcctggtcgctgttttattttaaactatggaatttaatatatgaatgcattctcattcacaaaggtctaaattgcttagaattaggtggaaaaacgtgttaaaacctccatttatcatgtttctttctccctattaccattttcaaacataaaggtaaccaccctttttgtatcgtttcactgcttggtgatttacagacatttggagactgttgcaaaactaatgttgaattattttcagtgggtatttatattttctcctaatcattttcattctaggaaagtttaaaacttttcgctattgagttatgaaaatttcccttgaaattaagaattatgtaaatgatgaatatgttcacagtagaataatgagaaaataagccaacgttatatttttaaaattcacctgtagtgttagaattgagagagaactactcttattaatttgatatctagatttccaacttgcccatttctgaagataaatgtaatatatttaagtcttaaaggatcattatatacatagttttgtaatttgtgttttttaatgtagtaataaatggtagcatacactcttttagcagttgtaacatgccagccagacttttaatccatttgtatttagtaacctaggtcttcacaacagtcctttcaggtaagtattattactattatgcccattgtacagatgggaaaattaaactcacgtagttaggataaataacccccaaagttcacatagctgctaagtggttgaaatgagatttgaatttaggcagaggattccagagtgtgttctctttgacatatggtcataaccatctttccatgtcaataaatatagacttcacctgtacttgtattggctgtatagtatttcactttcatctcactcaaactcttagtaatattcacatatcttcatttcttgaaaggattttttctttacaggctcttccttctaagtttccttcatggttcattctctacctgacttctaaatttgtagtttccaatggccaggctctttgtttatttgccttcttaaggtaagctcatgcattcctgtgactttaaatacagtttatataatggcaatgctcaaatttacagttactgctcggaactttctactttgctccccaactcatatccacagtggcttatttgacatcttcatgaagatgtgtcatagatctctaaaatgtgtgaaatcagaatgtttgattccctctctaactttgttcttcctccacaaatctgttccttctctttctgatcgtagtaaatggctcttgcatcaacctagttgttcaagtcaaaaaattaggagtcatcactgattactcttttttctgtcaactcttatagttaatttttcagtaagtcctgtttctgctttcataatatttctccagtccatccacttttactgtcatcaccttcatcaggccactccatcgttatccagttatgtatgaacacctgctttgcattctattttccacttctgctaacagtgtttcaccattgttactattaatcttaggttgtgaagtgctgataaagacagtgtcaggactctgcttattacatctataaattcacactatccaagctcagttagactgacattactatttagcagaccatcttcctcctgcttgaaatatccttgcgttctcatgtattactcctatccccattcctggtttatgtgtagtggaattaagagtggagctttttagcatacatgtttttttttttttcatcttttttctttatttccccacctccttatattgagttagataaaaaatgggaattctacatctgatctgactaatataaactgctgtcaaggtgaccttataaaatatatttatgtactatctctgctgtatattcaatggatctttttccaaccaaatgaactatgaaaacttcatcctggccctccaggctgccttttaaggtgttgccaattaaaaaaaaaaaaactttaacccttatcttccactgagctattcattgtagtcaggctgctcatttcagagcatgctctttgtttttttttgtgtgtgtgtgtgtgtgtgtgccttgtgctatagtttatatatatactttgatttcttttttttttttaataatgtaaaactttggatgcaggaactgtgtctttcaagtacttttggcatttacatcagggattcatagctgttctacatagttcacttgtatcgggaagattatcttacttagtcaggaacacagttttggaggaatatctgtagagcagcaggaagaaaaggagaacccttactgtaggcatttgtcagttcaacccagacattggtaactaatgtgtgtgtgtgcaaccagatcatatctggagttagatttttcttgtctttcagtatgctgtatagcacagaaacttgaatgtagaaagttttcattgaagaattgactgtgatccttcctgatcactgggcttattgcttcctgggcatccactggcttttaatttagttttaagccaggcttttaaagtagaaccaaccaggaggcaaggatgttgggggcatgattttccaatgctactcatgtaaactcaactttttaattccttttttggaataaaacaggctcttcactgtttacagggttatttctaagttgcaaaaattatctctcaacatgtttttgtaatttctgtatcccccatttgatcttggctgccacaaacagaaaatgtgagaacattttttttgtgtatctatggtagaaacagtaactgctccaggtctgtcaagtagattcattggatcttcttataaaaataatatatttttgttaataaaaataaatttgaaaatttcaaatgaggtgttttacttagaatgatgttcaaaagtttttgtccataagtgtttgaggaggtccattttaggattttccaagtgtattagtctgttttcatgctgctaataaagacatacccgagactgggcaatttacaaaagaaagaagtttattggacttacagttccacgtggctggggaggcttcacaatcatggcagaaggcaaggagcagcaagtcacatcttacatggatggcagcaggcaaagagagcttgtgcaggaaaactccccccttataataaccattagatctcatgagacttactacttactatcatgagaacagcacaggaaagacctgccctcatgattcagttacctcccactgggtccctcccacaacatatgggaattcaagatgagatttgtttgggggcacagccacaccatatcaccatgtatgtctctggctacacttaggaatgtctcatctatttaagttttttttaagctctacatattagcttcagaaagtacaaataaaaataagaataaaaattaccaaagattttatcagttatgttataacccctgttaactttttgaccattatttatttttttgttctttgttttttttcatatgtatagccagttagatggtgtttttacactcatccacttttaaaattaaaaacaagggatgtagcaatcttttctatacaaagagaaacactgtaataggagcaacgtttttatcctttaggtactcatagactagtgacgggaaattcatgtcatactacataacagaatgagctaaattccatttgtctgtggtggagtcagctaacattttcattgaggatattctgtgtgctgaatatttatagccattatctcattttatctatgcaataactctatgatatgatgtagatgaagccattgaaatttagagattagataaattggccacatagttcataaacagctaggagtttgcccaggtttgttgacatttaaatccacgcttgctacttctttctttatttatttaagacagagtcttgctctgtgacccaggctggagtgcaatggcgtgatctcggatcactgcatcctccgtctcctgggttcctgggttgaagcgattctcctgcctcagcttcctgagtagctgggattacaggtgcctgccaccacgcccgcctaatttttgtatttttagtaaagacagggtttcaccatgttggtcaggctggtctcgaactgctgacctcatgatccacccgcctcagcctcccaaagtgttgggattacaggcatgagccaccaagcccggcaaatccatgcttttaaacattactctgtatggtgtgataatgaacagtcactgtatctgactgttcatctgtgtgtccatctgtattgaataaaggagaaggagttgaagaataaagggaaatctacagagatgctgaggaaaataataataaaataacttggaaagagacatcctcaaaggataatcagtggaaaccagctttgctaaagtaatagcactttattgtggtacttgtaacatgactgctaacgaattataaaggtatggtatagatatttggcataaataagcttattgcctcttaatgtttgctctgtagattaagttatgtcaaagaccacaagctgatggttcccagctcttgatttatgagccaggaactgtcctgtcaaagcagtttaagtgaaattcaggccctatgaactagaacatgtagccaaaatattctaaagttttgtagatatcctacagatatatgattttgttgaattagtcaatttagcattgtgccagccactacgcagtctcacaaatgaaagtatgtgttatattcctaaaggagcgtatgaagtagacatgttcacaagtaatagattattttaagtgctatggaaacacatagaggggagcatttttgcatgaagaatcaccaaaagtgaagtcagtcagcatttttctcatattcaaaagccatcttatgcctatcttgtgtgattttattttatataaatgaatatctttttccttctaggtatatttgtttttctgtttagttatctcatatgtaaatgctagtttaaatatttaactgttttctaccagctgacaaatatattttagcttctgttgatatctttataacagaagtttaaaaactgttcttgtcatgttctgagtcaagcataggtaataatactgtataaattaaaattggctcttaatgttgtatggattgctttctctaatgaagttaggaagcattcaaaatttgatttgttcttaaagtaagtgaagatttgaagagtggtgtaaatatatatagaagaaggactatgttagcacaactcctttttttttttttttttttggagacagagtctcgctctgtcacccaggctggagtgcaatggtgtgatctcagctcactgcaacctctacctcccaggttcaagcaattctcctgcctcagcctcctgagtagctggaatcacaggcacctgccaccacacccagctaatttttgtgtttttagtagagatggggtttcgccatgttggccacactggtctggaactcctgacctcagatgatacacctgcctcagcctcccaaagtgctgggattacaggcgtgagccaccacacccggcctaagcaacttctttttaacactgttgacatattttaaactatatttaacaacattgctggaatgactatttgagataacctgctaattgaacacaaatcagttgaaaatctagtctatctgctgtaagagggttttctagtttcaagtctaggataattcattccttaaattcccactccccacctgtgttttcatagtcctttcctgtgcatttattttcagtattctataaattttacaacagtatacaaatcaaaggaattgttactccagcttggtcatttaatataaaagatggatgtaagccatgattcttgtcattacttacttggctctttgcatttaggattcttgttatatacagttactgtatatcaatccttcaaatttcaaaaaattttttttacaagaaaagtatattttaaagataaaattaatccaaaagtagtgccaaataggactgcttattagtatagatttatgtatcactaaggataattactaattaatacttttacacaatttaaaaatatataaacaccgttagctacataaacttatttagacctaacaacaaccttatgatgggtattatgatactagctttatagattgcaaaactgagtctcagagaggtcaaatgacctgcccaaggagaaagaattaagtggcagagcaggacctgaaacccatatttgtatgattttgaatccagaagtattttaattacttacacttaattggtagcttccagagtgcttatgaatgttttattttggcttaaacatttgtcttgcagttccatttacagtatatgatatgcaaacactgatttgtatagttaatgcaaagatacttcagtctggtctttaccctagtgatcaccaactagggaaaagtcatccatttaaatgaggctctagagcagcttttcccaaagtgtgaggtatgctagtgtaggtatcaaaggaatatttattattttaatgtaattctcagcctaaaaggccatcagccctcagaccaaccaacaacaggtttattctagattttatgtagtgaagcctaaatctcccttaaaagctcaaactttcttttcccctgtcctcacttctcttgaagctctttgtctagctccttcccctctgggcacatgcagtcccctcataatttcctccagtctgtcacccttgcctttcctatatttgactcttcatacttcttcagtaatccaactcttcctcctcagctccaactctttcccttttcagttttcttttttttttaatccctttccaggatccacacatcaaacaccagtgtcctctttaccccttgggttcttcataacactttcacatataccttagccctagacttatcctacctcccatcctatcacagctccttctccagtcaactgcattcacaacccaccctaactccttaacccgtgactaacagaaataacctgctcaacaaaatctgtagtatgaagtgtctttctcaccaaaccaaggtctaactggttccaggattgggaggtcttgttttcttccccttggctgtctcataactgaactccataggctctctccacacttttaaatgttttctacacttttgtgcttattcactgttgctaagcttacattctacagttttggtgattcagaatgttctgggattcacgaataatatggggaacattttaaaaaagaattaactaagagcagttgacaaagcctcctgccttgaaaggagattttggcttacaaaggaccactgttaaatcagattggacagcaggtgatatcaaagaaatacgcaggtagtaagggtatgagacaaaacttctaatgcatgaagtttgggaaatactgctctagagtatttggaattcgaatttattcattcagtcagtcacttattcactcatgcattcaccatgtcgtcattatattaagcatctactctgtaccaagcattgggctggctatgcagtagtatgacaaaaattcagtttcagccctcatggagtttcctgtgtaagggaagggagattccatgtgcttttatgaaaagcagagtttttgtttcttaaaaaaaaaagttcctccttaaacagattttaaaaatataactgaagtgacaaaaatacactttctgtaaataacatctggtagatgtgttaccactcagaatttctattatgataaataaatgtaccaaacctggtgtcagaaatcactgtgggccaggttagaaaaacaaacacttttcacttgagaatacatcactccattattcagtattataaaatgaagaaaaatcactattactgctctagttagtaaatgaaagtgtatttgcttattacaaatgttggtttgatttcgaatctcctaaagtacctatctcctgagatgctggctgagctttaaggacagcttgcaacactggatcttcccatgggccgccatctctaatgattcgagtcaccagttccagattcacatttccatatctgcggaggtgattctggtattcctggaatgatccaagaatatcctttaagggctcttcataaaactcacctcttccaaagaacagcagcaactcgaagaaactcacagcaaggctactcaaaacatgttgtacgtgctcacattcatctgggaatgatgcactggctgttgtaaaacaacaaagtacagtctgaagaacctgaagctgtggcaaagggacctgccatcttccaacgtaatcttcaaccacctgacagaagcgtcagcagtaaccccgacagctgatcgtgacgccgccactgcagctgccagcaccgcctctgccgtcgcccgcagctctaagccccacagggccagcagggactccacagtggccacaagctcttctctgaggcgttcggccttttgatcgctgtcttcctccgccatgaggctctcgctgcccagcgcataccagcccctgctcctccaccactgtagctgcctaggctaacctcccaaatttcaaaatattttaaaatgagaagtgatgtaatctattaatataatctttgtaattataatttgtttaggcagtttttattttgggctatattttctttatatccatactgatgttttgtttgcttgttctatcaaatactgagagtccctagcctactatccctgcattaaaaattttggtcggggtgaccttggagcgtaattcaacctccgaacaacctaaactaagaccatggggtattaatatttccaactgaaggtatagatttgtccgtttctttcttagtcctgttagtttttatgttattaattttcaggctcatttattgaagatgcatacgtaattagaatggttatgcctccgtaatggattaccccttttatctaaattaccttatctcttataatactctttgccttgaagtctgctttattatttatataccaacttttttacccttgcagtttgcatggtagatctttctccattcatttgttttcaactcatttgaactcataattaaactatataacttatgtatatatttatatataatatgtatattagatatatgtattagtccgttctcacattgctgtaaagaactacctgagagactggataattcataaaagaggtttaattgactcacagttctgcaggccgtacaggaagcgtggctgggcaggcctcaggaaatttacaatcatggcagaaggtgaaagggaagcaagcacgtcttacgtggccagagaaggaagacgagaacaaagagggagaatgccatatacttttaacaaccagatctcatgagaactcactatcaggagaacaacaagggggaagtccctccccgtgatccagtcacctcccactaggcccttccctccaacactgggaattacaatttgacctgaaatttgggtgggggcacaaatccaaaccatatcaatatataattattatatataagtatgtgaactataattgctttttaatcagtttttataatttatgtttattaattggagtatttaatccatttataattacacatattttagactgtttaaaatggtattggaatcccctgagtctcttcagtttcatttattcattttgtctttatttttcagattgatttgtgttgaagttcactgacttccatatagtttccttttttttttttttttttttttttttgagatggagtcatactctctcatccagactggagtgcatggagtgcagtggcaccatctcggctcactgcaacccctgcctcccaggtttaagcaattcccctgcctcagcctcccgagtagctgagattacaggcacatgccaccatgcctggctaatttttgtatttttagtagagacggggtttcaccatgttggccaggctggtctcgaactcctgacctcaagtgatccgctcacctcagcctcccaaagtgctgggatcacaggtgtgagccactgcacccggcctagtttccatttttctgttgatatttacttctattcactcattaagactatattttatttctttaatatattttcccttagttctttgaacatatttataagagctatttttaagtatttgtcagttgaatctaacatcttttggggccattttctattgactgcttttttcttgatgatgagtcgcattttcctttttgcctatctagtaatttttaaattatatactgtaccttgtggatgtatggtagagactctggggttttgttatttttctttgaatactattgattttcattctgataggctgtccagttacttgctgttcatccttaactcttgcaggctgttttatactttgtaaatgtagatgtgtggaaagatcaagatgtttcccaagtttttttttttttttttttttgagatggggtctcgctctttcccccaggctggagtgcagtggcgcaatctccgctcactgcaagctccgcctcctgggttcatgccattctcctgcctcagcctcccaagtagctgggactacaggtgcccgccaccatgcctggctaattttttgtatttttagtacagacggggtttcaccgtgttagccaggatggtctcaatctcctgacctcatgatctgcccgcctcagcctcccaaagtgcagggattacaggcgtgagccactgcgcccggcccccaagttcttttaaatttgtagggtacaacctccaaactgtgtttccctttggatcttttagggtttaatgttaggttttgttaggtttgtgctagagtaggtcttactttagagcctggttctttttcataagatgtgtcagctgaacgaccaagaaattagccaggtttctctacctttttttttttttttttttttttttttttaagagacagggtctcactgttgcctaggctgtctcaaactcttgggcttaagcagtcctcctgcctcagcttcccaaagtgctgggattacaggcgtgagccaccacacctgcccttctctacttttgcttgtctggaaatcctgtgttcttccaatgccacttaacctccagtgtttatgttttaccataaccccaaagcagttggtctctaataaacctggactgctttctctctgggtagcccagcctttagccaagtacacacatgtgacttctagggatctccctctccttgctttccagtgtcctgcccagaataatttagctgcttcatttgtcttaaactctgatctctgcctcctcaactcagcagaaacatgcaattatatgctgcacactggttgcaatattgacttttatcagagtttctgggcaattatggggttgacttggtgagtttctcttctctcaggaattacagtcttgtgtttattttacgaaacctgaatacggttgccttgtgtgttttgtcatttttgatggttgtttacaatgggagggctagctggtaccaattacttcatcatagccagaagtgcatgattctgagtaataagtatacaaatgtattgtgtcatgctgggacttatttgtattttccattagtgatttgttcaaacccactcccctaataaaattttgtacctggcttttattggagggggagcaaaactttctctattaaagaggcgtagcattttatgattttctaaaattttattgcattttatagagtatctgataagtgtcatggttcttccctgtctgctctggggaagacaccagcatatctttggtttaccttattttcatcaatataagtattagctgtacatgtggatagtatttgacaaaagatagctagaaatattagctgctgaatcttttttaaaactggaaattgatggtgtggccacttttaaaataaatttttgcagatattaattgagtcattaaatatttagtgagtgcctgttttattgccattgctggcattgtacttggcactagggatataatggagaacaaaataggcatgcataatccccatccttgttgaatttacattccactatgggagacaggcaataaatacaaagaaacaacatcaaaaattacaaattatgatacctaccaggaagaaaacaaatagggttctatggttgagaacagtgagttcttagttcagttagggtggtcagagaagacctctttgaggagttttatatttaaactgaatggataaggaggtagtgtccttatgggagaggttgaattaggtactatgatgggtttttaaatacctttccagtacccataaagatcctgaggaaagtttcgttatattagaggaactgagagaagataagtgtgtctgaagtatgaacaatgggaagaaaatgacaagatttaagtcgggaaggtggacataggctagatcatttaggaccctgtagacaatggtaaggtgcttgatttcttcttctttcttccatcgctgaatagggtaactatataatttgttgtacaaaaactggcatactctgagtaaaaaggagcaccaactggatggaatactgggtggacagatgtaatctagccctgtttggtaaaatcatcctaattgtgtacataacatatgtagaaatagtatagattctgcctgcagattacctttaaatattattattattattattattattattattattattattattatacttttaagttctgggatacatgcacggaacgtgcaggtttgttacataggtatacgtgtgccatggtggtttgctgcacccatcaacctgtcatctacatttctcctaatgctatccctcctctagcccctcaccccgtgacaggcactggtgtgtgatgttccactccctgtgtccacgtgttctcattgttcaactcccacttatgagtgggaacctgcggtgtttggttttctgttcctgtgttaatttgctgagagtgatggtttccagcttcatccatgtccctgcagaggacatgaactcatccttttttatggctgcatagtattccatggtgtatatgtgccacattttgtttatccagtctatcactgatgggcatttgtgttggttccaagtctttgctgttgtgaacagtgctgcaataaacatacgtgtgcatgtgtcttcatagtagaatgatttataatcctttgggtatatacccagtaatgggattgctgggtcaaatggtatttctggttctagatcttttttttttttttcacccaggctggagtgcaatggcgtgatcttggctggctgcagcctcagccacccgggttcaagccattctcctgcctcagtctcccaggtacctgggattacaggtgtgcaccaccatgccaagctaatttttgtatttttggtagaaacggggtttcaccatgttggccaggctggtctcgaacgcctgacttcaggtgatccacccacctcagcctcccaaagtgctgggtttacaggcgtgagccaccatgcctggcctctggttctatatccttgagcagttgccacactgtcttccacagtggtttaactaatttacgctcccaccaacagcataaaggtgttctatttctccacatcctctccagcatctattgtttcctgactttttaatgattgccattctaactggcatgaggtggtatctcattctggttttgatttgcatttctctaatgaccagtgatgatgagctttttttcatgtttgttggctgcataaatgtcttcttttgagaggtgtctgttcatatcctttgcccactttttgatggagttgtttgtttttttcttgtaaatttgtttaagttccttgtagattctggttattagccctttgtcagctggatagattgcaaaaattttctcccattctgtaggttgcctgttcactctgatgatagtttcttttgttgtgcagaagctctttagtttaattagatcctatttgtcagttttggctttgttgccattccttttggtgtttttgtcatgaagtctttgcccatgcttgtgtcctgaatggtattgcctaggttttcttctagagtttttatggttttaggtcttacatttaagtctctaatccatcttgagttaattctgcttactatctatatagcccttgggcagtttgatgtctctgtgcctcagatttcccatttgtagtatggggaaataatacctcactgggaatgaagattaagtaagataatatatgtatcaaaacacacagtgcctggcacatgccaagtacttagtaaatctgttctttcagcagatatttattgaaaggttattatgtgccagacattatactaggcaatggggattaaacattgaaccaaacacagaaatccttgacttcattgggtttatattctggtgctgagaaataggtgataaataagttaaaaatgggatgtaagatggtaataagtacgatgaagcaaaaacatgacacagagaatggaatatggaatatgctggcagcagaaggggatggtgagctaatatgtaatatgctggcagcagaagggaatagtgagctgaaagtttaagtagattgatcagagtagacctcattgagaaggtatgatttgaacagggatttaaggaagtgagggattgagccagctacaggaggtgattccaggcagagggaacatgcagagatgatatgggaagtagttagggggttttaagcagaggaatgacaggaaatggtttatattctagaaggatgactaggctgtggataagagagagtgacagcagggaaacaagttgggaattgaaataaaatatgttgaaccagggtggtatcagtggaggtagttagaaatggttggattctgaaacttcttgaaggtagaactgacaggatttgctgataaatttgataagttgtttgagagaaaaagaggtgccagaggtttttttagctagagcaactagaaggatgaagctaccattttaccatttactgaaacggggaataactgtgggaggaataaattcgggtgaagattaggagtttcagttttaggcatcctattagacatccaagtattcgtgttagcagttgttacttatctaataaatgttaactgttataatcattcattaaatatttattggctctctggtgaacaatttgctatgttcttggaattaaaagggtggtcaaaaatagacaatcttcttgcctttatgaaatttgcagtctaattggaaacatagaaattggtcaaatgacctcatcattggtagtatttttttcctaaaacacaaacaaacaaaaaaaccctttaattagggcacctaaagagaaataagagtgacttaacaaaatcataggtatcccttgatatctaaatttattaggttcttacgggcagatagtgagggatgtgtatacattgatctttcagactacttacataaatggttttttttcagtagacatatattttaagtttcttatttaacaatatctcattcttaaagttggttagcttaattaatatgagagaatgaagcttcacgaatttaccttcatttagttgaaatgagagagttgtatattgaatttagtgtttaaaagtattacatatttcatgaaatacttaggttgttagaaatgttctcctttgtttctttcattaaaaatgttttgcttttactttttattagctaaggaccatttttttgtaactgaagtctttaataatagcattatagtatcatctatttacctttctctcataacatgaaagtattaatttttgtgttttcaaaaatcaacaggttcgtcacaaggcatcgcagaaggtttatgctatgaagcttcttagtaagtttgaaatgataaaaagatcagattctgcctttttttgggaagaaagagatattatggcctttgccaatagcccctgggtggttcaggtaagcatactaacttttataagtttatttcctttttttatgagtgctttattattcatgagttgatttttgtgtgccaagtcttatgcttcatttacatggtaacagtgcagttatttttaggagatttgattcaaaacatttgtttaatgttccaaaacagtatgtccacatagatatgacatgtaatacttacttaaattgttgtatggaagcaagtattacttgcagctttttcttcttgataaagaattggcttgaataccagtatgccattgtttcatacccacttattcttgtgatttacatagtaggaacatagtaaattcattgaatcatctggaaggatatatacatattaatattccaacatggcacatgtgtacatatgtaacagacctgcacgttgtgcacatgtactctagaacttaaagtataatcattaaaaaaataaaaagtttgtgtggccaggcgcagtggctcacacctgtaatcccagcactttgggaggccaaggcaggtggatcacgaggtcaggagattgagaccatcgtggctaacacaatgaaaccctgtctctactaaaaatacaaaaaaattagccgggcatagtggcacacacctgtaatcccagctacttgggaggctgaggcaggagaatcgcttgaacctgggaggcagaggttgcagtgagccgagattgtaccactgcactccagcctggcaacagagcaagactccgtctaaaacaaaaaaagaagcttatgttacattaatcagcctatcttgaaaagaaaaaaaacaacaaaaaacttcctacaataaacatttagaaaattctacaatattgtggctcctaattttgccttttatttgactgtgggttaaggaatttatggttctgctttgccttcattctttcttttttttttttttttttttttttttttttgagatgaagtcttgctctgttgctcaggctggagtgcagtgttggaatctctgttcattccatcctctgcttcccgggttcaagcggttctcctgcctcagtctctcgaatagctgggactacaggcatctgccaccatgcctggctaatttttgcatttttagtagagatggggtttttgccatgttggccaggctggtcttgaactgctgacctcaagtgatgtgcctgccttagcctcccgaagtgctgggattacagatgtgagccaccgcacctggcctttgccttcgttactattatatttcttcactagctttgcttctgtaaacattttttttatactagtaagtaaatctgcagacatttttgaacaagtgtcctgagtaagattaggtatacaccagttcttgttcagaatgcttaaatgatctgggagtttgataccttgcttgtggaaggcagttcagattcccctccccccatccccccccaaaaaaaacccacttttgaccatgttatttagaagctcattaatgttgcttttttataagattgatcctcattcctgctccctcccccactttttatttaaattgtaggcagtgaatagaaattctgatatgtacagtgaaactaaaacttctatggtaaattctataccatgataatttttttttttcccttgagacggagtctccctctgtcacccaggctggagttcagtggcgtgatcttcgctcattgcaacctccacctcctggattcaagcgattctcctgcctcagcctcccgagtagctgggattacaggtcctcactaccacacctggttaatttttgtatttttagtagagagacggggtctcaccatgttggccaggctggtctcgaactcctgacctcaagtgatctgcctgccttggccccccaaagtgctgggattacaggcatgagcctctgcgcctggcctgcataccatgataatttatctgattaaagaatgattgcagtaaagtatttgtttcacttttagctttaaattgctttcatagtagcggattgccatttctggttatttcataaattgatattctttgatctttaattctgctatgtgaacctttataaagtgttaattgagatagaagaaaatctgctgattattgaagtaattgagataatggatctgagggagcaaaccaatagtgaaacatagtacaattgaaaaagtaaatccgattataattgtggcctttatatgcttatctctctgggtaaagaacaacattccatgcaccattatatttatgtgtataaaatgtttgaccttttgtgaaaacttgtcaaagtgactgacttatttttatttattgttttattcaatgattttgaatattttcacagagttgtacaaccatcaccattacctaattttaggacatttttctcaccctccaaagaagccctggaccaattagcatttattcccccaattccacctgcccccctgcccctgccaactgctattctattttatgtctttatggatttgcctattctgaaagcttcctataaatcaatcacacaacatgtatgtatgtcttttgtgacatctttcacctagcctaatgttttgacattcattcattcatgttatagcatgtatcaacacttaatttcttattatggttaaatagtattctgttacatggttgtaccacacttcgttcattcatcacttaatggacatttgtgttgtttctcctttttgactataatgaataatgctgctttgagtgttctttcataaggattttggtacatatgttcacacatttcttttaggaatctacattgcagtgaaattaatgagtcattggatatgcctataattaattttattggactatttcagttttccaaatctcagctcttatttttaaatgactattaaatatttaattgtattaatacccccacagttactatacttttgttagaaatatcacttttcatttttgttaatataaattagccacagtaataggttaaatcttgggcctatctgtatttcttagaaatatattattagggtgatttctgaattcaatagataaatattgacatattttaaaaacttttattcatttgcgggtagagaggactttgtctttttaaagccatttatatatccagtttgctgtgtttttctagtgttgttatttttatggcaaatgcttccttgctttcctttgtagttttatcacccagatgtgtacccctaaacaccttagtttagttttggcattaaaaaaaaatttaagttcaggtatatcttttaaatctctcaatgtagagagtttccctcttctttcatttacttttgtccccaggttgaagaaacctagattttgctgatctcttcttgtggtgtagtttaacatgtttctctctcacttgtatttttgtaaattggttgttagatatagaggcttgatcagattcaggttccactttggaaggggacggtataggactacttcataggccaggttcataggccacctataagaagactaatgtctggttatctggtgtgttaccagctatttgtgctcagtgtcttgatatatcatttattaagatttgtcaaatgatacttcagttcaatcattcctccttggttatagtgactggaatacttctgtgaagaaaaatatttctctgtttacttgttaagttactcagggtgcagttcacactggaaggacaggataaatgctttattcttttattgtatttaccagttttcaaaataagggtgaccaattttgggggagaatcagtttgaactcatggacttaaaacctgtgtgatatgtttcagtcctttgaatatcttattgatgctcaaattgtggtacctttgaccagtgggatcagaatgaggttggtttctgaaacctttaacgaagccttaataatctttgatagcttgcttgcaatgtgatgtaacagggtgctccagacctatcttaaacatttgctgctcttgatgtgtaattaactgtgcttgtaggtctgtcttttatacatgtgtgagtttttctttacaatagattcctagcattgggattgctaggtcagatggtatgcacatttgacattttgattgatagcaccagattgctttgttaaaaaatttttctttacaagtttacattatctttgtacaatagatgttctctttcaccacagttttagcaaatacttgatattgtaactattttaaatttttactagttgcatgcttgagaaataaggtgttaactgtgttaagttgtacttccttgattacttacgagattcagcatctttcatatgcttattaataatttatattccttatacattaagcctaaaatataatttatatttttataaatttataatataattttataaataatacatgatttataatataatttatattttatacatcaagcaaagtataaggaatataaatttcattgctaatgtataaggaatataaattagtaagcaaatgaaatatgctaatcttttatagtgcactgaaaaagatttcaaagtagtgtaaaatttaaagtaaatgctatttgcaataatgtgatttttaaaagtgggatactgaatttgatttactaatattttgttaagtagttttgcatctatgtgcataatgagatttgacctttaatttaatttaattatttaaacatgggctcttggttttcttattacggtaagactactctaatagacataatagggaagcatactacttttttctgtgctttgatacagtttatataaaatataaactattcatttcatgaggcttgaatgaacttacttgcaaagctttctagaaaaaaattcttttttttttcttttttctagagacaggatctcactctgttgcccaggctgtatttagtacagtggcaaggtcatggctcactgcaccctcaaactcctgggcacaaacaatcctctcacctcagtttcccaagtagctggtactgcaggcatgtaccaccatgccctggctcatctttggtaaagattggggtctcactatgttgcccaggctggtctcgaactcctggcctcaagcattcctcctatctctgcttaccaaagcactgggattattatagacatgagccactgcacccagcctaatgatacatttttccattttaaaaatgtattatgataaatttcaaatatatcccaaagtagaagaaaaaagtatattgaatccccatgtacagttcacccagcttcaacaattaccaaccatggccaatctcatttcatttatgccaggaattgcaaacattttttggtaaagggccagatggtaaatatttaggctttgcaacctaagaggcaaagttgaagatattacataagtatttatataatgaggaaacaaatttctgcacagtttttattgataaaattcaagagataataaatacaattttaaaaatacaggtctactaatgacaagaatgaaattcttttctgaatgtttgctcaactggggtccacaattagtgtttcctatcatcaaaattaagtgcaaatactcatctgttaatgctggtgtgtaaaaatattttacatgttcatctgtgaaaatgtcctttcacacagctaggtattgccacgtactataattatccactaacgtatgattgttttttaaagttgtagatttatagaaaaattgagcagacagtatagagttcctatctatccccaatacagttttccctgttattacaaatgtatgaatgaaccagtattgatacattaaactgaagtctttatttagatttttaaaatttttacctatgttctttgtttcaggatcccatccagaatgccacattacatttagttatcgtgtcttcctgggctcttcttggctgtgacagtttctcatactttccttgtttttgatgaccttgacagtttggaggagtacatgaattatactgtaggatgtggatgctcctctgtaggaatttgtctgatgtttttcttattaattatactagggttatgggtttttgggagaaagactgcagagttaaagtgccattttcatgctgtcatatcaggagtacatactaatacattatttatgactgttaatgttgacctcaagcatataattttgatttaccatatttatcacttggagaaggcgttttcagaaaattttaaaattcttcttttgatagttacaggttaatcatttctaattgaagattagatagaagaagccccttgattggaaagttcaaatagattttgaaatatggatatttccattgcgcttacatttgggccaaaaatgctgctgcaaaatgaggaaattaacattgatacattactgattaatattcagatcccaatcaggttttcaccagttgtcccagtaatgtcttttatagcaggaggatccagtttcaaaccacatcacatttattttctttcagttttgaacatttcctcagtcttcccttgactcctcaacctttttggctgttatatcccccactaggctgcccctttgcttggatgtcctttggaccctgtttgtgttaccaaccacaggttcctagggtcccaggcactagaaagtgaaatgaggcaagaaagtgtcccagacaaggctttattcatggctgatgttagaacacaaaggagagcactagagagagagttctccagctggctccctgaggacaggtctttttgttgttttaagaaccatgatgacataaataagcatgagatacttgaatgtcattacatgtgcagggtggagcacaaggtgtgcaggcgcagtgagaaatcatggtagtacacacatggcatgataacaaaatggtgaataagctcctccctgggtggggagtttagtattgtaaggaggcaaggggtggagattagccattcttctggtcttatgcacatatgggcgataggattaactcccttgagtaagatttaaggtgggatgctgtgtattttagtttcttcaagatcatacttcagtgagtgtggcacttgataagatttagggtgggattctgcttatcttggtttcctcaaattccagccatcatctggaaggaaggtcaaggtaggggtagaatcccgtccctcctctctcacttgggctttggtatcccatggcacccatcctcacacgtgaatggtcctccttccctttctgagctctgataccctctgtgcggcttgacttctgactccttttatagtatgttttgatgaatagtaattcataattttaatgcagtaaaagtttaatcaaacttttatggttaatggccttttgtgttcagtaaaatttgtccctaccttgagagcatgaagatattgtgctatgttacctttctgacttttattttttccctattaatctgtcctatcatggtccattagggctcctataacaaaatactatgaaccaggtagcttataaacaacagaaatttatttcccaaagttctggatgctgggaagtccaagatcaaagtcctggcagatttgttgtctggtgagaatccactttgttatatatggcaccttgtctctgtgtcctcacacagtagaagggggtgaataagctcccttgggcctattttacaagggcagtaaacccatttatgatggctgacttcatgttatgctaacaaggtggctcaagtgacctccatgacctactcattttcccaaaagccccttctcctaataccatcaccttaggatgacggtgttataccgtcattaagatttcatatgaattttgagggaacacaaaacattcagaccatagcacctatgatcagcccagaatggattttttaatagtgttacttaagtattcaattttacgtgtttccatatggatattcagttgttccaacattacatattgacaaaactttctgttccccactggtgtatgttaactccttatgttgtcatgcatttatccatctgtgcatagatctgttttggggttctgtgtctcactgcatcatttatctgttcttgccaccagtaacacaatactttaattagcttggcttaccttgcttggtatttattggagtttcttagaattatgggtttatagagttcatcaaacttggaggtagttaggccattatctctttaaatgttttttctgtctcagcttctgtctcctaagcccctatcccctttctcagacttcagttacacatgtgtaatctgcttgatgttgtcccataggtaactgatactctttttcccaccagtctttttttctttgcatgcttcattttgtatagtttttttgctatgtccttaagttcatggatcttctcttctacagtatctgctctaacttcagtcccattctatttggcttatttgactccacaaaattgttttgagattcatccatgatgtatatcaatatttcattccttttgattacttttattacatatatccttgtagggagatgtgacaatttatctgttcatctattaatggacattcaggttttttccagtttttctctcttataaataaaactacattattatttctggattaacttgattctttgaaagttgttgttgagctgtggtaaatttagagttgtctttactctgatggaaaatatatacggtatctcttttctgttgttctagtggctgtgtttaccattttaacatgcacatttaagttttcaaaattaattttattgaggtataataactatacaactttattgaggtatgcaactttttatacctttgtaagacaactttataatagaactttatgaggtataatttgcatagcataaaattcacctgcgtgaagtgtatgctttagtgagttttaggaaatttatagcattgtggaaccaccactaccatctgattttagagcatttccaccatcccaaagtggtcacttgtacccttcaatgacatttcctattaccctctgagccccaggcaaccattaatgtgctttctgtccctgtaggtttgctttttctagacaggtcttataaatggaatcatacaatatgttatcttttacatctggtactttttccttagcatactgtttttaaggttcatccacattgtaacgtttgttatacttcatccctttttagtgctgaatagtattccattgtatggtgtgttataataaataatatatctagtctttgttgccatttctggcacagagcttcaaaagccctggaatttcctgagtgataggagtgtctttgttacaccagtgaggtgactcacgtgtccttctgatagcttcaggatgagggctgaccgctacaaaagaccaaacacatgattagaagattaaggcttttagctgccagacctcccgggagagggagaaggaggtattgggggaggattagagattgagtttaatcattcggccagtgatttaattaatcatgtctgtgtaatggggcccttatagaaactctggatactgacactcagtggagcttactggttggtgaacacattgatgttctggtgccaggagagaaatgcacttttattctacacagacagggtggagaagctctgtaatctgttccacactttgtcctgtgtgcatcctttataataaaactgtaatcataaatatagcactgtgctgagttctgtgagtcatcctagtaaattgttaagcctgaggaggttgtgggaacccctgaatttgtagccagtaagtccaaaatatagggaacctggggatccccaaagtgcagctgatttctgaagtgagggaaattttgtagaagactgagctcttcacttgtgggatctcataccaagccttgttggttaatgtcagaattgcattgcagaacacccagttggggtggaaacggtatacagatgtactccatgttatttgctcatttaccggttaatggacatttgaattgcttccactttttggccattatgaataatgaataatgccgatatgaatatttgcttattagtctttggcagatatatttcatttcttttaggtaggtacataggcgtggaatccttgattgtttgctacatttatgtttaactttgtaagacattatcaaactgctttccaaaatggttgtgccattttgcattctcatcaacacttaactattttctgtcttttttagtatagctattctgatgggtgttaagtggtatgtcattgtggttttagtgtgcatttccctaatgaccaatgctatatatatatcacttgtaaatatttcctcccaacctgtggttcatcttctcattttattaatagtatctttcaagccagaaaatttttattttgatgaaataccatgtatcagttttttattttgtcagttgcgtttttggtgttatatctaagaaacctttgtctaatctaggttcattaagatattctcctgtgtttttttaagatttttgtagttttaactcttaaatttaggcctataattcattttgaattaatttttgacttatggtgtgaggtaagggtctaaaaatattttggctgtagctatccagttgttcaaactttttttttttaattattttttccctcattaaattgccctggcacctttgtcaacaaatttattgatcataaatacaaggatttatttctgggttctcagttctatacaactgtgttcaatcgatctatgtatcttttcatatgccagtactcatatctcactgtgttgcgcagactggagtacagtggtgcaattgtaactcactgtaaacctcaaaatcctgggctcaagcgatcttcccacctcagcctcccaagtagctgggactacaggtgtgcgaccattcctggctaatttttaatatttgtatagagacacagtctcactttgttgcccaggctggtctcaaattcctggcctcaagtcatcctcccacttaggcctcctcaagtgttgggattaccggcgtgagccaccgtgcctggccagtattgtcttgattattgtaattttgtagtaagttttgaaattgggaaatgtaagtcctcctgctttgttctagttccagattgttttggctcttctgagtcctttgcatttccaaataaattttaggacctgcttgttggtttttggaaaagacccactgggattgagatggagattgcattgaatataatgatcaatttggggagagttgccattttgatagtattgattcttccaatccgtgtacatgaggtggtctcttcatttattttcatatttcctttaatcatttaaacatgttgtacactgacacacacaacagacacacacacacacacacacacacacacacactctttctcaatttggtaaccagccttatcatgctttcctatttcttccttctcttcatcctgatgccttccattttaaaattatgtctcacataataatcctcttacttggatttattccttttctccccgctagtcaaagtctcactctgtcgcccagcctggagtgcagtggcacgatctcggctcagtgcaacctctgcctcccgggttccagcaattctcccacctcagcctcccgattagctgggattacggcatgcgccaccattcctggctcatttttgtaattttagtagagatgggggttttgccatgttggccaggctgatctcaaactcctgacctcaggtgatctgcctgcctcggcctcccaaaatgctgggattacaggcatgagccactgctgtgcccagctattcttcattttgtcaaactatattcttgaataatttttttgaaaatggtctgtcaattataaaatttcattttgtcatctcctttgttttcttgtctgccatattctagaatcaaaattattttccctcaaaactttgaagatatagctatgttgccttttatattcagtatgttggctgagaggtttgttgccaatatgattttatgtttttgtgtatatggcattttttggaaacaggatttttctcttggatttctgaaaatttagccctagctgtgtaaagtatcagtttcatttagaggttttcttgatcttagatttttaactttactcatttctagaaatttttgtttactattcctttgttctagtctacatactctctagaactacttttaggtagacgttggtgcttttctgacattgctctgtatttcatctcttactccttcagtgtgttcagagaacattcattttttcagttttctaactgtaatgtttgtctatcatcagtcatatagtgaattcttagacttcagggtttttttggtcctcatatcagcctaatgtttaattgatgtgacatctgttacccttttgagggtatcgattttacatatattttttgttttcttttgagacagagttttgctcttgttgcccaggctggagtgcaatggtataatctcagctcactgcaacctccgcctccggggttcaagcagttctcctgcctcagcctcccaagttgctgggattacaggtgcctgccactacgcctggctaattttttatagttttagtagagacggggtttcaccatgttggccaggctggtctcgaactcctgacctcaggtgatccacttgcctcggcctcccaaagtggtgacattacaggtgtgagccaccacgcctggttgattttacatttttaaagctgtcttcggtttgtcctattaaacatttccttgagtattatttttgtttctcaaattgctgttttctctatttcatgatgttggtttttctcaaatattgattcttagttttatcttttccctgtttgtctgtggaagacttgtgtttgcattgcttgtttctgggaggggtgtgacatactgtttggtagaatgtacagataggttttcttcagacattgtggtttctctgtctgtttggggggtcagtagcaacctggactggtatcttctttctctggtcccaatgctactgctatagtctcagtaaactgaatgtctcttgtttatcatgaacaaggtgatggggaaggggagagaagagttacgcgtcttccaaatatggctaccagtgactcattctttccattgatatggggcttattccctcttcttgtgtccgttgaatctagtatctctagatttttttaaattgctcctacctcctctgctcttttctgtgtgagttaggtgcagtagtttgttcagaaagctgttttttttaaattatagtgaattcttctgtcattctttcacctttaatgttccttattcctgtttgtttctttcttaaatgtttctatttaaatagtttcttttgtattgtgttctccatgaggggaaatattcatttatgcttgaataaggtacccatataaaaattttgtctgatactgtttatccattacatacgcctgagtctaaaataaaagatctcataaattttagttttggttataaaatagtttgcctttttcaatagtaataatagttttttaaatttttgttctgattatgatttttggtttgggtttttaaaaatttttccttttccttttgttttccagcttttttatgcctttcaagatgataggtatctgtacatggtaatggagtacatgcctggtggagaccttgtaaaccttatgagtaattatgatgtgcctgaaaaatgggccaaattttacactgctgaagttgttcttgctctggatgcaatacactccatgggtttaatacacagagatgtgaagcctgacaacatgctcttggataaacatggacatctaaaattagcagattttggcacgtgtatgaagatggatgaagtaagtaagcaaattatttaaaacgatagtgttttgagggacagaaataaatgaaatactttaagtcaggtcttcatagttttgaacaaaggtaaatttagttttcataactgtatagcacccaaacaagatataaccaacttaaaacatttccttaaccaacttaaaacatttcttttgtaatcatttatgtagctgtagagtacttatcaagagaaataaaaacttagcttagttatcttcctcatagactgttgacaagcatttgctaccaatcaaaaccggttcatatgtataatttaggtgaagaaggacacaaaatctaaattaaggtaaataggtattttcaccaccattgttacttctgcatttttttctttaagaggaggtaaaagtaagtaaagaaatttatgttacaacctcctcgtcactccctctgcatcaaccacacagaataaatttgggaacatcatctgttccgatgctttacctgttgatcaattcatattatgattgataggttcagtggcattaacctcgtagctaattatgatactgatttattttggttgtaaaatttatatatcttgcccttttctctgtaagtgtgcagtaagtaattcttgatggagagggatcggttctgtttcctttgtattaccctgttggtcctaggagtcgacttataaatgttaatatatattgacagcaaactgtatttcatcttttgtatgttttttataactttccagtatgcttataaagccaatcttatttcttggtagttacctagtcaaatgtttattttgagttaaggtaattttctctctacctcttaacttgttcatgccacctgtatgacattcacttttattgatcattctaccttcatcagcattccaacttctaagctcatctcagattttacctcggctttaaggttccttctgataatcctgacctgactgatcattctttaatgtcataatgtccataatttcctcacatagtcagaatttgtgctatactttatgggccatttttgtctatcttaatctatccagctagaacttaatatccctatatatttttggtctttttgatagagtctgttatattctgcaacccttaatcaatgtttaataggtggagttttttattgtacccaaagctccctcttgtggtatttggtataatatagtgtgaaatgattaacagtgcaaattatctttaatgaaaatgaagtatgaaataatttcctaatagaatgctaaacttatgtctgctatacataagagaagatgtttttgtgttgtacttccatgaatgtattgcgattttcattaaaccaaaaacttttggcactagggtacagacaaataaatcataccacatatttttagggaagataagggtggttaaggagagcaaggtgtagagaagaagaatatggggaacgggatagaatatggtacctacagaataattgtataagcatgtaagcaaatacttaaattgtctctttataaggcaaagtaaaacatggcctaattttgtttactatttttacttttatttatttttatttattatttttaataaatttaaaaaatatggactgcttcaagaatttgcatgttatgcttgtgcagcggccatgctaatcttgtctgtatcattctaattttagtatatgtgctgcctaagtgagcacggtttactgtttttaaactcagatacagacagttgagttaattatactccttggttcatagtttattgtcatgagtagtcaacacgaaggcctcatcttgcttttattttatattttcctccattcagtttctgtctcattctgtctttcctctccctaatagatagctagtatatgttcaccatacgtttttgcagattattagtatagtgtactatatgttcttagctggtataaacagtatcttgatatagatgtcattttgtttgctgttgttactcagcattgtttttatatctctccctgatgtcagttagttcattgcttctttctgctgcttagtattccatagtatctatcaatcaatttaccttattattccttggatgttcgatttctaggtcacctccaaatccctgctaacaacaatactatcttgaacatctttatatatgtcccatgtatatgcttacagggggttctctaaatataaacatagaagtgaaactactacatcagagggtacataaagaaagaattgcccgatctccagaatggctgtgaatgtttctaactacttactactagtacatgagagatcttgtctccccatatccttgctaacacttactattcagttctctaagggttaccagttccgttgatatacagtagtatctttaaacaattatgttcatcttattggactaaggttgccaagaaaaaaataaataagatttgtaaaaattacattaatctttttttgttgttattgtagacacggtctcctctattgcccaggctggagtgtagtggtgtaatcatagctcactgtagcccgaaacccctgggctcaagggatcctccctccttagcctcctgagtagctgggacaacaggcgtacaccaccatgcctggttcattttttaatatttcatagagacagtatctctctatgttgcctaggctgatctcaaactcctgggctcaagtgatcctcctgcctcagcctcctaaaatgctgggattacaggtgtgaggcactgtgcctgaccagttatgttaatcttgtaactaatgatgacaaacctctcttcatatatttgtcagtcatttctgttttgtgaattacctgtttatatcttttaactcttttaaattggtttcttgttcatgtacagggattgcttatataatctagatagtgattccatagatattgctgatatcatcttccattgtgttacccatctatgccttcctttgtttgaatagaactccttcattctgatgtagtcaaaggtgttctttaacaaatactgaacttttaaaatgttgttttaccccagatctccattcctcaagcaatactaaggataattatacaatgtttaagaacaaaagagttttttattaaaaactatagtacattggatttataattttctattagtttttaacatgaatagtcttattgcaagtttaaggctcaacacttcatgtgcctttgtttgattattgttactataccaaagccattagaaatgtccatagttttggccagctgtggtggctcacacctgtaatcccagcactttgggaggccagggtgggcagactgcttgaagccaggagttcgagaccagcctgggaaacaaggtgaacccccgtttctactaaaaacagaaaaattagccaggcgtgatggtgcatgcctgtaatcccagctccttgggtggctgaggcatgagaattgcttgaacccagggggtggaagttgcagtgagccgagatcgtgccaggccacagccctccagcctgggcgacagagcaagaccctgtctgaaaaaaaaaaagaaatgtccatagttttattctcatccacttacagaagggactgtgacttggttttatacagcttacatgccagaaataacttttacatttttaaaagtttgtttaaaaaaaagaagaaaaatatgtgacggagaccctgtgtggcccacaaagccaaaatatttagagtctggccctttacaggaaaaattagccaatactttatctataatatagacatatatgctcaaattatttttcagccatcctgacttcctataaaatgttatgccatggataaaagcaaaaataaaatacaactataaacttacaaggactaaaatgatttgtcactatcagaattaagagtaatagtatctcattaaattatataattgataaattgtatattacacaactttctggatgcagttgccatcacccttattctctcaggaaaaaaaaaacttatctaaatgtgagtgagagtcacattgtaagatatttatatgtagatgtgtctcagtaaaagttgagagctactgctatgttgggtgtactctttgcgtgtcatgcattttatagcaacctttacctccttttaagaccactttatatgttagtattttaaattacctgaagaggccaggcacgatggctcatgcctgtaaccccagcactttgggaggctgaggtgggtggatcatctgaggtcaggagttcgagaccagcctcgctagtatggtgaaaccccatctctactaaaaacacaagaattagccgggcatgatggcgcgggcctatagtcccacctacctactcaggtgactgaggcaggagaatcgcttgaacccaggaggcggaggttacagtcagccaagttcgtgccactgtgctccagcctgggtgacaaagcgagactctgtctcaaaaagaaaaaaaaaattacctgaagaaaaaaaaaaattacctgaagacgatttttatccattaatattctagcatataccatttgactaaatagaagatataattttttaaaagctaactggtagcttttctttttaagtaatttttttaaaaaaaggtatgcattttcaaaaggtttctcagattattttaaatgtatcatattaaatatgtatttgctaaatgtatttgatgtattatggcccaaaatatcataaattcagagaatttactgaaaacactgaatttactgaaaagagaagaatttcctaaaacagaagcattcagtgattctgttattaaaaattccatttacagttttttttccacctttataggaagcatttcagttgtttttagaccaactccaagatttctgattgaccagttttgtgttttcagtaagttatctcgatttatgatattttttgaccatgataacacatcaaatatatttagaaaatacacatttaatctgatacatttaaaataaaataatttgagaaaccttttgaaaatgcatacttgattatctggctttccagcttaatacccttcagtagatttctgtcatctactgaattaagttcaaactccttagcttgtcacatgaaatttcttctgatacgaccccctgcctgcttttgtaccctattctctatcatttgacagtactttatggcttagaagtcttgagttacatgtagttctttctgtactatgatatatcatgattcttggcctacgtatatgctgtctaaaaatctgcctggaaaattcttattcatattttgaaactcagtccaaagtttgccatcttgtgaaagctccttaggttgacttctttgtcctttccacatatcccccttttggagcattttcttattttttgacactatacaatgttcaagacttgtcttatattttctctgtctcacctctggaatcacttctccaagaagctctgattctttttattaaagaatggtatttataaatcaataattgggtgctagatgtgctcattgcttctggactgtcattacttctaggccctgccagctgacagagttagggggtatatattgtatatactaaatgtactaaaccataaaccacatgcacacatgtttatatttaattctgaatatgtctgtatatatagcatattaaaaattaggagctcatactgataactctgattcaagtccagcaccactgggtttattcttgtctccctcctttcttttttgtaatttctttcgtgaacagtaaaactcttggctcttattatctgcaatatatttacttaccagttgaaccctagtatacacataaaattatttcagaattgtcagtccttatccctgtgacaaacagatttgctaaccaaaatatattatttttgtacacttctttctgtttttaattagtcttacagtattgtgttaagatgttattttccatagttacttagtttattttgtttctttctaccttctctaatgtggttatattatttgtttataaaacaagttcatttcttgttttttttttttgtgttgcatttagagttccccccacatcctgattggttttaatgtttatttttttttttggatacgtgaagtttcctctggttttaggagatagagccatgcaaaatgtatgctcagagaagagtcacttgctccatattcccataccctgttcccattactcccttctttccatcctttgcccacccacccactgttggtaaaccaatctctttagttttttacttatccttctcacagttcatttaaacagggttagagacttgttataaatgtagatttcatattcatataatttgagggcttccacataagacactttttaagtatttttaaatatcattttcaaatgtttgttttaaaaacttcagtatgctatccaaaaattatggttagaacattaattttccaaaagcagagtgttattcacatagtttagtatgtgaatatagtttactattagtaattactattactatatagaatataatagtttataaccaataaaaatctttagtcctacccaagtatttattctgcaagtggttattcacactgatatgcagcttatccttccagtcttcattgtgtagaactttacatttagttgatttggatttcactgcatttcttgaacaagtttataccaggttgttcctgtttctttatgctctttttttctatctaacctgtcataccatcctctctcctttaaaccctagcttatccgtcctttacagcctaactttatgccaattctttcttatcttgccctttcttctccttcctctgaacctttgaatgctaagtaatttttcctttggttgtatgtgtgtgtttgtgtctgtctgtgtgtgtgtctccagtaagttggttttagtagctaagtctcatataattttttaaaagcttaatttctgtggatgtatgtgaaataaggaaattttctttaacctaataagcctctattgattttttcccccaacagaagtctagactataggacagtccatgataaaaattaattgtataccctgccttttgaagtcaggcactgtcttgttcataatttgtcctttgtaataatccacacaaagtgttactcccatggtttgctcaattatttccataacatttatttttaaatttctattcacactaaaatagcttttattctctatttgctatatatgtgggaaaataaagccattgagttagttctgccaatttgagaatgaatgaaaagatcttttctataacaagttttatataaagttacataaattaggtttacaaaatgtgttcaacctccttttctcaaggtagccataatactcaatattaggtagtttgtatagcttccttatgaggaatgtgggcaacacactctttactgggcaggtaaaggaaataaagggcacttaatctctcaaatcattgcaagttggacagagctagaggtaaagaaataccatttagcaccatacttctctagtcatttaattttgcagcatgcagacacacacacccctataatggttattttacttgtcaaaaagacatcagggagggattattttattatctgctgaaactaaacacagataagtggtttttaaaaatcatcatgccaaatatattgatgccacagctgcatatttctaaatatatagcttggaagtatagctttcacacttctaagatcttttaatttaaacatttgatctatttcttcattttttttcttggtaatacaagagccaattctttattcagtctccaaactggggccctttgttatcttgattacttcagtttattctggaaatatgaaagcttcctttctctaatgattctttttcctgggtcagtgtccttaagaccacattttgtactaacctcataactgtagtgtaagaaataagaaaaagaaaagttgttgatttgcatggaatctccattttaccaaacttttttcttctttcattgaggaagcctcctgtattttagagttcacagtttattcctatctcccataatttaggcattttaatgcattttccagtgtatttattctctgtatcctgaagtcatgtcagcagtgaagttctgttggttagcaatatgtaatcattgtatatctagtaataaatggattcattgcatttataagtgtgtgtttttacactgaactgttttttctttatctctcctgttcatgcagacaggcatggtacattgtgatacagcagttggaacaccggattatatatcacctgaggttctgaaatcacaagggggtgatggtttctatgggcgagaatgtgattggtggtctgtaggtgttttcctttatgagatgctagtgggtaagtaaatattttaacttcttttttcaaaatgcttcttataatactttatttcagtcaagaatttgagaatataaggaaattaattgcctttgtcgtagggaagaattagatttctggaaactttgaattagtagtatctgatagggcagactgttaattggaaaattaataccaagcctgatactggcatggtgattaaatagaataagtagaatgtaaaaagaattaaaaatatatcagacatttttgaattaaaatattagaacaagaagcaagtttacagcttcagtgggccttcattctaagattttccttcttttttttttttttttttttttctgaggcagggtctcgctctgttgcccaggctggagtgcagtggcatgaatgtggctcactgcagccttgaccttctaggctcaagtgatcatcccattttgcctcccgagtagctaggattacaggcacatgccactaaacccggctgatttttctcattttttgtagggagtggtctcatcatgttgcccaggctagtttcaaactcctgacctcaagtgttactcccacctcagcctcccaaagtgctgggattttaggcatgaaccaccacacctagccctctaagattttcttgatcaatcatatttgttataatatttaaatataagacttaatatttgtcccaatagtagtagagaagtaaaaatctctttagtttatgtaattacataattgatttcgtaaacaactgtattccttccatttacttcttgcatatatattgtttgtaattctcgtgaaataaattataaatacagtgtttaccatttgattatcaagataaatatattttgtaataacatttcagttttagaaaactcagagacagatttagttatttcttcttttttatgaccaaatcaaaatttgaaaggctgaagtatttcaaaactttctttacatcatagatttcattcctaatgtttcccatttgtaagtactggggtcataaaaatactagtaccttctggctaaggaagccagtgacgtggcatggggatgagggttgaaaatgtagttaaatccactttccaaggcaagtatgtcaaggctaataacataatatggaattaattagagttaaaaatatactttttagaattagagaatatattttctaaaagatgagcctaaaagaaatggtagtgtaaaacctgtatgataaaagactatggttattgctaaaaaatcagaaattttcggtaaattgcaaatttaaataataattactcttgaacttttttgtggcataaattgttttctcttgatgactgtcttgtgtatgtagcattgatcttgttatgctttgtttcatgtcatagtatgacctactttattttgggcctttcaaagtgagtctgtttgtacgcatcatatggtcccatgtagctgtccgttctcccatctctggcctaggttgtgtcttgtaatcttttgaaaatagagtatattctcttttttgcctagacacgctttcctagggatttacaaaataaggtactttagaggaagtaatttggcttatttgatgaagaggccatttaaattctcacgactgccaggctgggtggtgctagctcagctcttcaggaggctgaggcaggaagatcacttgagcccaggagctcaaggccagcctggggaacatatgagatactgtgtctaaaaaagtaataataaaagagtaaaattaaaataaataaaaaatttttaacataagaaagtttaaaaagttaaaaaataaattaaaaaataaaaaataaaatcttgaattcatcacttccctccacctttctttgaacacaaacaaaaataactacctgaagacattttttgaagttttggattggctgatttgggaaagtcaggttttcattaaagttacttgtagtgtaggtgtactggcagagcctgtaacacttgtggctttagctgagtactggccaaaatggtgccttcaacattttccatctttatacttgcttcagtgcatctattacagtcattagtaagaacactgcatggggagaccatttcttccctctttcaactctagctatatgtcattttaagctagtcacagtctgtctctctgggcctgacttcctcttatgtaaaataatagagctggtttaactcttgcagcagccctgtctggcctatcatgatgtaaatgatttaaatctgtgctgtccagtgtggtgaccattggttacaacatgacttaaaatgtggctagtataactagggaattgtgtttttcattttatttaattcattttaactttaaattgccacctatagctagtggcaactgtgttgtataacatatctctagagaatgatttcaaaatgctgatccagcccaagcattaaaggaccctgactgatctgaccccacataggaactctttctcttggactattcagtaaaacatttcctctcttaaattaaaaaaaaaaaaaactcaacaaattcgggagttatcattgattttattttgcttttaagggatgagggatcattggtggtgttaaattttaaatatattctttgatttagaatataacaatatgtctgttgttttgactgggactctgtgcccgtagaatatttgttcttccctgcatgtgacaaatttaaacttaacatatttaagtactaggtgaaaagtgtttcctttgcattctctgttacattcagtatcttctttcttgaaattttaggggatactccattttatgcggattcacttgtaggaacatatagcaaaattatggatcataagaattcactgtgtttccctgaagatgcagaaatttccaaacatgcaaagaatctcatctgtgctttcttaacagataggtaatgtacattgaatttctttgtagagaagccctttatgttaaatttatagaaataaaagcatgcctagcttattaacatatgaaatcagtctgcctctcattacccaagtagcatctaattctgggttagccttttccttctgctaagcctggtgttgggctaccttgttgttatgtgtgtacagcccagttgtaatcgaactctaaccttaaccctcatgtctaaaaaggaaaaaatagaacgtggtaaaacaatggatttgaaagaaataaaactttcgtgttgttcacattttatcctccaagctggttattccatattactcttatataacttttgagagtattttgtgtagataaatactcaacaggttataatcttaaaaactatttgtgttagacttgggagtgcttccttcccaaccctttttaatttgcatttgaatatgagcaagactatcctggaaattccatacttttaaaaacaaaatagatgaacaaaggtgtgaaaacctgcccccaaaagataagctagaaaactatttgatttctcttctttgttcaccccattccatttttttctaatgtcccgttttatatttgtgataggagtcatcctgtcaaaggaccaacatatacaagaggatgctcacaccctcgttcaaacttacacatcagctttatgatcttggggaaattatttttacttttttgggaaataattttactcatccataaaacagtggtctcaaattacaaaactaagggcatttctagctttaatatgctaagattccttagcacatcttattgcttattaatttgttacaagcattactgcagtgactatcctcacacattcatctctgcatactttttataggataaaatcttaaaggtggaattctgggatacacattttaaacttaagtgatgttacaaaattgatccccagagaagttacagcagtatgtatttccattaacaaaattgttttcttctcgtcaaactgaacattgtaaaatgttttttctttttttcatcaaagaggataattatttttatttgtcagtcatttgtagaataaaactttaatacctgtcaattacatggttgacgagcagttggtgctgataaactcaaagtaaaatggaaatgacgatttatatattaagacctggagatgaggagatgttatctttgaaaagaaggagagacgcctctttctaagaggatagggtggaagaagaacacagcctgtatgatgtttgatgtgggcactgagcaggattggtagggatggccataatttgtgctggatgataaattgtacaacagggtacacctgttttatgttaatgaaaggagtgttattcatgaaagttttgaattagtagtcatggggcaggggtgtgcaatctaaggaatgattataggtggaaaactgatattttgaaaacgagttaatgccgtaaatatggctaggagcacttccccttaaggtctacagttttcctatttatgttaaacatagctccagggccttgtataacacagatgctctctatttccatacagtcttcattgaagactcagagggtcaaagaatgaaattctttgtaacatttttcatatatgcagaatgataagtttaatatacatgtagagatatactttaccagaataaatatggatagcttcaaacataatatatgcattctttttaggaaagggagagatttttaaaataatatttctattagggaagttttgaataactcttctctgccgaaagttagacctatgtctgtttatatcctgaagttattgtcattcagtcgtggcacatgcaggtgaatttttttacttgatagtcttaacgtactttcatttgatgcaaactatagacagaaacattttacttttcatgacatttattgtgcattacagttttttaaatctgtctaaagagatcacatactgtaacttgggattgcttatttttgagaaacatttaagctgaagcttttaatacaaatatctcaaatttacttgagatctttattttggttaaactgttgacatagagttaatctttttattttataatttttaaataatacaatctttaactgcattgtttagggaggtacgacttgggagaaatggggtggaagaaatcagacagcatcctttctttaagaatgatcagtggcattgggataacataagagaaagtaagtcaataaacctaaatattttcattccatcacattctgaaactcataagttgattccttttttgaaataacaagcatatttgataacacttaatgctaactcatttttaaattgagaaatttcatttcaaatttgttctgtggcaatatttataacaatattcctcaatatctttgcaaactattagcaatatttctcaacacttttacaataaacattacacatttcttaatttgccaagttaagctttgtagatctcaataattttcagaatcaagggaatgcaatcctttaatttaaatgcgtttgacttgataaatcaacaattatttatggagaccatactctgctaaatattgctgtaagcatagtaacttatttttactatgtatatatgacattgattcattttaagggtaagaaatatttctgtttcgagattgtagaaaatggaggtctctaaattctgtgcaaattattgctgcttgtaatttttaacaactagaataatatgttgctttccttgtttaatctatatttaaaagtgatctaatatagcaataaattacaaaattttaattctgtgaatcgataaaatggcaaatgcgctgctacaaatttatatagtgttattaaataataaataatacatcataataaaataggatggtttatatattttggttgtgaatgaaataatttatttcttttcttttaatagcggcagctcctgtagtacctgaactcagcagtgacatagacagcagcaatttcgatgacattgaagatgacaaaggagatgtagaaaccttcccaattcctaaagcttttgttggaaatcagctgcctttcatcggatttacctactatagagaaaatttgtatgtggtttattatttgttaaattttactgtttttagaatctagctataagatgatgtgttattttgagactcaattataggagataaagtattaatttgttttttccaaaaggactatcatcagaagaattcttaattttattttattatttctgaatgttatatgttattcatttataagttattgcaagacaccattctacattcttttggggatatacagtaaaaacaaatacctatttttgaagaagcttgtcatctcgtgaaggatataagagaattatatagtcataaagaagggtaaaatgtgacagttgccttaagaaagatgctgagagaatctgggatggttcagaagaaaaatagaagtcatctctttggggtgggagtagggagaaataggtcagacctctgggaagaggtggcattttagccaagtctaacaagaaaaggttttgagtggctgaaatgtggggaggttaggggacagttgtgaggtgttgaatagtggaagcaaatgtttggaatgtgagcatacattgggagcagagcactcgcattgagtccagtagcactcaaacatagagcaggtgctactatgtcattacagtttggaggactcgatgagactatgtggttttcttgcctgtagtctctgcatctagcagaaagtctgacacaagatcattcaataaatattggttaactgaagtgagtattggatgtaagattagaaaatatgttgaggccaggtgtggtgattcacacatgtaatcctagcactttgggaggctgagatgggaggatagcttgagcccaggagttctagaccagcctaggcaacaaagtggaaccctgtctttacaaaagaaaaaaaaagccgggtacggtggctcatgcctgtaatcccagcactttggaggctgaggtgggcagatcacctgaggtcgggagttcaagaccagcctgaccgacatagagaaaccccgtctctactaaaaaatacaaaattagctgggcatggtggcacatgcctgtaatcccagctactctggaggttgaggcaggagaatcgcttgaacccaggaggtggagattgtggttgaaacgagatcgtgccattgcacgccagcctgggcaacaagagcgaaactccatctcaacaacaacaacaacaacaaaaaagccagatgtggtggtttgcgcctgtaatcccaggtactcagaggctgagatgaaaggatcacttgaggccaggagttcaaggttggaatgagctgttccagcctgggcgacagaatgagaccatgtcttaaaaaaaaaaaaaaaaaaagtgagttttggggaagaataatcaacagatgattgttgtgtgctctgctaaggggcttttgaccgcctggcattgggaagccactgaaagctgttcaatagttgaatgaggcattaaagatatttgagaagcccaggagttcgaggctgcagggagctatgattgtaccgctatactccagcctgggtgacagattaaaaaaagaaagaaaaatgagataataagatgaagaggtgggaagtatagtttcatttagtgagtctggtgcaaacaaaattaaagactagttatcccgtaagagggaaaggcaagaaaagtttagcatttgattgattgattgatggatggattgagatggagtctcacttcgtcgcccaggctagagtgcagtggtgcgatctcagctcactgcaacctccacctcccgggttccagcaattctcatgcctcagcctcccgagtagctggtactacaggtgtccaccaccatgcccggctaatttttttttttttttttttttttttgtagagataaggtttcaccatgttgatcacactggtctcgaactcctgacctcaggtgatctttcccgccttgacctcccaaagtgctgggattataggtgtgaaccaccacgcctggccctagcattttaaattattgaaaatgatacaaatgtcttgagggaaaaatattgcttcatttgtaaataatgtgttgaagggaaaagagagaaatctgtgtttgatatttaagtctgagaataacttgaataaaacagcacatagattaaaatgaaatgaaaaaatttattttctccccccttccatgtagattattaagtgactctccatcttgtagagaaactgattccatacaatcaaggaaaaatgaagtacgtatacatttttactgctgtagttattttagtttcatgtttaaatattttagtaatccccatgtttttaaaaagctaatttgatgctccttttaaaatcatgagatggcattccttgtgtaatacagtttaacatagcattgcaatgattgatttatgtgaatagtatcattattcaagacatgatggctagtacaaagaggacttctacatggctttaggcttaattgagtgccaaaagtgatagaataagtttgtaaacaactataataacatttagaaaattgacttctataatttgtaaatgaatgcaaagctaaatcatacatggatatacacatacacataaatgatgatgctaaacattttttcttcaaacttatgaaagctaaagcattaggttggataattttgttatggtttgtgttttaggaattttacagaatataaccatcattttagtattttaatgtgttttctgttttgttttaaataggaaagtcaagaggtatgttgatgttgtcagatatattgaaaaactgagaaaagctcatcactctcgcaaagtttaaatatagtcatatcctacctagcatttggagtactacatctacccaagagagaagttcccaacctttcttctaccaagtatctcttttattattgttctgtggatctgtttaaaatatatattatgtaattttgtttttatttatcaaggacatataactggcagcaaaaatttctgattagcatataataactggtgtgctcaaattattgtaatgcagtagtagccaaaagcaattaaacttgactagttcattagcctgtatatttttattaagggaaaacagagttttgcttaagatagatgcagtatttaaaaccatggagaacctgatcactagaaggaataatggaaagtacattgccatgggagtctaatagacctgcattgatttttgccactgcgacttattagctatgccatcttggcctgattatttaccttttttgaatttcattttctgtatcaagtagatacaatgctaccatctttgtaggatttttgttaatattaacaagacaacatttgtaaagtgcctgatattttaccaaaggcaccacaggagctcaaaaagttaaatcctttaaaaagtaaataatgttccaaaaatggattatttaatagtttcggtaatttttgcttgtttaaagacttacatagctagggaaagctgctgaggagctggcttgtaattaattagctatcatttattcgaaagttattgattactcctcggtaatatgaccagcactacataggaagatataaaagaagagcttatattctttactttgagcatattcagttgagtactctgaatatttgttttagatgtattcatttttatccgactagcacaaataatgacaatattttcaagcaaataattcatagaaaagcagcagaagatatctgaggtggtattctttataatgaatttgaaactttgtgtcatagaacaattctgccaaagttagagcttcttatgcatggttacataagtatgtttcatatatacatgtgtactctgatagaaagcaagagatgggggagtttttccttttatcaatataagtcacattaaggaggtacaaatactgtaccattatagaggacattatgtttagtggaaagacaaaataagcttatcattgttttctttaagcctctcatctttaaatatgaccaaaatacgtaattacagtttcttgttttttgacagattcagaaaaaactgtatacattagaagaacatcttagcaatgagatgcaagccaaagaggaactggaacagaagtgcaagtatgttttgtagataattaaatattacattataaaatttaagtttaaacatttactgaaaaaagagcggccaggtgtggtggctcacacctgtaatcccagcactttgggaggccgaggtgggtggatcacgaggtcaggagttcaagaccagcctggccaagatggcgaaacccagtctctactaaaaatacaaaaattagctgggcatggtggcgggtgcctgtaatcccagctacctgggaggccaaggcagagaattgcttgaacctgggaggcagaggttgcagtgagctgagatcatgccactgcagtccagcctgggtgacagagtaagactccatctcaaagaaacaaaagaaaaaaaaagaaaaaacagaaacggagagctatggcctggtgcagtggctcacacctgtaatcccaacactttgggaggtcaagggaattacttgggaggctgaggcgggacagtcgcttgaacctgggaggctgaggttgcagtgagctgagattgcgccactgcactccagcctgggcgacagagcgagactctgtctcaaaaaaaaaaaaaagaaaaaagaaagaaagaaatggagagctacggccgggtgcggtgactcacgcctgtaatcccaacactttgaggggccaagggagctacttgggaggctgaggcaggacagtcgcttgaacgtgggaggcaggcattgtagtgagccaagattgcgccactgcattccagtctgggcaacagagcaagacttcgtctcagaaaaataaaggagagctaccaagtaattatgtaattacttttaaatttatagactatgttttattgtaaattagaagttatttactgtttctttctgaaattctttagatctgttaatactcgcctagaaaaaacagcaaaggagctagaagaggaggtaaagttgccccacttttttattaacatttttgttagtaaaaatctttgatgtctgacttacctaaggagctctcttggtaccatagtaatacgtgccttgaaacctaccttgtagtattggtggataggactaaattatagggaaatcatgttataaataggcttcattctgttatgtttttgcaaacttgagttaattcagtatgtgtaaatatttcaagggaaaaaaatgctattcataacattttaggccaaagtattaaataatgatagttcagtaattgtggaaatttacaggaagtttgaatagtaaacaaaacatttacggtctttatgatttaagagtagtgtgctagtttacaatcatagaaagcattattacagttttaacaaaaaagcagtgaaagcctttttgagatcttttttatctgtttggaatagcaagtattttttgttttgatttcatttttatacatacttttttgataataactttaagcattatttcagattaccttacggaaaagtgtggaatcagcattaagacagttagaaagagaaaaggcgcttcttcagcacaaaaatgcagaatatcagaggaaagctgatcatgaagcagacaaaaaacgaaatttggaaaatgatggtttgtggtgtagaatattaattactcatcaagaaaaaaattaagtgtgtgtatgtgtgttatgctaagcttgccactgaaatgctttttatcatagttaacagcttaaaagatcaacttgaagatttgaaaaaaagaaatcaaaactctcaaatatccactgagaaagtgaatcaactccagagacaagtaggtggatctaatttgtagtaaagatactgggttttatttttaacgcgataacattagttttaattgacagtgttgcaaaaggcctttacctctaattttagaaatcatttggaaaatatttttaggtttttgtttattttaaatagtttctaatgggggaatacattgacttattttcattacatacatgtgtgtttgtttgttgttgtttggttttgaatggaataacagctggatgaaaccaatgctttactgcgaacagagtctgatactgcagcccggttaaggaaaacccaggcagaaagttcaaaacagattcagcagctggaatctaacaatagagatctacaagataaaaactgcctgctggagactgccaagttaaaacttgaaaaggaatttatcaatcttcagtcagctctagaatctgaaaggagggatcgaacccatggatcagagataattaatgatttacaaggtattgaagtcgtggttgcacttgaattaattttgatgattcttattttaaaaataactttagatgatggatagtgtgctggattggacatttctgaatatactattatgtaaagttagaatattagaaatacactgatacaaaattttaggaacaaaagatttaatttcaaatagtatgattttaagtattaaactcttcaggtagtagattggattccatttgaattaactataaagcacaataccaacaagtataaaacttctgctcacaaacaacagctccaaaatagaaggtggcttgcaaactttttattcctaattgaatgtatatactttgtgggtttaatgttttaaaaaaacgttgcaatttttaggtagaatatgtggcctagaagaagatttaaagaacggcaaaatcttactagcgaaagtagaactggagaagagacaacttcaggagagatttactgatttggaaaaggtaaaacatgttttatatttttgcataagaaaattgacagtagactttcaggttagaaaagttattctaaactaagggaagtcactaactggaatatttccacatgctcatggattccttttgatttggacttgatgtgtagataagagatgtatctgcaggcttaccataacactgtacaagcagccctcagcatgctggttgctcatgaagtaaggggacccatcctggagtgtagataatgaggatctctctaggacccaaggaaaactcaaatttcgactcataacatgtcttaaaaatgccatatataaagtcaccatgacttttggcatttagaagtttttcttttaaaatactctaagaaagggatgatttctagagtctatgcagttagcattttattttcattcacttatttatttactcagctaaatattcagtgtgttatatgtggtagaaatatcaggatgcagtccttgccttgaataatgtcacagttgaatagttaagtttaaaagtaataataaagcacaaagataattctaatgacagtatggcaaatagaatgataagacttatggacagggtatatgtattgggtgtatgggatgcatccctaacctgacagcaggataggtccgtagggcaaaggcacattctaagttagggagaacagcatgagcaaagacatagaagatggaaaataaaaaaggcattgtttgttttctggagtatagagtgggagtcagcaaattttaatcgtttaaaggcatggtaataaatattttatcttctgtgggttatatggtcttgcaactgttcagccctgctgtgattcatgaaggaatggatgtggctacgttccagtgaaacttaaaaaagaaaaaggcatcaggttagattggcctgaagatcacaatgtggttgttatgtaaggacatgaggaattcagtggtcagaatgaggctacagagctcggcatgaggtagatcatgcaagatagcgaatactctattaagaaattttgaatgtagtaatgggctagccacttaagggctttaaattggatgatcttattagaggtacattaaagatagatcgctgtatactgtgtggagaaaagatttgaggaggacaagactagaggtagagagactggtcagtagactttttcagtaatgctgataaggaataatgggagacttagtacagccattaaaaggttggaaaaattggaagactcagaaatatttggaagaggaatatttggcagcacttaatagttgattagatatggcatatgagtagcagtcaaagatgagtcccagatttgtaggttgtgacaagatatatagtgatgctgttaataaagaataaaggaaaaatagctcatgagacagtgataaacccactttagtcctcttaagtttgagggtacctatgggacagccaaattagcatgtctgcactgcagtaggctatagtagtagaagttagaaatatttgagtcattggtatgtaagtagctgaaatcatgtgagtggaatagcccatctgggaaaagactgtgtgaagtagtgatttttttttttcttttttaggacagagtagattactctgttggtggattatgtggtttgagaaatcattttttgtatgaaaggctttatttggaaaaaagcctttatcatatttatgatatgaactataaaaatcaaagaattagaaaacctttggggtttatgtagaaaataggaggagtattggggcttagatcaccaacatttaagggacagctgggaaagcttcaggagcaacagaaaggatgcaagcagaatggagagaaccaactaagtacaaggtcggcaatgccaagggatagttttaaggggggcagtgagttcaaataagactgaaaagggtctttagaatttgatattgagaatagcattggtctttttgttgagattaagtgagcttgatacagatctcagaacagcagagtggtggtgtagactgttgggtacagtgggaagtagagaagtagagtatatagattactattctaaaaggtttgagtgaagacgggaggggaaatactgaacattctagttaagcctgttaaaaaacaagttaaggttgagcaccatggcccacacctataatctcagcactgtgggaggctgagtcgggaggatcacttgagcccaggagttcaagatcagtgtaggcagtgtttaatgagaccttgtctctacattaaaaataaaataaaataaattagccaggagtggtgacaaacttctatagtcccagctactttggaggccaaggtgggaggattgcttgagcctggggaggttgaggctgcaatgagccataatcaaaccactgcacttcagcctgggtaacagagcaagactctgtctcaaaaaaaaaaaaaaattagaaagcttttgaaattgtgagctagtctcttttttgttgatagctgcattttaaatatttaataggaaaaaagcaacatggaaatagatatgacataccaactaaaagttatacagcagagcctagaacaagaagaagctgaacataaggccacaaaggcacgactagcagataaaaataagatctatgagtccatcgaagaagccaaatcagaagccatgaaaggtatgcattttttaaagagggttttccagcagcgtcttcctaagaattgattctgtgttagctttttggttttgaaacatttttttttatatttcattgtcaaatattgggaattggagggaaaaaaactattagggaagctttacatagatattctattatttttcctttgtatcattacagtaatcatttctaagatagtaagacccaaacacaaaattacatgatcagatttttagatcagagataaattaatatttctcaatattatatacctggtaatatctgtaccactcggtatacgtgtatcagtagtaagaaggaatatctgaacttcacacgctgtatacctgttactattgatacaggtaattcttgtaatacaagagttttgtattataaaattcttgccagtttatgcaaggtaagaatttaaaagtaatagctggtctaactagaatataagttcactgagtattttgatctctaacatgatgaagatactagccagatttggtcgaagccatataatactaatagataacaaagttaaccttcccataaactagactttatcctggaattgtcttaggataattttttcttttccaaactgactgtttataatgactctgaaattccagagaaaatcagtactttaagctattcttgtgaaaggcttaaaactcttgaacagaaatttattttcatattgaagcattacatgagtaactaacttagaaaaaatagccttttaattattgcatgtaattaaaatggtagattttcttagtaaaaatcagtgtagtttaaggcactaaatcaggatgataagaaatgaaatgagtactttatttacaaaaatctaattgtaagggagaaagttactgggccatatttccttgtctgtggcctagaagacagagttcaattattttcattgaggtataatttacatgcaataataaaatgtaaacatttttgacatttcgtgatatgctcacataactactgttcaaaacaagataaagaatatatcaggctaggcatggtggctcacatctgtaatcctagcactttgggaggccagggtgggaggatctcttgagcccaggagtttgagaccggcatgggcaacatagcaagaccctatctctacaaaaaatagaaaaattagctggatgtagtcgcgtgcgcctatagtcagagctacttgggagtaggactctcagtattcctgcaatgatgcaggaacattgcttgagcccaggagttcaaggctgcagtgagccatgattgcatcactgcacttgagcctcagtagcagagcaagaccccatctcaaaaaaaaaaaaaggactattttcattatctcagtaatgcctctttctattctcaatgcctacattatggtgattgttttttttgttaaatgaggacatttgtttagtgattattctctgaattgataaaaatgaaccaattcagtattaactaccatttttttcaaactattaaaacgctaatgtaagatacatgatgacttccatattttacacatgagtacacaaaactgttacatattatagatggtttcaaatctgaggctaaagcctttggtccttctgttgcatgtcattggctccttggattaagaacatggctcaccaaataattactagctatgtgaccttgtctagttatttaaactttctgtgtcttgtttcctgtgaagggacaattacagtattgttacgttgttgtgaaaatcaagtgcaataaaacatgtaaagtgtttagaaatgctattattagtactacatggggaatgtttcatttttctgcacttttgaagaccattcattaaacactaaatattcataggtttaatttttacctaatacaactttataatagatgataattagatgttgagcattaattatgaaaaagcagaggagccttaattgaatgtgaactgaagtactaaccagtatatcaagataatcctttaactgtgatgacttacatttaacactgaaatcacttggaactttgccttctgataagtaaaatagattaaaaatttattgtaaataatttagaaaacacaggaaagtataaagaaaaaagcaaagattactcataatcctatgagttaggatactattttgtaaattttctccactttctataccgttttgctttttaaaaaacaagacattgtgagcgtttccttggtcattaaaaattctgcttaaataataagcacttaccaagtgcttgccatatgccaggcagcatttaagtggtacacatgtattaaatcttcacaacctccctaggtgctgttatccctattctggagataaggaaacaggtccagagaggtgaattacttgcccagtcaaacagtgttagacccagggtttaagctcagaaagtttggttccagagtcttgtcctttaccacctccctaaaacatatttttcaacacctgcataataatgtgttaacatggaaagtcctatggagatcatagaatctacctggattgttttaaggtaaaaatagtaacactgagagacatagaatagcagtaagcagtagaatataagaaacctttgtttaaagatgtaagcatcttgtagaatataaataaaggtagaactatcttgcttccattagaatagatgtaatattgcagagtgtgatacatttttacaccctgtgaatgaaactcctaattttcaagtatgaaagtgaaaatattaaattgaaaattaaggccaggtgcagtggctcatgcctgtaattccagcactttgggtggccgaggcgggtggattgcatgaggccaggagtttgagaccagcctggccaacatggcaaaaccccatctctactaaaaatacaaaacttagctgggtgtggtggcacacgcctgtaatccgagttatgtctggaggccgaggcacgagaattgcttgaatccaggaggttacaaagagctgagattgcgtcactgcactccggcctgggcaacagagtgagactctgtctcaaaaaaaaaaaaaagaaaagaaaaaaagaaaattaatagaatataaggcagcatcatttattataatttttattagtatggtgtcatttaatgtgcttttacttacaaatttatgatatgcttcttttatttgtaaatttatgattgtgtccatttttattatactagaaatggagaagaagctcttggaggaaagaactttaaaacagaaagtggagaacctattgctagaagctgagaaaagatgttctctattagactgtgacctcaaacagtcacagcagaaaataaatgagctccttaaacagaaagatgtgctaaatgaggatgtaagtattaagtgtactaatgattaataataaactaatgaattaataggtttattcatgaaggtctagtgatggtttcataattttaaagtttttcttataatagtctgcaacctgttggtttaactaaattttgatgatatactaaaggaatcataatttaaacatttttaaagttatatttaccttattatattttatttaaaaaatacaattataatattattagaaatacaaaaaaaattttagtatgaaatgaattagctacctaagggtaaaaaaatctgttttacatcaccatattttataccaacttcattgattagaaaaatggaaataatttacttatataccaagtacacaatttatttcttaggttagaaacctgacattaaaaatagagcaagaaactcagaagcgctgccttacacaaaatgacctgaagatgcaaacacaacaggttaacacactaaaaatgtcagaaaagcagttaaagcaagaaaataaccatctcatggaaatgaaaatgaacttggaaaaacaaaatgctgaacttcgaaagtaagttaattgattgagatgttttaatatgcataattatccatgtataagttaattttggtgtatctgtggattttcttttgagcattttactttctagaccatgttttctatttatttctgtacaggtaatgtgttgagtgtcactgttgtccttcgagattatattcgtttccccaacagtttttactgctgctacctaattacaatgtgatgatagaggaagtgttggtgatgaggcagaagaaaatatctgggattttcataccatgcttttagattcctcctcagggctctttctcaagcttattgtccgtgtgcctgtttgtttccttagtttcttagacttggaaatgtttgactgttaaataaacagcatgtaaatttttaatcatgtcataggatgtactctagtgtctacttgatttacttataaaatggagaacatattgttaaaatactttaaaaatattataggcacgattgtgcacgtctgtagttccagctacttggggagctgaggcaggagaatcacttgaggtgaagtgagattgctttgcactgtgatcatgcctgcgaatagccactacatgccatcctggacagcataacaagaactcaactctaaaaaagataaaatatatagtaaatatactattaaaatttgtcccatttattctattagtaggagaattacttcttcctaatcatgaccaaaggtcatattggatcccggttgtttgatgaaagacagtgtgatagagtggaaagaaaaaagtctttggatccagacagactgagttgtgaatattggttctgttacttaccaactaaccaacatcgggcaaatgatttaatttctctaagccttttatcacacttgtgaaagggagcagtaatagcttccttgttagggatcttgtaaaggatagcaatggtttatttaaagcatccatcatatgataagtgttagggactattactgctagatctgttactgttacaactactacagctactactaatgtatcctcattataattgtctgctttatgcatacctgtgacaggtcagtaagactgatgctatctaagaaaagatgcttaaaatattcaagtagactttgttctttttgctgagctgatctatttattgccagggtaagcctagaccttcaacttcatgagatttaaacttttaaaattggaactagaaattggaacagtaatcagacatctttgtctttgtgttttttgtgggttttttttctgtatattagctttatttttctctcttatttcaggccagctttttattctaacgatagtgtttatgcagatgtaagagctagttaatcatctaggttgtgtttccttcccacttctaataatgctttgtttatacctagtgtatatgcctcttattttctttgtaagtgaatggcgttctgttatttcttagtccctcttttccttacctctccccaccaaagacacccatgttttctatcttagccacctaatagggttatagaggaagtgttcattgtagggttaaaattgaagggcaaaaatcatttatttatattttgttctccccagtcctttttttttttggagatggagtttcactcttgttgcacaagttggagtgcaatagtgtggtctcagctcactgcaaccttcccttcctgggttcaagaaattctcctgcctcagcctcccaagtagctgggaatacaggtgcccaccactatgcccggcttatttttgtatttttagtagagatagggtttcaccatgttggccagggtggtcttgaactgctgacctcaggtgatctgcctggctttgcctcccaaagtactggaattacaggtgtgagccactgtgcccggcccccaatccttgattaaggttttacatatactacatcctcaataaatgttgtatgaatgattacatccctcttaggtgtaaggcattgtagtagttactatgaaagatagaaagattaaccaaatacatttcctacccatgagaagtttactagcattttatcattagttattcagtggggaagataaggcaggtacataagtgaatagaaggtaaaaaaaaaaaaaaaatacatgcaatgggaatttacatatgaagtgctatgttggcttctttttaaaatggccaacatgtatatctcttctttcttgtaagattccagaaaaactctagtaaaggaattaaaaaatatataaacccacaataaataagaatgagaatgggttggagggcaagaaggttctctagtgaatgagatggcagttagatggaagccttgtgactgatgaagtagaacaaaagaagaaaggagtatatataaggccaggggtatacatgaagtgggatatagatggaaaagaagtattcagagcaaataaggcctggagtaagttgtgacactaaatgaactaatctgctgatcatactctaccattaaccttgcagatatgtctgcagccaggcacctcccaccactaaggtttttatcagagcattctcctctacagagtaattgggtacaacctctggggtaattagaacagctaatatggggtgaaaagcctttctcactctggcatttaggggtccctttgcttaatgctggcttttaaagcctctcatcttaaactgaagcttgccagtgagaaaactcctacatacatagagattaaagtttttcccaccccctttgcaagtaaataaccaagtatcactaaacatttgaggaaagcctgcaatctgaaagaggaagattatgataatgaaagaggaaaagtgcccccggaggaaacatatatcaaggagtagaagagaactgctaaaagttctggaaaaacaaaagcactgtaaaaagctactggtaattagtattgatcaaagatttcaggagatactgcttccattaattgagaaccagacacaatgtaaaaggaacagccagaataggaacgagctcttgaagatgaataattactgccaatataaatttgttggaagggttcaaagtcaaagaaatttcctaaaatgtagaacaaaagaagaaatgtcatggaaggtttgaaagacgtaagtaaggcccagagggactgttctaggagatctagcacccagcgaataagaattccagcaagaactaaaaaccaagaggaggaaattaaagaaataatagagaagaatttcccctagctgaaggagaaatgtctttagactgaagggactcagcatataaatgaaaaaagatctatatctagacatattctcatgaaatttcaaaaacaatgacaggataggagtgttagagttctcatctagtaaaccggggagattatagtttgtggttgctataagagggaaatggggggttcattataccacttagatgagtgatacaactatattgggaggtggggagaggttggggaaggcaagagagctaaattcaagtctgacaacagggaatgggcaaataatatctaaaacttatgagatgtggaggtaaccaccaaaagataaaacacaaatgaaacagttatttcttctaggcgaataggattagtaggggtggagaggtgtcaaatgaggagacttctacttctcattgtaatttcttccttctgttctgtactcctcatttgtaatcatgtaattacatggttctttctgaaataatactttctgaaaattacttttcttaaatacctaataaatattaggttataaaagttacatataaatgaaagatatcagctcttgaagaaggtcctgatgttaaaattatactgtggtttgctacaagtgggcttagctgacagtgatcggacagttttaaaacttgacctttcatatatttgttaaattgcatctctcacatctttgactcatggagaaataagaatcatgaattctctacagtatactcatcaacaataaaatacagaaatgacacagttaagtgacattgagtcataacttccctttttacccacaagtttaagagccagtgagtaaacaaagtgaccaaattatgttaaatgggaatgaggataaacctcctaagcagtatacgaactgaagagactagggttaaatcacgtgctccctctgagtcttcctgcattgtagtttttaaaaatacccaagtggtgttcatatagcttcccattgtaaaatacttgactacatttaaaaaaaaaagcagtacgtaagctctccttcatgaatgcagacattttcctctctccagaggtaacatatcaacaatttgttatttctccttccagactgttttctgtgcctttatctatatatctgaacaaatatatgtgaggttgagttttctgtacatttgattctattttttgcttgtttttaaattatatcatacaaattgtattgttctccaacttgctttattcctccttagttttggtttcggataactataatttttatgtttttaaaataaggccagaatttaatgtaccatttcaacccagcttcttaaatgggttgttgggcttgcttttattttatttattattttattcctttattgaagattaacataatacagaaaaagtacacaaatactaagtgtggagctgagtgaatttttacaaagtatacaaatctgtgcagccaccatccatgtttagatctaaagccagcacttctcgcctccccagaagccccctcccaggcattctgcactccccactgagatcaccagatttgaggtgctctttggattctacttgttggcataaatggctgatcacagtgtctgtatgtgaatgtgtgattcaatgttgatttagtataacactggtctcagaacccctttatactcttaaaaaaattatcaagggttctgccgggtgcagtggctcacgcctgtaatcccagcactttgggaggctgaggtgggcagatcacaaggtcaggagatcgagaccatcctggctaacacggtgaaaccccgtctctactaaaaatacaaaaattagccaggtgtggtggcaggcgcctgtagtcccagctactcgggaggctgaggcaggcgaatggcgtgaacccgggaggcggaacttttagtgagcccagatcgcaccactgcactccagcctgggcgacagagtgagactccgtctcaaaaacaaaaataataataattattattattattatcatcaagggttccaaatgagtttttgtttacgtttgttatatctaatgatttgtattgtgttagaaattaaaactgagaaaactttaaaacacaggaacacacaaacacgttattttagccatcagaatgatgtaattacaagtcatgtggcctcaggaaaagtacatacggtatataacgagggaatgagagttttaaaaaaaaccatggtgctcagtattatgaaaatgatttgaccttatgggttctgtggaagaacctcagagactcccagggcttcccccagaccatactttgagagctgctcgtttaaaatatgtgtaagttatttaaacctttgattcattgtcctcacagagaacgtcaggatgcagatgggcaaatgaaagagctccaggatcagctcgaagcagaacagtatttctcagtaagttcaagacacattaatttgcaaatagcaaacagagttttggttgggatattttatttataccatacaactcatataaaaagagcagctgggcaaaagaatgtagatagtttaagagaaatttattatcattgctagaaaaataattctaagcacaaaacatacctggtgaagctgattaacagcattgttttcaggaagaaaatattttcataatgcaagaaataaaattgtaataaaattatcattttaatagttgtgctttttttgagatcagttttaaaaatatgaagtagaaactcctgttttattgatttaagccaataacatttttttgtctaaattgttaatgtttttccttgcctccttattcattttacctatctgtgctattaaatgagaaatatcactgtgatatccagttgaaaatcatgcttcttaattattacctgaacttgtattagttaattgatgactagaaataggaaagttcattaaactattcatttgctcggggacttagcagtaagaaaatatttgtatgtgttcattctcctttttgtctgaatagcttttgaatgtagaagtaatatttctgatgatgatacgcatttctgttgtattttgctatttagaccctttataaaacacaagttagggagcttaaagaagaatgtgaagaaaagaccaaacttggtaaagaattgcagcagaagaaacaggaattacaggatgaacggtaagtatgagacccttgtctctttttgttcatagctgtatactttgctcctagaacaatgcctggtaatcaccaaataaaaaattattgatgaagtgaattagacaaaaactttcacttcatagtgaaaactgaaccattaaaatgatatattgctaaaatgtagggactctttggctgcccaactggagatcaccttgaccaaagcagattctgagcaactggctcgttcaattgctgaagaacaatattctgatttggaaaaagagaagatcatgaaagagctggagatcaaagagatgatggctagacacaaacaggaacttacggaaaaagatgctacaattgcttctgtaagtcaaattcttggtgcttttttggattatagttaaattgctatatcttaaaccttctttagacatactaagtatcacagatctaaatgaaaaattatatatgctgactacaagatttttaatctagttaactgccaccttctcaatgttgtcagaggagcttactaaaagtgacttcacctgttaatgaattcaaagttaaaggtctaaagtgaaagggtcatttttttttttctttttaaacagaacttagttcagaagaatcttgaaactaccaggaaaacagttccgtgcaggttgaaaaaattgcaataaaaatttcagagagaggtcaaatatcaagtagttaggtttaccctatcaattaactagacctattgaaatgctgcggtaattaaaaagtctggtattagaacagggatattcaatcctgttcagtggaaatgaaaagggaggccagaaagatttctgcacatacaggaacttggtatatatgatgggagtggcagtacacaaatcactgggaaaggacacatttcataaatggtttcagaataactgtgtttttatatggaaaggaataaaattaaatccccactacatcacacacaaaagtaaattctagctatcttaaggactatgaaaaataaaaattttaagctatcagaacagaatctaaaagttgcatatgacagaagacagcataaacaaatgacagaagggagatatttgtaatatatttattaaacaagggatttgtatctagagtatatgtagaatgtctgcaattcagtaagataagattaaagaatttggaagaaaacttagctgaaagagaaaacctaaatatataagcatgtacttaacctcactattgttcaggaaaagcctaggtaaaacaactttgaaataccatttcatacccatcactttggcagaaattcagtagctgacaatttcaagtgtctgaagaatgtctagaaaatggcattcttattcactatgggtagtataaatttagtatggcatagtacagtaagtagtatgacagtttccagtaaattttaggcattcacataatgcagtcagaagaaagtccacattaagataaatacactatagaaatttaggcacaatgcttatagcagcataaatatttagcaaaaactcaaatgtccatgaatgaatgaatgcatgcattaaatgtaatagaagatggaactattacatcagatcttcatttgtatcagcaatttaatgccttaatatgctattgagtgaaaacaattacagaaagataaattcagtaagatagaaaatcgcagcctggcatggtggctcatgcctgtaattgcagcacttttggagttgaaggtgggagtattgcttgagctccaggagtttgagaccagcctaggcaacatagtgagaccctgtttctaccaaaaaaaaaaaaaaattttttttatccaggtgtggtggttcatgcctatagtcccagctagctactcatgggggctgaggtgggaggatccttagagccttggaggctgaggctacagtgagtggtgatcgcacgccattgcactccagcctgggcaacagagcttgagaccttgtctccaaaaagagagaaaaaaaaaaaagaaaatcacataaagccacactgtgtattgtttcatgtgtatataatgaaatacagtcatgggtggaaaggcaaaacacgtaatttacagtaaaacttccttcaggccaggtgtgttggcttatgcctgtaagtaatcccagcactttgagaggcctaggcgggcgatcactcgaggccaggagtttgagaccagcctgaccaacatagtgaaaccccatctctactaaaactataaaaattagccaggtgtggtggcgcatgcctgtaatcccagctactaaggaggctgaggcaggagaatcacttgaacccaggaggcggaggttgcagtgagctgagattgcgccactgcactcctggttgacagagcaagactcacctgggtgacagagcaagactctgtctcaaaaaaaaaaaaaaaagaaaaataagaggtttaacaatattctaggatgtttctcatttgaatcattttataacataaattgtgtaaattgggatgtgattattttttcctctttcatttcttagcttgaggaaactaataggacactaactagtgatgttgccaatcttgcaaatgagaaagaagaattaaataacaaattgaaagatgttcaagagcgtatgtattaacaaaaaatgtttatttttaatatacctaatgtttatcagctgctgtaattaccaatgtaattttaacttttttccatgtttcagaactgtcaagattgaaagatgaagaaataagcgcagcagctattaaagcacagtttgagaagcagctattaacagaaagaacactcaaaactcaagtatgtataatagaatctaaatatgattttgaattttgtctcagtttatctcttttacattttacttctagcattacaaattggtagcagtagtcatcgaatgtaccaatatttgtgaagtcacaattacctgatttttgccaggttgagagaagttagatttgattaatattgttaaattctatagcaactaaaatttttcttaatatttccttttggaatcacattctctttcaatttattgttgtaatttaatgtgtttttctacttttaagaactgttgggattgaccatttgctgacaacctgaaaagtgtcagttagttcactctctgccaactcctacagttgcatatgtactgcatgaacaggtggggtactagatactcttcactgttgttgcacatagaatattttattaatttgatgtcactgcaaaatgttcttcctccagaataaaagaagaaaggtctgcctattaaagtctctctagaactaaaaagtcaaaatggtagaaagcaacatcagatcaattctataaatatttaaattataattctcagaaaacacgagtaaaaatctaatggctcattggatggagaaggatgatgagtagtaaaggaggtgtattatttaaatattatagaaagtgtttctttgtagccctgtatgtagggaaggagagtatttgtgattgtataacttgttgctcttgatgagatactgagaaaccataaacgtaatttattttatttatgtattatatttatttttacattttttaaggctgtgaataagttggctgagatcatgaatcgaaaagaacctgtcaagcgtggtaatgacacagatgtgcggagaaaagagaaggagaatagaaagctacatatggagcttaaatctgaacgtgagaaattgacccagcagatgatcaagtatcagaaagaactgaatgaaatgcaggcagtaagaatactttttggactctagactgaagacttctttttaagaagtagaattattttcatgtctgtgttttactggttatagaccatttctatttaataattattattgaaccaagaagcaaaatgttgagttatgttgcatccaattaacttattgtaattaaatttcttatagcaaatagctgaagagagccagattcgaattgaactgcagatgacattggacagtaaagacagtgacattgagcagctgcggtcacaactccaagccttgcatattggtctggatagttccagtataggcagtggaccaggggatgctgaggcagatgatgggtttccaggtatggatttgttttcagcactaatatttatcttaaatataaatcagttgattgttttaagtcttgcgactgactgctctgaaggaaaaatgtttgtaatttctttaagggaaaacctactccttggagtaaggattcaagtaacatttcaaacttattttatttattgattttttttacaaagtttttcataaacatacaaaagaaaaactccacatgtctagtttttaaattattatattagctctatttttaagctttcgtttcattttctcttctttctgcattcttacttccttttatgttgggtgtttagttcatatcactcagtcacacactatggaatccatgtcattcacctaccagcgttcctctacttctctcaatattgccactaagccttccagttctcacacgctccttgactctgattctgactcagaagaagaatctttgccttacttacccatttcatcggaacctaatggtacaggtgatatcctgaaaatcttctcatctttggagtttttcccactacccttaattttagtccttttgaagattttttatgtaacattaactaataaccactaactctaatatgttgttgtagactcagttaaaaataaactgctgcatgaataaagaatttgtttttaaggtattttctcatggcattgctgttataattgatagatgccaacttgcgagaaatggagtaatacattatattgcttaagagcgcatggtttcactgcttgttttagccattttcaaccaagaagaaattcttcctgaagtttcataacaagagtggtggtacagaaaaagtacttcgactgattcaaaggatatgcttaaggtttttactgagtacttactgacattatcctaggcatatgtccttcataagaaacatgaaagaatttggcccgatcgttaccctgaaagagattacagtttaaatgaaaacagcagagagttccgtcattcagagtcagaggcagccctgtgtgatctttcaagactgcagtttcctcatctaaattaggaaaataattcctgttctgtgcggtttttttaggattaaagagaatttgtgtaaagcatccagcacgattgatacataatagaagttaaataagtgatagctacttttactattagaataacttccccaaatgctatttcacatatttatttcattaaaagacattgatcaaatgtcattaaaacaaattccgaggattcatacacattccttagttgaattacaatgttactgattttgatattttggaatttagaaatcttttgattattttgctgcttattaaccaaattttatctaaaatgtacgtaattggtcaggtgtggtggctcatgcctataatcctagcactttgagaggctgaggcagacagatcacctgaggtcaggagttcgagactagcctggccaacatggtgaaaccccatcgctactaaaaatacaagaaatagctgggcgtgctggcgcgtgcctgtaatcccagctacctgggaagccaagttaggagaatcactggaacccaggatgcacagcctgcagtgagccaagattacgccactacattccagcctgggcgacagagcaagactccatctcaaaaaaaagaaataaaataaaacaaaatttacattattttattttattatagttattctaaaagtccattttctctgaacacgtaattatttaaaatatttactccttgaaaatgtgcacaatgtggccctcttccaaaggaaaaataaaggagtctaaggcaggtgtaccagtgagaatagagagttgctgctgctgccttttttttttttttggcaacttttctcctgaattttataaatgcatgaatttaatcaatggaacatttgactttataaaagtatagactatctgtttccaatatgatataacctggattttgttttgcattgcataactttttactactgatcctgtactattactgtatcctagatgatgtatagtgataaattctaaaggatatattttatttgttttataaatttcatattaaaattttattaagttctttgttatctaaggagaattgttatctttagcctcacatgttgtgcttatttgtagaatcaagattagaaggatggctttcattgcctgtacgaaacaacactaagaaatttggatgggttaaaaaggtaattgatactttggaatatgagccttttgtttttgtttttgttttaactctagtcatttggcttttgtagttgtaggatatacatgactggtacctttagacacatagaacttgtttatacttcaggatttgaaatgatatgattttatttatctttgtaaaaaatttttgtcctcataccttgttaataataagacagattttattgttaggaaattgttgattttgatacttttgctgttttgttgggaaaagaactgtgaatatagtaaaaaagacccacttatttattttcctctgttactatgattattgatgttattatgtttatttttgagaaggttactaatgatgttggatcccaaagctaagtccaaaaaaatttgactttacttctccccacagtttgcttatttaaaatatctattaatataaacaaaatttattgttattttaaggaagactgtcctaaagatatattaaatactttttagttacttagtattttatgatttttattgctaatatagaatttattttcaaaaaaatcaataaataaggtatataaaaacttgaattactgatttcttttctccctgttttaacagtatgtgattgtaagcagtaagaagattcttttctatgacagtgaacaagataaagaacaatccaatccttacatggttttagatatagagtaagtgtttttgttagaatatttagaaactatatcttttaaagtataagagactaacaatgcaatttattagtctcatagtatagctcctactgtaatattgttacattttcctgtgatttgcttcatacagatgaaagtctgggatacagggttagttaaaacatctttatttcatgggcctttgatacattattttttgaaactaattagaaaatttctgacatagaggtttctaaaaatcttaattaattatagaattaatagaacaaaatattctgagttcctaacatgggtcaaagtagtcagtgtttaacgtctgatgtaagtatagaataattaatatataatttgatccttgggtgatattttattcctttattcaaaattttttatagcaagttatttcatgtccgaccagttacacagacagatgtgtatagagcagatgctaaagaaattccaaggatattccaggtaaacatagttttgtttatatttggttggttggctttgttttgtttttttcacatttagaagttctcaagtgacatgacatgttaaatctcttcattctttgaccctcttcaggttacctttatgtttcagtcctatttaaagatggtttgttgctttgtgacttttgtgcttaattctgtttgggaacgttttcattcctttctccattttatttgttaaagcttgcggtgtgtttgtatcatgtttctggtctttgctatatttttgtttaaggttggttatgacttttttttaaacatgaatttttccctttctgtttttgtttaatctcagctctctagaaagttagaaaagtcagttatggaggtaaattttgtaccttgtagcccttttacctccgatttaaagtgaagccacattcttccctttactacttccattttaaaattagtcaaaccaacaatgacttactgatttccttctatgtaagagtcgttgtgcttggtgtactgtgtggaagttggctccttgttttctggatgcttgtcatgtttatttggagtttaatacacatcctttcctctttcttttctctctcaactctcaaaatataggacttttaaaatgaagctgtgctcatagctgttacccagttttctgttaagtattacaaaacaccaattagtgtgattgccacatttcttcaagtgattattttgaacagtctctcccagaaaaacttcctaacacctatgaagttaccttttgctgacctattctgatagtgctgctaaagcatgggtgttataaagaaaataaggaggcagcatttgaacaggatcagttcttttgaaatgcaaaccaaagtgactgtctgatgacttttcttatataagctcttgattaagtttgcgtaatcaagagcttaagtttgtacttcagatacattttcttctctttgaataatttaggctaattttattttacttacactatcagaattgttcctacataaaaaaatagcatgtttggaaatcacttattgttcttttggcattcatagattctgtatgccaatgaaggagaaagtaagaaggaacaagaatttccagtggagccagttggagaaaaatctaattatatttgccacaagggacatgagtttattcctactctttatcatttcccaaccaactgtgaggcttgtatgaagcccctgtggcacatgtttaagcctcctcctgctttggagtgccgccgttgccatattaagtgtcataaagatcatatggacaaaaaggaggagattatagcaccttgcaaaggtaaatgataaattacttgctccatcgatattggttatgttcagatcattttaagcacattaatttttttttctaatttttctttatagtatattatgatatttcaacggcaaagaatctgttattactagcaaattctacagaagagcagcagaagtgggttagtcggttggtgaaaaagatacctaaaaagcccccagctccagacccttttgcccgatcatctcctagaacttcaatgaagatacagcaaaaccagtctattagacggccaagtcgacagcttgccccaaacaaacctaggtaataaactaaaatgtggtaaggaaaaaaaaaaagtctattaaaatattttgctatttatgttcaaactacaaattttcctaattagttttcctttgctttgtattttagttaactatggaataccaaatgttggaactgtcttaatgtgcatgtcatgttcatcgattcagatgaaagtaatataaacttacttactaaatcacacacatacagtaaattcaaccaaaaatctttaaagatttttgttatgtttatttgtacaataaatcctcacttaacattgtccataggttcttagaacttacaactttaagcaaaataatggctggtcctggaattaagttgtttccttcaaaattgttctgttataaccttgatgagaagaaaatggttttgttatacttcatttagcttaaagtcatactttccaagaacctgtcgatgatgtccagtgaggacttactgtataataatataattttcagcttttataagcacttgagtaatttaataacttaaaagatagaattaacattgtacacagacctcacattgtcaagtgcacacactgtgtttcatattataagcttttattatgttgggtgacttgggaggcaggtttaaaatcagcttaagttttaaatcaaatctataaatttaaaacagtaacttgagtgtgattttaacagcaacatagaccagctttaaaaatgcaaatattagctaatgggtaaagtggttattccttggaattgaggtagagttaggaaaatggagtaaggtcagggatgatcattatgcacaaaaacattttgatggagccattttcggatagctatgtgaaagtcctttagttaaatatcgtgattcacaatagccatttcttggcttactaactacttcagcatttataaacattgctatccattgaacatgaaatgaacacaagaatttggttagctaaaggaaaaagcatatcctttgatcaggtatctgatttcaggtatccttttggttccctaacacaggaccttcagtatatgaatattgatagcattggctgtattgtcagaaattctaatcacaaacatcttagatgaaactttctgaaactaatctctcaaggaaataatttagaatgacaaaggcagaattggtgtttcagcagtgaaaatgttgaatattttgtgtgaggtatgataaaactaaacaaaattaatgattattgactaaagctaaagaaactcagaattcagagacactgaaggccatttcaagtgccttctgtaaaacatctgaaaattaaatttctattattaatattgtagaactattaatgcttaaatggtattttaataccttatagtgtgtagtgatttcagtttccaaagtacttctctgtgtattcttttctctcatttaacttcttatatattatctcatttgctctttaaaatagtcctatggaatagaataggtattgttatatttgtttttgattaagactccagaaggggtttgtctagatctagaactataataactccaaatatccttttgatacatttttttcttttgtgctatttgacacattaatgatttcactacatacgataacatatatggaattagtttatgaggcacgctcccagttatgtaacaggctgtttttatgtacactgacttacaaataccttcctttcccagtccaaatcagcattatggtctatttgagagtacatttacttttgatttttgttacttttttttttttttttaaaaaacttctggccttgccctgtgaatcattcttcattgatttttttaaaaaacacattttgtcatagcaacggtaagtagtaaggatttctttccctcatatctgcatgtaaataaaactaatatcaaaattgactgtaaaatgtgtagtgtatattttgtgaaaaaattcatttaatacattctttgaaattctaaacataaaggtggtcacatttataatataatttggattttgttgtacatctgcaacattatttccattgtttttggcatttgagtctccattgtttcatgtactcctagcattgtgtctgtatctcttacatgaatcaatcaacctgcattttattattattattattattattgagacagggtctcactctgttgcccaggctggagtgcaatggcacgatcatgactcactgcagccttgacctcccaggcccaactgattattctcccacctcagcctcccagagtaggtgggaccacatacatgcaccatgacacctggctaatttttttttgtttttattttctgtagagatgggggtctccctatgttgcccaggctggtctcaaatgcctggccttaagcaatcctcccacctcggcctcccaaagtgctaggattacaggcatgagccaccacgcctggccagtattccattttgaatgtcacattttaagagtcacttatacaaattgaatggtatatagatgagaataacagaggttgcagtatgtcatttgaaagtattatgtagcaagcgaaggaactgaggatattttgttctctaaagacattatttgaaagtgtgagagatcataaatagcactaaacagttaaagaccttttccttggaagatgtattagaagaagaaccaatcagagaggcaaattgtaaatctcattgagtagcatggttccagggaggaatcaagcctcaggctggatggtttttaacattctactggactaaagcccattcagtatacaaatgggtggaaatggtaaagggtcatccaagaaaacagaggcacagaattgctggtgtgtctcagcagtgatctaacatctagctgttcatttgagtttgtttaatattagtcttagcattagtcaatctagctttagttgaactaatttgacatggtatccttcttaaaacaaagtttggctttgttagatacatcaaatataaagtgaacccataaatgttcacttaaccatttttggtaacttttcctctgtgtctttctttgtggtcatctgccattacatcattacatctttttctcttcttttttctttttttttgtgacatgacgtctcactctgtcacccaggctggagtgtagtggcgtgatctcggttcaccctaaccctccaccttccaggttcaagcaattctcctgcctcagccttctgggtagttgggattacagacatgcaccctacaaaattagcactttgggaggccgaggcaggtggatcacgtggtcaggagatcgagaccatcctggctaacacagtgaaaccccatctctactaaaaaatacaaaaaattagctgggcgtggtggcaggcacttgtagtcccagctactcgggaggctgaggcaggagaatggcgtgaacccgggaggcggagcttgtagtgagccgagatcacgccactgcactccagcctgggcgacagtgagactccgtctcaaaaaataaaaataaaaaaataaaaataaaataagactagaaattaattgacagttcataaaaataatgtatagaaatgctattctacaggaatgttttcttggtacttttgaattaaaattaaaatgccatactggaaaagtaggaaatttgtgaataaaatgctaatttttgatgaagacaatttggggagtcctaatttgtttcaatgcaagataaaaatataccagtctgggctgggcgcggtggctcacacctgtaatcccagcactttgggaggccaaggcaggtggatcacctgaggtcaggagttcaagacaagcctggccaagatggtgaaaccccatctctactaaaaatacaaaaattagccaggcgtggtgtcaggcgcctgtaatcccagctactggggaggctgaggcagagaattgcttgaacccaggaggtggaggttgcagtaagccgagatcgcaccactgcactccaacctaggcaacagagcgagactccgtcacacaaaaaaaaaaaaaaaaaaaaaaattatataccagtttggctagagggtatttctctttaattatttttcttttaaagattttttttaacgcagtatttaatgcatgcagaaaagtataaagcaaaaatgtaacaaatgctcacttaccgagttttaagaagtgtaaaacatggcagcacagttaaaacttaaaggaggaagtagctattgtgtcattattatcttatctttgctcttcctcatttctaaatgttaaagaattaacagtctacttgggaaaataatgaagttatatacaatttgaagtgtcaaaaataaatccataggtgaatatatacctgatcttgaattggggaagaacttccaaataataaaagcaaagaaaacaaagccaaagatcaactaccccaaaagtaaagccttgtaaatttaaaaaacaccatgtatttccaaaatatatgagaaagatgagttagtatcttcacatacgaaaagttcttataaatcattgagaaaaaagattgcctcatccccatacaaaattaatgaggcgcatgcaggcattattatggaaatagctgttaaatgtaaaaaaaagtgatcagcctgattacagtagtccccctttatctcaagggatatgtagtccaagacccccagtggatgcctggaatcacgaatagtactggaccgtacacatacaattttttaaaatctgataatgaagaccattagtaagtgactaacaagcatggatatgctggacaaagggatgactcacatcccaggcaggacagagtgggatggcacaagatgtcatcacgctgtttacaacgttgggcagtttaaaacttctaagttgttttgagcttttctatttaatgttttcagactgtggttcaccactggtaacttgaaaccatggaaagtgaagacaaggatatggggggactactgtattaagaaattagcattaaattaaaactataacataaaaccatttttcacctgccaaactggcacgggttaagaaacgaaatgggtacttttgtggactgctggtagaactccaaattaaatgcactctttccaaagcatctttgacaataagtttcgcaggcctgaactatatccctgttaatggtggagacagtcaagcaacaggcaattacagtactatgtaaaatgctgtttataatatagggatgaacagagcgcttggggaaacgagggaagcatggagaattctgcctgaggacattaagaaagatctcaaacaatggaggatggataattttacaagcagacaaataagggaaaatcagttccaagcaaaatgtcatgtgcagaggtacaaagtcatcagaattacttatgtatttgtaattttgtgttggcttggcgttgggagaaggcaagggtagggagtggtaaaagatgatgtgacactagagagaaagtctgaacccaactgaaaagctccatgtacactgtgctcaggagttttgatttataagtagaagtctttcagtaagggattggtattcaggcttaatgagatcctgaactgagtacttgacaatgaaaacgaagaaaataaacctggatttggaaagatttcttcagttgaaataactagaattagatgactgattcgaagggatgagggagagggttgtaagggaagtctcgtcatacactacagtcgcatctagcgattagacttaaatttgagattgtgacactggcacacacttcaaaggttttgaaagggtatgcaatgcagctttctcctaacctatgctaaagctgaggcttggatgccctggaaggcctgctgatcacaatctcccaagcagtagagctgaaactatggctataagttacattatatataagtctagagaagtgagtgtgtgccaggttgcgatatgtgttcagtgagtaattatatctgtttgtgtgttttctcaaatgttgtgctgtgtttagcacattttaaaagagtaatttgagtcgctgtgtttattttaaattagagtaatcatccattaacctattctgtcagtgtttctcaaagttaaccagctgtatcagaaatcgcctcaggttttttatttgaaaatgcaaatatttgggcccttttcagtcatatctaaatctcttggaatgaggccttataaagagcagtaggtaaatcatatacactaaagtttcttactttagaagtgtgtaaataagaaccactgacaatagtgattacaggtgagactttggggaccagatgagttccttggcacaagttgattcatgaacaccacagttttaaaaatgaaaaagttactgcttttttttattatttatttatttttatttttatttatttattaattttttgagacgaagtctcactcttgttccccaggctggagtgcaatggcacgatctcggctcactacaacttccgcctcctggattcaagtgactctcctgcctcagcctcctgagtagctgtgattacaggcacctgccaccatgcccagctaatttttgtatttttagtagagacatggtttcaccatgttggccaggctggtcttgaactcctcacctcaggtgatctgcccgcctcagcctcccaaagtgctgggattacagacgtgagccaccgcatctggccaggtggctatttttaaaaacaaagatgatagcaatattacagtttaggttattgaattagaaagaaaagaccacatatatcccaactctaagtccaatttagccaagatgacttgctaatgctacttatgtacctgtggcttttcccttgtccctagtttttcatatgcaggacaaagctcttggtgacacattgagcaggcagggtcctactggaattcagaaagctgctttcttattctattactccctttttaccccatggtttttggtgctatgatggaaaaactgagctgacaatctgaccactttggtgaaggggaacattgacaaatgtgctttcataattctcaaatcaaactgggcatcaggatggttatgtgtttatctggggtatgggagtgaggagggagaagcagattgtttcttattatcccaaatatgatcgctgtcttcaaatatctggaaagtgtacttggccaacatgattatatgcatttatatataaagggcaaggcttccctatgtgcgtccgtcttaattttaatcttgttgttatccatgaagggaaaattaaaatgcttacaagcacattcaaagtatgatttctaagtcataacattaagttacagtttctaaagagtgttagagtataaatttacaaacctcctattgcagattgcttgatttggcatttaaagactgggattggtcatttgatgatgttgatggtggtggtgatgatgatgacgatgtttttgatttctgaagaaataaatggggtaaatcaaaaaatgaaaaatcagttattttagtacttcaacgtagtgcatgtggtttgccacttgggctttcattattttttatttttgaaacttgtttttaatagtatatagttaaaagtagttttcgaaaagttgctaactgaaatttacatgttaagtgtaaaagtgaaatgctatgttcagattctttattggctataaatttttagtacagttagaatttatcttaggaatgagatgtagaaatcacaaaaggagttaattctgatacgttctgttcattccaaagaagccatattcagaagagaagtaaaatttacaacgttttcaagttcctacagctatattagtttgtgaacatagcatgagattcctttctccatctctctccttttatttccaacttgcaagaattgaaagcataaaaactttataagtctaataagtgctgtgaaatagctatttctgatttggcatttttgtgtgtggtgctgtgaaatgtttgctttgtgagaatttaatgttacccttgctgaagaatgtcagtgatacgctgtgagaattgtgcttttagaaaatgtaaaatagtttggttaatagtggctaaaggagatttgaatgaaagttgagcctcaagttaaaccttttacatagaaggatttaaaagaaataatgtgtgttttagtctaagtaagcaagttgcaaaacataaatcaggtagtactggtatctatttataatcagatttcatagagtagcttgtatatatttactacaacaatgtagttggtcctatcttatagaaaaacaaaatgtggcttagggttgaacagccaagtagaacctgatcaataggcccatttccctttcagctacatgaggcagctggcagttaaaccccaaatcaaacttttatcttctaagttattctgtggtatattgtttaaccctaatagcttgttaaccatattaaaatgtgtgtgtaatgtgtgtagctaatattccaaaatcccaagttgttttgggaaagaatataattgcatgttgtacctataggaaaagtaatacagtaagtatgtttatgcatgattttagtgttaaaaaatatagtagctggaagactatatagtttaataatgtgaatggaatgctttttctaggaatttaacactcttaaattatttcactgtatcaactaactttatttttcctttcttttcagctaactgccttctatgaaagcagtcattattcaaggtgatcgtattcttccagtgaaaacaagactgaaatatgatggcccaaaatttattaaaaagctatattttcctgagagactgatacatacactcatacatatatgtgttccccttttccctgtaatataaattacaaatctgggctcctttgaagcaacaggttgaaccaacaatgattggttgatagactaaggatatatgcaactcttccagacttttccataaagctctctcggcagtcgctcacactacaatgcacacaaggattgagaagagttaaaggctaaagaaaacatcttttctagcttcaacagagaggtttcaccagcacatttaccagaagaatctgggaatggattccactacagtgatattgactgcatctttaagaagtgaccattatactgtgtatatatatataaacacacacacatatatatatatatatatagtactctaatactgcaagaaggttttttaaacttcccactttattttttatacacattaatcagatatcattacttgctgcagttgcaactatgcacttgtataaagccataatgttggagtttatatcactcattcctgtgtacctgatggaagttgcatgttcatgtttaagcagttactgtaacaagaagtttaaagttaattatatcagtttcctaatgcttcatgataggcaactttacccattttgaatgccttaatttaatttttttcaaagtctcagccctgtctgtattaaaaaacaaaaaaagcgtttaccagctcttaggatgtaaactagctttgtggaagataaatcgtgcactatttttacacataaatagttatatcaatgtcagcctattttgattaacaaatgtttttaaagtattattggttatagaaacaataatggatggtgttggaactaatatatccttgatgtctgtctattattcattcaactctttttacagacctcagtattagtctgtgactacaaaatattttatttgctttaaatttgctggctaccctagatgtgtttttattcctggtaaagacatttgtgattacattttcacacttaagattcaaaatttttcccaaatataaagaaaactaagacagactgtagatgcattttaaatatttaaatatgatcctcagacatgcagctgtgtgtggcagtattttagtaccgggttaagaaaactggcaactgggaagaagtggcctcaaaggcacttaatttgatttttattttttaaatgctgtcaaagttacagtttacgcaggacattcttgccgtattctcatgatcccagataagtgtgtgttttatactgcaacaatatgcagcaatggtaagcgtaaagttttttttttgtttttgtttttttttatattatgaagtcttttaacagtctctctttatataaatacacagagtttggtatgatatttaaatacatcatctggccaggcatggtggcttacgcctgtaatcctagcactttgggaggccaagacgggcggatcacctgaggtgaggagttcaagaccagcctgcccaacatagtgaaactccgtctctaccaatatacaaaaattagccgggcatgatggtggtggcctgtaatcccagctacttgggaggctgagacaggagaatcgcttgaacccaggagacggtggttgcagtgagcgaagatcgagccactgcactccagcctgggcagctgaacaagactccgtctc
